(12) United States Patent
Pramod et al.

(10) Patent No.: US 12,234,469 B2
(45) Date of Patent: *Feb. 25, 2025

(54) COMPOSITIONS AND METHODS FOR PRODUCING TOBACCO PLANTS AND PRODUCTS HAVING ALTERED ALKALOID LEVELS

(71) Applicant: ALTRIA CLIENT SERVICES LLC, Richmond, VA (US)

(72) Inventors: Sreepriya Pramod, Fredericksburg, VA (US); Marcos Fernando de Godoy Lusso, Chesterfield, VA (US); Jesse Frederick, Richmond, VA (US); Andrew Adams, Midlothian, VA (US); Dongmei Xu, Glen Allen, VA (US)

(73) Assignee: Altria Client Services LLC, Richmond, VA (US)

( * ) Notice: Subject to any disclaimer, the term of this patent is extended or adjusted under 35 U.S.C. 154(b) by 133 days.

This patent is subject to a terminal disclaimer.

(21) Appl. No.: 17/337,161

(22) Filed: Jun. 2, 2021

(65) Prior Publication Data

US 2022/0010324 A1 Jan. 13, 2022

Related U.S. Application Data

(60) Provisional application No. 63/034,061, filed on Jun. 3, 2020.

(51) Int. Cl.
C12N 15/82 (2006.01)
(52) U.S. Cl.
CPC .................. *C12N 15/8243* (2013.01)
(58) Field of Classification Search
None
See application file for complete search history.

(56) References Cited

U.S. PATENT DOCUMENTS

| | | | |
|---|---|---|---|
| 4,516,590 A | 5/1985 | Teng | |
| 4,528,993 A | 7/1985 | Sensabaugh, Jr. et al. | |
| 4,660,577 A | 4/1987 | Sensabaugh et al. | |
| 4,732,856 A | 3/1988 | Federoff | |
| 4,762,785 A | 8/1988 | Comai | |
| 4,848,373 A | 7/1989 | Lenkey | |
| 4,945,050 A | 7/1990 | Sanford et al. | |
| 4,987,907 A | 1/1991 | Townsend | |
| 5,004,863 A | 4/1991 | Umbeck | |
| 5,013,658 A | 5/1991 | Dooner et al. | |
| 5,104,310 A | 4/1992 | Saltin | |
| 5,141,131 A | 8/1992 | Miller, Jr. et al. | |
| 5,149,645 A | 9/1992 | Hoekema et al. | |
| 5,159,135 A | 10/1992 | Umbeck | |
| 5,177,010 A | 1/1993 | Goldman et al. | |
| 5,231,019 A | 7/1993 | Paszkowski et al. | |
| 5,316,931 A | 5/1994 | Donson et al. | |
| 5,372,149 A | 12/1994 | Roth et al. | |
| 5,463,174 A | 10/1995 | Moloney et al. | |
| 5,464,763 A | 11/1995 | Schilperoort et al. | |
| 5,469,976 A | 11/1995 | Burchell | |
| 5,491,081 A | 2/1996 | Webb | |
| 5,563,055 A | 10/1996 | Townsend et al. | |
| 5,589,367 A | 12/1996 | Donson et al. | |
| 5,659,026 A | 8/1997 | Baszczynski et al. | |
| 5,689,035 A | 11/1997 | Webb | |
| 5,789,156 A | 8/1998 | Bujard et al. | |
| 5,814,618 A | 9/1998 | Bujard et al. | |
| 5,866,785 A | 2/1999 | Donson et al. | |
| 5,879,918 A | 3/1999 | Tomes et al. | |
| 5,886,244 A | 3/1999 | Tomes et al. | |
| 5,889,190 A | 3/1999 | Donson et al. | |
| 5,889,191 A | 3/1999 | Turpen | |
| 5,932,782 A | 8/1999 | Bidney | |
| 5,981,840 A | 11/1999 | Zhao et al. | |
| 6,072,050 A | 6/2000 | Bowen et al. | |
| 7,700,834 B2 | 4/2010 | Xu et al. | |
| 8,124,851 B2 | 2/2012 | Dewey et al. | |
| 8,319,011 B2 | 11/2012 | Xu et al. | |

(Continued)

FOREIGN PATENT DOCUMENTS

| | | |
|---|---|---|
| CN | 108271341 A | 7/2018 |
| WO | WO 00/67558 A1 | 11/2000 |

(Continued)

OTHER PUBLICATIONS

Kudithipudi C, Mossis JW, Lusso M, Shen Y, Qi D, Davis GA, Lion K, Xu D, Warek U and Strickland J. 2016, CIRESTA Cibgress, Agroinomy/Phytopathology Groups, AP 20.*
Bowman et al., "Revised North Carolina Grade Index for Flue-Cured Tobacco," *Tobacco Science,* 32:39-40 (1988).
Cermak et al., "efficient design and assembly of custom TALEN and other TAL effector-based constructs for DNA targeting," *Nucleic Acids Research,* 39(12):e82 (2011).
Chaplin et al., "Agronomic, Chemical, and Smoke Characteristics of Flue-cured Tobacco Lines with Different Levels of Total Alkaloids," *Crop Science,* 76(1):133-136 (1983).
Chaplin et al., "Association Between Percent Total Alkaloids and Other Traits in Flue-cured Tobacco," *Crop Science,* 16(3):416-418 (1976).

(Continued)

*Primary Examiner* — Cynthia E Collins
(74) *Attorney, Agent, or Firm* — Arnold & Porter Kaye Scholer LLP

(57) ABSTRACT

The present disclosure provides tobacco having genetic modification(s) in a group of ERF genes. Also provided are tobacco plants with altered total alkaloid and nicotine levels and commercially acceptable leaf grade, their development via breeding or transgenic approaches, and production of tobacco products from these tobacco plants. Further provided are compositions and methods for producing tobacco plants having novel mutations or alleles to reduce nicotine levels. Further provided are sequence polymorphisms and molecular markers for breeding tobacco with reduced nicotine or alkaloids while maintaining tobacco leaf grade and tobacco product quality.

7 Claims, 30 Drawing Sheets

Specification includes a Sequence Listing.

(56) References Cited

U.S. PATENT DOCUMENTS

| | | | |
|---|---|---|---|
| 9,187,759 | B2 | 11/2015 | Dewey et al. |
| 9,228,194 | B2 | 1/2016 | Dewey et al. |
| 9,228,195 | B2 | 1/2016 | Dewey et al. |
| 9,247,706 | B2 | 2/2016 | Dewey et al. |
| 11,950,563 | B2* | 4/2024 | Pramod ............... C12N 15/8218 |
| 2004/0118422 | A1 | 6/2004 | Lundin et al. |
| 2005/0178398 | A1 | 8/2005 | Breslin et al. |
| 2006/0191548 | A1 | 8/2006 | Strickland et al. |
| 2007/0240728 | A1 | 10/2007 | Hashimoto et al. |
| 2008/0120737 | A1 | 5/2008 | Hashimoto et al. |
| 2016/0374387 | A1 | 12/2016 | Adams et al. |
| 2017/0233756 | A1 | 8/2017 | Begemann et al. |
| 2019/0216037 | A1* | 7/2019 | Pramod .................. A24B 13/00 |

FOREIGN PATENT DOCUMENTS

| | | | |
|---|---|---|---|
| WO | WO 2004/041006 A1 | 5/2004 | |
| WO | WO 2011/027315 A1 | 3/2011 | |
| WO | WO 2018237107 A1 * | 12/2018 | |

OTHER PUBLICATIONS

Christensen et al., "Sequence analysis and transcriptional regulation by heat shock of polyubiquitin transcripts from maize," *Plant Molecular Biology*, 12:619-632 (1989).

Christensen et al., "Maize polyubiquitin genes: structure, thermal perturbation of expression and transcript splicing, and promoter activity following transfer to protoplasts by electroporation," *Plant Molecular Biology*, 18:675-689 (1992).

Christou et al., "Stable Transformation of Soybean Callus by DNA-Coated Gold Particles," *Plant Physiology*, 87(3):671-674 (1988)

Collins et al., "Determination of Nicotine alkaloids in Tobacco Using the Autoanalyzer," *Tobacco Science*, 13:79-81 (1969).

Coresta Method No. 62, "Determination of Nicotine in Tobacco and Tobacco Products by Gas Chromatographic Analysis," revised Apr. 2020.

Crossway et al., "Micromanipulation techniques in Plant Biotechnology," *Biotechniques*, 4(4):320-334 (1986).

Davis, "A Combined Automated Procedure for the Determination of Reducing Sugars and Nicotine Alkaloids in Tobacco Products Using a New Reducing Sugar Method," *Tobacco Science*, 20:139-144 (1976).

De Wet et al., "Exogenous gene transfer in maize (*Zea mays*) using DNA-treated pollen," in The Experimental Manipulation of Ovule Tissues, Chapman edition, Longman, New York (1985).

D'Halluin et al., "Transgenic maize plants by tissue electroporation," *Plant Cell*, 4(12):1495-1505 (1992).

Doyle et al., "TAL Effector-Nucleotide Targeter (TALE-NT) 2.0: tools for TAL effector design and target prediction," *Nucleic Acids Research*, 40:W117-W122 (2012).

Estruch et al., "Transgenic plants: An emerging approach to pest control," *Nature Biotechnology*, 15:137 (1997).

Fedoroff et al., "Cloning of the bronze locus in maize by a simple and generalizable procedure using the transposable controlling element Activator (Ac)," *Proc. Natl. Acad. Sci. USA*, 81(12):3825-3829 (1984).

Finer et al., "Transformation of soybean via particle bombardment of embryogenic suspension culture tissue," *In Vitro Cellular & Developmental Biology—Plant*, 27:175-182 (1991).

Gaj et al., "ZFN, TALEN, and CRISPR/Cas-based methods for genome engineering," *Trends in Biotechnology*, 31(7):397-405 (2013).

Gatz et al., "Regulation of a modified CaMV 35S promoter by the Tn10-encoded Tet repressor in transgenic tobacco," *Molecular and General Genetics MGG*, 227:229-237 (1991).

Hibi et al., "Putrescine N-Methyltransferase in Cultured Roots of Hyoscyamus albus," *Plant Physiology*, 100: 826-35 (1992).

Hildering et al., "Chimeric Structure of the Tomato Plant After Seed Treatment with EMS and X-Rays," in The Use of Induced Mutations in Plant Breeding. Pergamon Press, pp. 317-320 (1965).

Hiratsu et al., "Dominant repression of target genes by chimeric repressors that include the EAR motif, a repression domain, in Arabidopsis," *The Plant Journal*, 34(5):733-739 (2003).

Hoekema et al., "A binary plant vector strategy based on separation of vir- and T-region of the Agrobacterium tumefaciens Ti-plasmid," *Nature*, 303:179-180 (1983).

International Search Report and Written Opinion dated Nov. 22, 2021, PCT/US2021/035498.

Kaeppler et al., "Silicon carbide fiber-mediated DNA delivery into plant cells," *Plant Cell Reports*, 9:415-418 (1990).

Kaeppler et al., "Silicon carbide fiber-mediated stable transformation of plant cells," *Theoretical and Applied Genetics*, 84:560-566 (1992).

Kajikawa et al., "Genomic insights into the Evolution of the Nicotine Biosynthesis Pathway in Tobacco," *Plant Physiology*, 174:999-1011 (2017).

Kosambi, "The estimation of map distances from recombination values," *Annals of Eugenics*, 12(1):172-75 (1944).

Last et al., "pEmu: an improved promoter for gene expression in cereal cells," *Theor Appl Genet*, 81:581-588 (1991).

Legg et al., "registration of La Burley Tobacco Germplasm," *Crop Science*, 10:212 (1970).

McCabe et al., "Stable Transformation of Soybean (*Glycine max*) by Particle Acceleration," *BioTechnology*, 6:923-926 (1988).

McCallum et al., "Targeted screening for induced mutations," *Nature Biotechnology*, 18:455-457 (2000).

McNellis et al., "Glucocorticoid-inducible expression of a bacterial avirulence gene in transgenic *Arabidopsis* induces hypersensitive cell death," *The Plant Journal*, 14(2):247-257 (1998).

Miller et al., "A Grade Index for Type 22 and 23 Fire-Cured Tobacco," *Tobacco International*, 192:55-57 (1990).

Morita et al., "Vacuolar transport of nicotine is mediated by a multidrug and toxic compound extrusion (MATE) transporter in Nicotiana tabacum," *Proc. Natl. Acad. Sci. USA*, 106(7):2447-2452 (2009).

Odell et al., "Identification of DNA sequences required for activity of the cauliflower mosaic virus 35S promoter," *Nature*, 313:810-812 (1985).

Official Standard Grades for Burley Tobacco (U.S. Type 31 and Foreign Type 93) (effective Oct. 1990).

Official Standard Grades for Flue-Cured Tobacco (U.S. Types 11, 12, 13, 14 and Foreign Type 92) (effective Mar. 1989).

Official Standard Grades for Georgia and Florida Shade-Grown Cigar-Wrapper Tobacco (U.S. Type 62) (effective Mar. 1971 ).

Official Standard Grades for Ohio Cigar-Leaf Tobacco (U.S. Types 42, 43, and 44) (effective Nov. 1963).

Official Standard Grades for Pennsylvania Seedleaf Tobacco (U.S. Type 41) (effective 1965).

Official Standard Grades for Wisconsin Cigar-Binder Tobacco (U.S. Types 54 and 55) (effective Oct. 1969).

Okuzaki et al., "Improvement of the plastid transformation protocol by modifying tissue treatment at pre- and post-bombardment in tobacco," *Plant Biotechnology*, 29:307-310 (2012).

Paszkowski et al., "Direct gene transfer to plants," *The EMBO Journal*, 3(12):2717-2722 (1984).

Poehlman et al., "Breeding Field Crops," 4th edition, New York (3.sup.rd ed), 1987.

Porta et al., "Use of Viral Replicons for the Expression of Genes in Plants," *Molecular Biotechnology*, 5:209-221 (1996).

Riggs et al., "Stable transformation of tobacco by electroporation: Evidence for plasmid concatenation," *Proc. Natl. Acad. Sci. USA*, 83:5602-5606 (1986).

Rushton et al., "TOBFAC: the database of tobacco transcription factors," *BMC Bioinformatics* 9:53 (20080.

Sanford et al., "[36] Optimizing the biolistic process for different biological applications," *Methods Enzymology*, 217:483-510 (1993).

Schena et al., "A steroid-inducible gene expression system for plant cells," *Proc. Natl. Acad. Sci. USA*, 88:10421-10425 (1991).

Shillito et al., "Direct Gene Transfer to Protoplasts of Dicotyledonous and Monocotyledonous Plants by a Number of Methods, Including Electroporation," *Methods in Enzymology*, 153:313-336 (1987).

(56) References Cited

OTHER PUBLICATIONS

Shoji et al., "Clustered Transcription Factor Genes Regulate Nicotine Biosynthesis in Tobacco," *The Plant Cell*, 22:3390-409 (2010).
Singh et al., "Cytological characterization of transgenic soybean," *Theor. Appl. Genet.*, 96:319-324 (1998).
Smith and Flower, "Chapter 4B and Chapter 4C" in Tobacco: Production, Chemistry and Technology, Davis & Nielsen edition., Blackwell Publishing, Oxford (1999).
Tomes et al., Plant Cell, Tissue and Organ Culture, Chapter 16: Direct DNA Transfer into Intact Plant Cells via Microprojectile Bombardment, Fundamental Methods edition, Gamborg and Phillips, Springer-Verlag, Berlin (1995).
Tso, "Chapter 1 Seed to Smoke" in Tobacco, Production, Chemistry and Technology, Davis & Nielsen eds., Blackwell Publishing, Oxford (1999).
Velten et al., "Isolation of a dual plant promoter fragment from the Ti plasmid of *Agrobacterium tumefaciens*," *The EMBO Journal*, 3(12):2723-2730 (1984).
Verkerk, "Chimerism of the tomato plant after seed irradiation," *Neth. J. Agric. Sci.*, 19:197-203 (1971).
Weising et al., "Foreign Genes in Plants: Transfer, Structure, Expression, and Applications," *Annu. Rev. Genet.*, 22:421-477 (1988).
Wernsman et al. Chapter Seventeen. Tobacco. In: Cultivar Development. Crop Species. W.H. Fehr (ed.), MacMillan Publishing Co., Inc., New York, NY, pages 669-698 (1987)
Centers for Disease Control and Prevention's Protocol for Analysis of Nicotine, Total Moisture and pH in Smokeless Tobacco Products, as published in the Federal Register vol. 64, No. 55, pp. 13897-13912 (Mar. 1999)(and as amended in vol. 74, No. 4, Jan. 2009).
"CORESTA Recommended Method No. 7: Determination of Nicotine in the Mainstream Smoke of Cigarettes by Gas Chromatographic Analysis," pp. 1-5, (1987) (updated Aug. 1991) (Paris, France).
"Draft for Diplomatic Conference for the Revision of the International Convention for the Protection of New Varieties of Plants," Mar. 4-19, 1991 (Geneva, Switzerland).
Miller "Memorandum: Proposed Burley Tobacco Grade Index," Legacy Tobacco Document Library, The University of Tennessee Agricultural Experiment Station (Bates Document #523267826-523267833) (Jul. 1988) (Knoxville, USA).
Agrawal et al., "RNA interference: Biology, Mechanism, and Applications," *Microbiology and Molecular Biology Reviews* 67(4), pp: 657-685 (Dec. 2003) (electronic publication), DOI: 10.1128/MMBR.67.4.657-685.2003.
Patent Search Report issued in Chinese Patent Application No. 2021800576993, dated Nov. 29, 2023, 4 pages (with English translation).

\* cited by examiner

COMPOSITIONS AND METHODS FOR PRODUCING TOBACCO PLANTS AND PRODUCTS HAVING ALTERED ALKALOID LEVELS

CROSS-REFERENCE TO RELATED APPLICATION AND INCORPORATION OF SEQUENCE LISTING

This application claims the benefit of U.S. Provisional Application No. 63/034,061, filed Jun. 3, 2020, the entirety of which is herein incorporated by reference. A sequence listing contained in the file named "P34813US01_SL.TXT" which is 2,780,435 bytes (measured in MS-Windows®) and created on Jun. 2, 2021, is filed electronically herewith and incorporated by reference in its entirety.

FIELD

The present disclosure provides a low alkaloid-associated chromosomal deletion region (LA_associated_region), a tobacco Nic1b locus, and genes in or around the region or locus. Also provided are tobacco plants with altered total alkaloid and nicotine levels and commercially acceptable leaf grade, their development via breeding or transgenic approaches, and production of tobacco products from these tobacco plants.

BACKGROUND

Four major alkaloids are found in tobacco: nicotine, nornicotine, anabasine, and anatabine. Nicotine is the predominant alkaloid, usually accounting for more than 90% of the total alkaloids in commercial tobacco cultivars. Nicotine biosynthesis occurs predominantly in tobacco roots. Tobacco plants then transport nicotine through the vascular bundle to leaves where nicotine is then stored in the vacuoles.

A variety of factors affect tobacco alkaloid levels including genotype, environment, fertilization, and agronomic practices (for example, nicotine production is stimulated by topping, wounding, and herbivore damage). Low-alkaloid traits initially found in strains of Cuban cigar tobacco varieties were introduced into cigarette varieties through a series of backcrosses. Low-alkaloid tobacco germplasm was subsequently registered in the genetic background of cultivar Burley 21 (Legg et al., *Crop Science,* 10:212 (1970)). Genetic studies using the low alkaloid Burley 21 (LA BU21) lines indicated that two unlinked loci contribute to nicotine levels in the tobacco leaf. These two loci are referred to as Nic1 and Nic2. nic1 and nic2 (same as nicotine 1 and nicotine 2, respectively) mutations in LA BU21 are semidominant. They show dose-dependent effects on nicotine levels, with the effects of nic1 about 2.4 times stronger than those of nic2. Molecular characterization of Nic2 locus has been reported. The nic2 mutation was shown to contain a deletion of a cluster of transcription factor genes from the ethylene responsive factor (ERF) family, e.g., ERF 189, ERF 115, ERF221, ERF 104, ERF 179, ERF 17, and ERF 168 (Shoji et al., *Plant Cell,* (10):3390-409 (2010)).

Reducing total alkaloid content in tobacco can have many benefits. It can increase the value of tobacco as a biomass resource. Increases in nicotinic alkaloid in tobacco plants may play an important role in protecting plants against insects and herbivores.

Consistent with alkaloids' role in insect defense, LA BU21 was reported to be extremely susceptible to insect damage (Legg et al., *Crop Science,* 10:212 (1970)). A further study comparing isogenic lines of flue-cured tobacco with low total alkaloids percentage (approximately 0.20%) with their "normal" recurring parents (total alkaloids 1.85 to 2.70%) reported that yield, grade index, total N, and reducing sugar content in the low alkaloid lines were lower than in the normal flue-cured cultivars (Chaplin and Weeks, *Crop Science,* 16(3):416-18 (1976)).

There is a need to identify genes that regulate tobacco nicotine levels, and to develop tobacco plants and products that contain altered nicotine levels (e.g., reduced nicotine) while maintaining (if not making superior) tobacco leaf quality.

SUMMARY

In an aspect, the present disclosure provides a modified tobacco plant, or part thereof, comprising a genetic modification in a gene and downregulating the expression or activity of the gene, wherein the gene encodes a nucleic acid sequence having at least 80% identity to a polynucleotide sequence selected from the group consisting of SEQ ID NOs: 38, 48, 49, 52-54, 158, 159, 204, and 205.

In an aspect, the present disclosure provides a modified tobacco plant, or part thereof, comprising a genetic modification targeting a gene and downregulating the expression or activity of the gene, wherein the gene encodes a nucleic acid sequence having at least 80% identity to a polynucleotide sequence selected from the group consisting of SEQ ID NOs: 38, 48, 49, 52-54, 158, 159, 204, and 205.

In another aspect, the present disclosure provides a modified tobacco plant, or part thereof, comprising a non-natural mutation in a polynucleotide having at least 80% identity to a polynucleotide sequence selected from the group consisting of SEQ ID NOs: 3, 13, 14, 17-19, 38, 48, 49, 52-54, 153, 154, 158, 159, 202, 203, 204, and 205.

In an aspect, the present disclosure provides a modified tobacco plant, or part thereof, comprising a recombinant nucleic acid construct comprising a heterologous promoter operably linked to a polynucleotide that encodes a non-coding RNA molecule, where the non-coding RNA molecule is capable of binding to an mRNA having at least 80% identity to a polynucleotide sequence selected from the group consisting of SEQ ID NOs: 38, 48, 49, 52-54, 158, 159, 204, and 205, In another aspect, the present disclosure provides a modified tobacco plant, or part thereof, comprising a genetic modification in a gene and downregulating the expression or activity of the gene, wherein the gene encodes a polypeptide having at least 80% identity or similarity to an amino acid sequence selected from the group consisting of SEQ ID NOs: 73, 83, 84, 87-89, 180, 181, 206, and 207.

In an aspect, the present disclosure provides a modified tobacco plant, or part thereof, comprising a genetic modification targeting a gene and downregulating the expression or activity of the gene, wherein the gene encodes a polypeptide having at least 80% identity or similarity to an amino acid sequence selected from the group consisting of SEQ ID NOs: 73, 83, 84, 87-89, 180, 181, 206, and 207.

In an aspect, the present disclosure provides a modified tobacco plant, or part thereof, comprising a non-natural mutation in a polynucleotide having a nucleic acid sequence encoding a polypeptide having at least 80% identity or similarity to an amino acid sequence selected from the group consisting of SEQ ID NOs: 73, 83, 84, 87-89, 180, 181, 206, and 207.

In another aspect, the present disclosure provides a modified tobacco plant, or part thereof, comprising a recombinant nucleic acid construct comprising a heterologous promoter operably linked to a polynucleotide that encodes a non-coding RNA molecule, where the non-coding RNA molecule is capable of binding to an RNA encoding a polypeptide having at least 80% identity or similarity to an amino acid sequence selected from the group consisting of SEQ ID NOs: 73, 83, 84, 87-89, 180, 181, 206, and 207, wherein the non-coding RNA molecule suppresses the expression of the polypeptide.

In an aspect, the present disclosure provides a population of the tobacco plants described here, cured tobacco material from the tobacco plant described here, and reconstituted tobacco, a tobacco blend and a tobacco product made from the cured tobacco material.

In another aspect, the present disclosure provides a method for producing a reduced-alkaloid tobacco plant, the method comprising: (a) downregulating the expression or activity of a gene encoding (i) a nucleic acid sequence having at least 90% identity to a polynucleotide sequence selected from the group consisting of SEQ ID NOs: 3, 13, 14, 17-19, 38, 48, 49, 52-54, 153, 154, 158, 159, 202, 203, 204, and 205, or (ii) an amino acid sequence having at least 90% identity or similarity to a polypeptide sequence selected from the group consisting of SEQ ID NOs: 73, 83, 84, 87-89, 180, 181, 206, and 207; and (b) harvesting leaves or seeds from the tobacco plant.

BRIEF DESCRIPTION OF THE SEQUENCES

Figure 1:
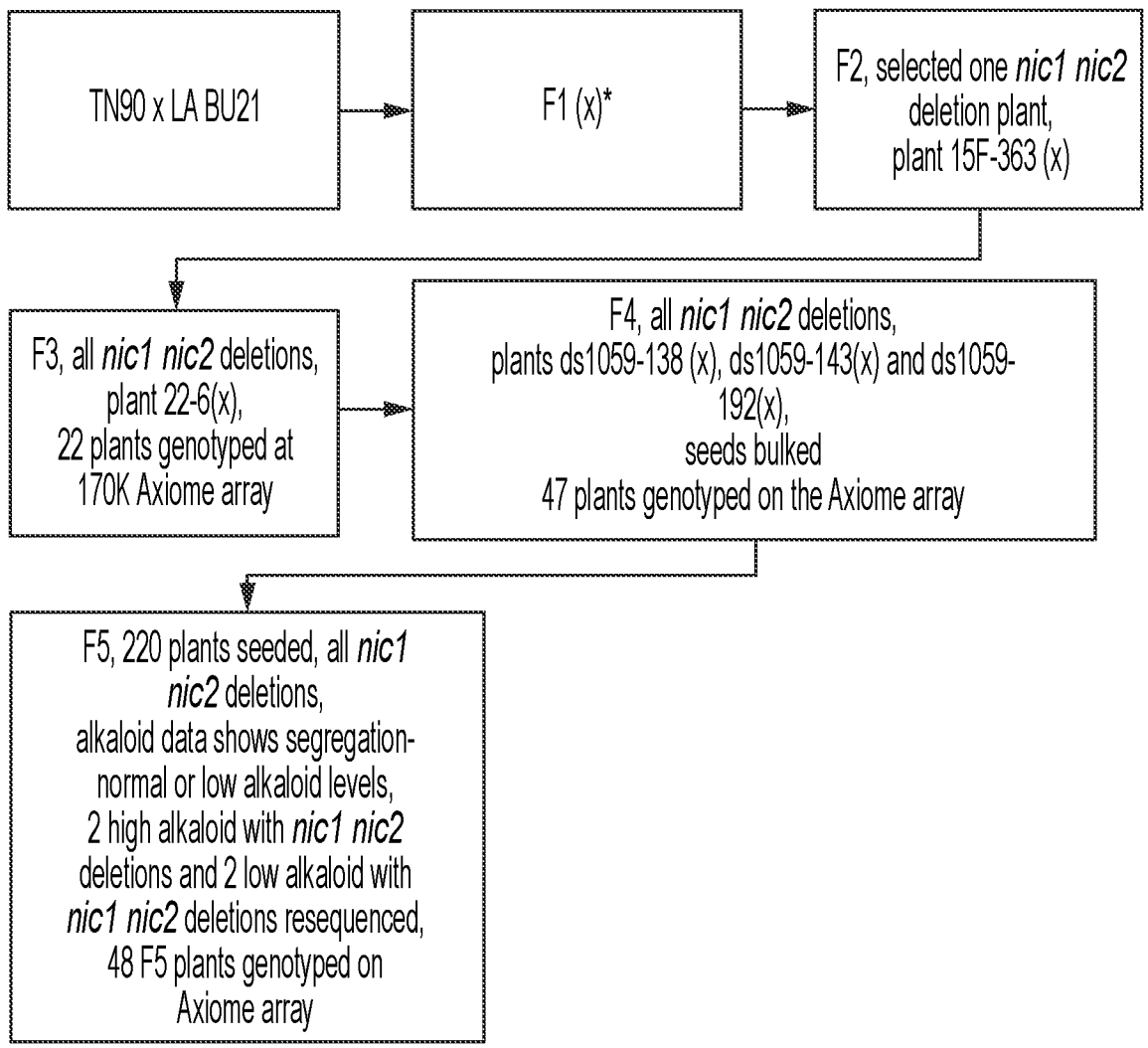
FIG. 1: Breeding scheme for develop F5 lines with nic1 and nic2 deletion marker alleles (*(x) indicates selfing).

SEQ ID No: 1 sets forth a sequence of a LA_associated_region identified from a TN90×LA BU21 cross.

SEQ ID No: 2 sets forth a sequence of the Nic1b Region (including the LA_associated_region).

SEQ ID Nos: 3 to 37 set forth genomic coding sequences (gDNA which typically starts with ATG and ends with a stop codon, but in some instances also contains untranslated region (UTR) sequences) of 35 annotated genes (NCGs) in the Nic1b Region.

SEQ ID Nos: 38 to 72 set forth cDNA sequences of 35 annotated genes (NCGs) in the Nic1b Region.

SEQ ID Nos: 73 to 107 set forth amino acid sequences encoded by 35 annotated genes (NCGs) in the Nic1b Region.

SEQ ID Nos: 108 to 119 set forth exemplary mature artificial miRNA sequences (sense or antisense) for suppressing selected NCG genes.

SEQ ID Nos: 120 to 124 set forth exemplary guide RNA sequences for editing selected NCG genes.

SEQ ID Nos: 125 to 145 set forth 21 SNP marker sequences spanning or flanking Nic1b Region.

SEQ ID Nos: 146 to 148 set forth the genomic coding, cDNA, and amino acid sequences, respectively, of gene locus g31432.

SEQ ID Nos: 149 to 151 set forth the genomic coding, cDNA, and amino acid sequences, respectively, of gene locus g31446.

SEQ ID Nos: 152 to 156 set forth the genomic coding sequences of multiple protein-coding genes and a non-noncoding RNA from the Nic1b Region. SEQ ID Nos: 157 to 161 set forth the corresponding cDNA sequences. SEQ ID Nos: 162 to 183 set forth the corresponding protein or non-coding RNA molecule sequences.

SEQ ID Nos: 184 to 186 set forth the genomic coding sequences of multiple transcription factor genes that exhibit differential expression between normal-alkaloid and reduced-alkaloid tobacco lines. SEQ ID Nos: 187 to 189 set forth the corresponding cDNA sequences. SEQ ID Nos: 190 to 192 set forth the corresponding protein or non-coding RNA molecule sequences.

SEQ ID Nos: 193 to 201 set forth SNP marker sequences immediately next to multiple ERF genes or within a gene encoding a non-coding RNA from the Nic1b Region.

SEQ ID Nos: 202 and 203 set forth the genomic coding sequences of two ERF genes associated with the Nic1b Region. SEQ ID Nos: 204 and 205 set forth the corresponding cDNA sequences. SEQ ID Nos: 206 and 207 set forth the corresponding protein sequences.

SEQ ID Nos: 208 to 214 set forth the genomic coding sequences of seven Nic2_ERF genes. SEQ ID Nos: 215 to 221 set forth the corresponding cDNA sequences. SEQ ID Nos: 222 to 228 set forth the corresponding protein sequences.

Various sequences include "N" in nucleotide sequences or "X" in amino acid sequences. "N" can be any nucleotide, e.g., A, T, G, C, or a deletion or insertion of one or more nucleotides. In some instant, a string of "N" are shown. The number of "N" does not necessarily correlate with the actual number of undetermined nucleotides at that position. The actual nucleotide sequences can be longer or shorter than the shown segment of "N". Similarly, "X" can be any amino acid residue or a deletion or insertion of one or more amino acids. Again, the number of "X" does not necessarily correlate with the actual number of undetermined amino acids at that position. The actual amino acid sequences can be longer or shorter than the shown segment of "X".

DETAILED DESCRIPTION

Unless defined otherwise, technical and scientific terms used herein have the same meaning as commonly understood by one of ordinary skill in the art. One skilled in the art will recognize many methods can be used in the practice of the present disclosure. Indeed, the present disclosure is in no way limited to the methods and materials described. For purposes of the present disclosure, the following terms are defined below.

Any references cited herein, including, e.g., all patents and publications are incorporated by reference in their entirety.

As used herein, the singular form "a," "an,' and "the" include plural references unless the context clearly dictates otherwise. For example, the term "a compound" or "at least one compound" may include a plurality of compounds, including mixtures thereof.

The term "about" is used herein to mean approximately, roughly, around, or in the region of When the term "about" is used in conjunction with a numerical range, it modifies that range by extending the boundaries above and below the numerical values set forth.

As used herein, a "Nic1b locus" refers to any chromosomal position or location within or closely linked to the Nic1b Region. "Nic1b Region" refers to a chromosomal segment of about 1.5 million bps long, corresponding to SEQ ID No. 2 from a TN90 genome, and having allele(s) associated with a low-alkaloid trait. A "nic1b mutation" refers to a mutation in a Nic1b locus.

As used herein, Nic1b_ERF (or the plural form, Nic1b_ERFs) refers to any one of ERF genes or loci at or near a Nic1b locus, and includes, for example, ERF101, ERF110, ERFnew, ERF199, ERF19, ERF130, ERF16, ERF29, ERF210, and ERF91L2. See Table 11 and Kajikawa et al., *Plant physiol.* 2017, 174:999-1011. A "nic1b_erf mutation" refers to a mutation in a Nic1b_ERF gene. As used herein, a mutation or mutant allele is shown in all lower-case and italic. Gene, locus, or protein names are shown in all upper-case or starting with a upper case, and may be italicized or non-italicized.

As used herein, Nic2_ERF (or the plural form, Nic2_ERFs) refers to any one of ERF genes or loci at or near a Nic2 locus, and includes, for example, ERF221, ERF115, ERF168, ERF17, ERF179, ERF189. See Table 12; Shoji et al., *Plant Cell*, (10):3390-409 (2010); and Kajikawa et al., *Plant physiol.* 2017, 174:999-1011.

As used herein, a mutation refers to an inheritable genetic modification introduced into a gene to alter the expression or activity of a product encoded by the gene. Such a modification can be in any sequence region of a gene, for example, in a promoter, 5' UTR, exon, intron, 3' UTR, or terminator region. In an aspect, a mutation reduces, inhibits, or eliminates the expression or activity of a gene product. In another aspect, a mutation increases, elevates, strengthens, or augments the expression or activity of a gene product. In an aspect, mutations are not natural polymorphisms that exist in a particular tobacco variety or cultivar. As used herein, a "mutant allele" refers to an allele from a locus where the allele comprises a mutation. As used herein, "mutagenic" refers to generating a mutation without involving a transgene or with no mutation-related transgene remaining in an eventual mutant. In an aspect, mutagenic is cisgenic. In another aspect, mutagenic is via gene or genome editing. In a further aspect, mutagenic is via random mutagenesis, for example, chemical (e.g., EMS) or physical (r-irradiation) mutagenesis.

In an aspect, a mutation is a "non-natural" or "non-naturally occurring" mutation. As used herein, a "non-natural" or "non-naturally occurring" mutation refers to a non-spontaneous mutation generated via human intervention, and does not correspond to a spontaneous mutation generated without human intervention. Non-limiting examples of human intervention include mutagenesis (e.g., chemical mutagenesis, ionizing radiation mutagenesis) and targeted genetic modifications (e.g., CRISPR-based methods, TALEN-based methods, zinc finger-based methods). Non-natural mutations and non-naturally occurring mutations do not include spontaneous mutations that arise naturally (e.g., via aberrant DNA replication in a germ line of a plant).

It will be appreciated that, when identifying a mutation, the reference DNA sequence should be from the same variety of tobacco. For example, if a modified tobacco plant comprising a mutation is from the variety TN90, then the endogenous reference sequence must be the endogenous TN90 sequence, not a homologous sequence from a different tobacco variety (e.g., K326). Similarly, if a modified tobacco cell comprising a mutation is a TN90 cell, then the endogenous reference sequence must be the endogenous TN90 sequence, not a homologous sequence from a tobacco cell from a different tobacco variety (e.g., K326).

In an aspect, a mutation provided herein creates a dominant allele of the mutated locus. Dominant alleles are alleles that mask the contribution of a second allele at the same locus. A dominant allele can be a "dominant negative allele" or a "dominant positive allele." Dominant negative alleles, or antimorphs, are alleles that act in opposition to normal allelic function. A dominant negative allele typically does not function normally and either directly inhibits the activity of a wild-type protein (e.g., through dimerization) or inhibits the activity of a second protein that is required for the normal function of the wild-type protein (e.g., an activator or a downstream component of a pathway). For example, a dominant negative allele abrogates or reduces the normal function of an allele in a heterozygous or homozygous state. Dominant positive alleles can increase normal gene function (e.g., a hypermorph) or provide new functions for a gene (e.g., a neomorph). A semi-dominant allele occurs when penetrance of a linked phenotype in individuals heterozygous for the allele is less than that which is observed in individuals homozygous for the allele.

In an aspect, a mutation provided herein creates a dominant negative allele of the mutated locus. In another aspect, a mutation provided herein creates a dominant positive allele of a mutated locus.

As used herein, "inducing" a mutation refers to generating a mutation in a polynucleotide sequence via human intervention. Many suitable methods for inducing mutations in tobacco are known in the art. Non-limiting examples of such methods include use of chemical mutagens, use of radiation, and use of nucleases. In an aspect, inducing a mutation comprises the use of an agent selected from the group consisting of a chemical mutagen, irradiation, a transposon, *Agrobacterium*, and a nuclease.

In an aspect, inducing a mutation comprises the use of a chemical mutagen. In an aspect, a chemical mutagen comprises ethyl methanesulfonate (EMS).

In another aspect, inducing a mutation comprises the use of irradiation. In an aspect, irradiation comprises gamma rays, X-rays, or ionizing radiation. In another aspect, irradiation comprises the use of fast neutrons.

In an aspect, inducing a mutation comprises the use of a transposon. In another aspect, inducing a mutation comprises the use of *Agrobacterium*.

In a further aspect, inducing a mutation comprises the use of a nuclease. In an aspect, a nuclease is selected from the group consisting of a meganuclease, a zinc-finger nuclease, a transcription activator-like effector nuclease, a CRISPR/Cas9 nuclease, a CRISPR/Cpf1 nuclease, a CRISPR/CasX nuclease, a CRISPR/CasY nuclease, and a Csm1 nuclease. In an aspect, inducing a mutation comprises the use of a CRISPR/Cas9 nuclease. In an aspect, inducing a mutation comprises the use of a CRISPR/Cpf1 nuclease. In an aspect, inducing a mutation comprises the use of a CRISPR/CasX nuclease. In an aspect, inducing a mutation comprises the use of a CRISPR/CasY nuclease. In an aspect, inducing a mutation comprises the use of a Csm1 nuclease.

In a further aspect, inducing a mutation comprises the use of a nuclease. In an aspect, a nuclease is selected from the group consisting of a meganuclease, a zinc-finger nuclease, a transcription activator-like effector nuclease, a CRISPR/Cas9 nuclease, a CRISPR/Cpf1 nuclease, a CRISPR/CasX nuclease, a CRISPR/CasY nuclease, and a Csm1 nuclease. In an aspect, inducing a mutation comprises the use of a CRISPR/Cas9 nuclease. In an aspect, inducing a mutation comprises the use of a CRISPR/Cpf1 nuclease. In an aspect, inducing a mutation comprises the use of a CRISPR/CasX nuclease. In an aspect, inducing a mutation comprises the use of a CRISPR/CasY nuclease. In an aspect, inducing a mutation comprises the use of a Csm1 nuclease.

Mutations in coding regions of genes (e.g., exonic mutations) can result in a truncated protein or polypeptide when a mutated messenger RNA (mRNA) is translated into a protein or polypeptide. In an aspect, this disclosure provides a mutation that results in the truncation of a protein or polypeptide. As used herein, a "truncated" protein or polypeptide comprises at least one fewer amino acid as compared to an endogenous control protein or polypeptide. For example, if endogenous Protein A comprises 100 amino acids, a truncated version of Protein A can comprise between 1 and 99 amino acids.

In an aspect, a mutation provided herein comprises a null mutation. As used herein, a "null mutation" refers to a mutation that confers a complete loss-of-function for a protein encoded by a gene comprising the mutation, or, alternatively, a mutation that confers a complete loss-of-function for a small RNA encoded by a genomic locus. A null mutation can cause lack of mRNA transcript production, a lack of small RNA transcript production, a lack of protein function, or a combination thereof.

In an aspect, a mutation in an endogenous gene results in a reduced level of expression as compared to the endogenous gene lacking the mutation. In another aspect, a mutation in an endogenous gene results in an increased level of expression as compared to the endogenous gene lacking the mutation.

In an aspect, a non-natural mutation results in a reduced level of expression as compared to expression of the gene in a control tobacco plant. In an aspect, a non-natural mutation results in an increased level of expression as compared to expression of the gene in a control tobacco plant.

In a further aspect, a mutation in an endogenous gene results in a reduced level of activity by a protein or polypeptide encoded by the endogenous gene having the mutation as compared to a protein or polypeptide encoded by the endogenous gene lacking the mutation. In a further aspect, a mutation in an endogenous gene results in an increased level of activity by a protein or polypeptide encoded by the endogenous gene having the mutation as compared to a protein or polypeptide encoded by the endogenous gene lacking the mutation.

In an aspect, a non-natural mutation results in a reduced level of activity by a protein or polypeptide encoded by the polynucleotide comprising the non-natural mutation as compared to a protein or polypeptide encoded by the polynucleotide lacking the non-natural mutation. In another aspect, a non-natural mutation results in an increased level of activity by a protein or polypeptide encoded by the polynucleotide comprising the non-natural mutation as compared to a protein or polypeptide encoded by the polynucleotide lacking the non-natural mutation.

In an aspect, a mutation in a genomic locus results in a reduced level of expression as compared to the genomic locus lacking the mutation. In another aspect, a mutation in a genomic locus results in an increased level of expression as compared to the genomic locus lacking the mutation. In a further aspect, a mutation in a genomic locus results in a reduced level of activity by a protein or polypeptide encoded by the genomic locus having the mutation as compared to a protein or polypeptide encoded by the genomic locus lacking the mutation. In a further aspect, a mutation in a genomic locus results in an increased level of activity by a protein or polypeptide encoded by the genomic locus having the mutation as compared to a protein or polypeptide encoded by the genomic locus lacking the mutation.

Levels of gene expression are routinely investigated in the art. As non-limiting examples, gene expression can be measured using quantitative reverse transcriptase PCR (qRT-PCR), RNA sequencing, or Northern blots. In an aspect, gene expression is measured using qRT-PCR. In another aspect, gene expression is measured using a Northern blot. In another aspect, gene expression is measured using RNA sequencing.

As used herein, a tobacco plant can be any plant from the *Nicotiana* genus including, but not limited to *Nicotiana tabacum*, *Nicotiana amplexicaulis* PI 271989; *Nicotiana benthamiana* PI 555478; *Nicotiana bigelovii* PI 555485; *Nicotiana debneyi*; *Nicotiana excelsior* PI 224063; *Nicotiana glutinosa* PI 555507; *Nicotiana goodspeedii* PI 241012; *Nicotiana gossei* PI 230953; *Nicotiana hesperis* PI 271991; *Nicotiana knightiana* PI 555527; *Nicotiana maritima* PI 555535; *Nicotiana megalosiphon* PI 555536; *Nicotiana nudicaulis* PI 555540; *Nicotiana paniculata* PI 555545; *Nicotiana plumbaginifolia* PI 555548; *Nicotiana repanda* PI 555552; *Nicotiana rustica*; *Nicotiana suaveolens* PI 230960; *Nicotiana sylvestris* PI 555569; *Nicotiana tomentosa* PI 266379; *Nicotiana tomentosiformis*; and *Nicotiana trigonophylla* PI 555572. In an aspect, a tobacco plant described here is a *Nicotiana tabacum* plant.

In an aspect, the present disclosure provides tobacco plants, or part thereof, comprising a mutation in a Nic1b_ERF locus, where the tobacco plant is capable of producing leaves, when cured, having a USDA grade index value of 50 or more. In an aspect, tobacco plants further comprise a mutation in an ERF gene of Nic2 locus. In an aspect, tobacco plants further comprise one or more mutations in two or more, three or more, four or more, five or more, six or more, or all seven genes selected from the group consisting of ERF189, ERF115, ERF221, ERF104, ERF179, ERF17, and ERF168. In an aspect, tobacco plants further comprise one or more mutations in ERF189, ERF115, or both. In an aspect, tobacco plants are capable of producing leaves, when cured, having a USDA grade index value selected from the group consisting of 55 or more, 60 or more, 65 or more, 70 or more, 75 or more, 80 or more, 85 or more, 90 or more, and 95 or more. In another aspect, tobacco plants are capable of producing leaves, when cured, having a USDA grade index value comparable to that of a control plant when grown and cured in similar conditions, where the control plant shares an essentially identical genetic background with the tobacco plant except the mutation. In a further aspect, tobacco plants are capable of producing leaves, when cured, having a USDA grade index value of at least about 65%, at least about 70%, at least about 75%, at least about 80%, at least about 85%, at least about 90%, at least about 95%, or at least about 98% of the USDA grade index value of a control plant when grown in similar conditions, where the control plant shares an essentially identical genetic background with the tobacco plant except the mutation. In a further aspect, tobacco plants are capable of producing leaves, when cured, having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In a further aspect, tobacco plants are capable of producing leaves, when cured, having a USDA grade index value of between 70% and 125%, between 75% and 120%, between 80% and 115%, between 85% and 110%, or between 90% and 100% of the USDA grade index value of the control plant. In an aspect, tobacco plants comprise nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, where the control plant shares an essentially identical genetic background with the tobacco plant except the mutation. In another aspect, tobacco plants comprise a total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In another aspect, tobacco plants comprise a nicotine or total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%. In a further aspect, tobacco plants further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

In an aspect, the present disclosure provides tobacco plants, or part thereof, comprising a mutation in Nic1b_ERF locus, where the tobacco plants are capable of producing leaves, when cured, having a USDA grade index value comparable to that of a control plant when grown in similar conditions, where the control plant shares an essentially identical genetic background with the tobacco plant except the mutation. In an aspect, tobacco plants further comprise a mutation in an ERF gene of Nic2 locus. In an aspect, tobacco plants further comprise one or more mutations in two or more, three or more, four or more, five or more, six or more, or all seven genes selected from the group consisting of ERF 189, ERF 115, ERF221, ERF 104, ERF 179, ERF 17, and ERF 168. In an aspect, tobacco plants further comprise one or more mutations in ERF 189, ERF 115, or both. In another aspect, tobacco plants are capable of producing leaves, when cured, having a USDA grade index value selected from the group consisting of 55 or more, 60 or more, 65 or more, 70 or more, 75 or more, 80 or more, 85 or more, 90 or more, and 95 or more. In another aspect, tobacco plants are capable of producing leaves, when cured, having a USDA grade index value selected from the group consisting of between 50 and 95, between 55 and 95, between 60 and 95, between 65 and 95, between 70 and 95, between 75 and 95, between 80 and 95, between 85 and 95, between 90 and 95, between 55 and 90, between 60 and 85, between 65 and 80, between 70 and 75, between 50 and 55, between 55 and 60, between 60 and 65, between 65 and 70, between 70 and 75, between 75 and 80, between 80 and 85, between 85 and 90, and between 90 and 95. In a further aspect, tobacco plants are capable of producing leaves, when cured, having a USDA grade index value of at least about 65%, at least about 70%, at least about 75%, at least about 80%, at least about 85%, at least about 90%, at least about 95%, or at least about 98% of the USDA grade index value of the control plant. In a further aspect, tobacco plants are capable of producing leaves, when cured, having a USDA grade index value of between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the USDA grade index value of the control plant. In a further aspect, tobacco plants are capable of producing leaves, when cured, having a USDA grade index value of between 70% and 125%, between 75% and 120%, between 80% and 115%, between 85% and 110%, or between 90% and 100% of the USDA grade index value of the control plant. In another aspect, tobacco plants comprise nicotine or total alkaloids at a level below 1%, below 2%, below 5%, below 8%, below 10%, below 12%, below 15%, below 20%, below 25%, below 30%, below 40%, below 50%, below 60%, below 70%, or below 80% of the nicotine or total alkaloids level of the control plant when grown in similar growth conditions. In another aspect, tobacco plants further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

In an aspect, a Nic1b_ERF locus comprises one or more sequences selected from the group consisting of SEQ ID No. 3, 13, 14, 17, 18, 19, 38, 48, 49, 52, 53, 54, 153, 154, 158, 159, and 202 to 205. In an aspect, a Nic1b_ERF locus comprises a sequence or a chromosomal segment of less than 50, 100, 200, 300, 400, 500, 600, 700, 800, 900, 1000, 1500, 2000, 3000, 4000, 5000, 6000, 7000, 8000, or 9000 nucleotides. In another aspect, a Nic1b_ERF locus comprises a sequence or a chromosomal segment of at least 50, 100, 200, 300, 400, 500, 600, 700, 800, 900, 1000, 1500, 2000, 3000, 4000, 5000, 6000, 7000, 8000, or 9000 nucleotides. In a further aspect, a Nic1b_ERF locus comprises a sequence or a chromosomal segment of between 100 and 300, between 100 and 400, between 100 and 500, between 100 and 600, between 100 and 700, between 100 and 800, between 100 and 900, between 100 and 1000, between 100 and 1500, between 100 and 2000, between 100 and 3000, between 100 and 4000, between 100 and 5000, between 100 and 6000, between 100 and 7000, between 100 and 8000, or between 100 and 9000 nucleotides. In an aspect, a Nic1b_ERF locus comprises a sequence or a chromosomal segment of between 50 and 100, between 100 and 200, between 200 and 300, between 300 and 400, between 400 and 500, between 500 and 600, between 600 and 700, between 700 and 800, between 800 and 900, between 900 and 1000, between 1000 and 1500, between 1500 and 2000, between 2000 and 3000, between 3000 and 4000, between 4000 and 5000, between 5000 and 6000, between 6000 and 7000, between 7000 and 8000, or between 8000 and 9000 nucleotides.

In an aspect, a Nic1b_ERF locus comprises a sequence or a chromosomal segment within 50, 100, 200, 300, 400, 500, 600, 700, 800, 900, 1000, 1500, 2000, 3000, 4000, 5000, 6000, 7000, 8000, 9000, 10000, 15000, 20000, 30000, 40000, 50000, 60000, or 70000 nucleotides of a SNP marker selected from the group consisting of SEQ ID Nos. 125 to 145 and 193 to 201. In another aspect, a Nic1b_ERF locus comprises a sequence or a chromosomal segment within between 100 and 300, between 100 and 400, between 100 and 500, between 100 and 600, between 100 and 700, between 100 and 800, between 100 and 900, between 100 and 1000, between 100 and 1500, between 100 and 2000, between 100 and 3000, between 100 and 4000, between 100 and 5000, between 100 and 6000, between 100 and 7000, between 100 and 8000, or between 100 and 9000 nucleotides of a SNP marker selected from the group consisting of SEQ ID Nos. 125 to 145 and 193 to 201. In a further aspect, a Nic1b_ERF locus comprises a sequence or a chromosomal segment within between 50 and 100, between 100 and 200, between 200 and 300, between 300 and 400, between 400 and 500, between 500 and 600, between 600 and 700, between 700 and 800, between 800 and 900, between 900 and 1000, between 1000 and 1500, between 1500 and 2000, between 2000 and 3000, between 3000 and 4000, between 4000 and 5000, between 5000 and 6000, between 6000 and 7000, between 7000 and 8000, or between 8000 and 9000 nucleotides of a SNP marker selected from the group consisting of SEQ ID Nos. 125 to 145 and 193 to 201.

In an aspect, a Nic1b_ERF locus comprises a sequence selected from the group consisting of SEQ ID Nos. 3, 13, 14, 17, 18, 19, 38, 48, 49, 52, 53, 54, 153, 154, 158, 159, and 202 to 205, and fragments thereof. In another aspect, a Nic1b_ERF locus comprises a sequence or a chromosomal segment within 50, 100, 200, 300, 400, 500, 600, 700, 800, 900, 1000, 1500, 2000, 3000, 4000, 5000, 6000, 7000, 8000, 9000, 10000, 15000, 20000, 30000, 40000, 50000, 60000, or 70000 nucleotides of a sequence selected from the group consisting of SEQ ID Nos. 3, 13, 14, 17, 18, 19, 38, 48, 49, 52, 53, 54, 153, 154, 158, 159, and 202 to 205. In a further aspect, a Nic1b_ERF locus comprises a sequence or a chromosomal segment within between 100 and 300, between 100 and 400, between 100 and 500, between 100 and 600, between 100 and 700, between 100 and 800, between 100 and 900, between 100 and 1000, between 100 and 1500, between 100 and 2000, between 100 and 3000, between 100 and 4000, between 100 and 5000, between 100 and 6000, between 100 and 7000, between 100 and 8000, or between 100 and 9000 nucleotides of a sequence selected from the group consisting of SEQ ID Nos. 3, 13, 14, 17, 18, 19, 38, 48, 49, 52, 53, 54, 153, 154, 158, 159, and 202 to 205. In an aspect, a Nic1b_ERF locus comprises a sequence or a chromosomal segment within between 50 and 100, between 100 and 200, between 200 and 300, between 300 and 400, between 400 and 500, between 500 and 600, between 600 and 700, between 700 and 800, between 800 and 900, between 900 and 1000, between 1000 and 1500, between 1500 and 2000, between 2000 and 3000, between 3000 and 4000, between 4000 and 5000, between 5000 and 6000, between 6000 and 7000, between 7000 and 8000, or between 8000 and 9000 nucleotides of a sequence selected from the group consisting of SEQ ID Nos. 3, 13, 14, 17, 18, 19, 38, 48, 49, 52, 53, 54, 153, 154, 158, 159, and 202 to 205.

In an aspect, a Nic1b_ERF locus comprises a sequence or chromosomal segment flanked by and not comprising any two of the sequences selected from the group consisting of SEQ ID Nos. 3, 13, 14, 17, 18, 19, 38, 48, 49, 52, 53, 54, 153, 154, 158, 159, and 202 to 205, and fragments thereof. In an aspect, a Nic1b_ERF locus comprises a sequence or chromosomal segment flanked by and not comprising any two of the SNP markers selected from the group consisting of SEQ ID Nos. 125 to 145 and 193 to 201. In an aspect, a Nic1b_ERF locus comprises a sequence or chromosomal segment flanked by and not comprising any two of the sequences selected from the group consisting of SEQ ID Nos. 3, 13, 14, 17, 18, 19, 38, 48, 49, 52, 53, 54, 153, 154, 158, 159, and 202 to 205.

In an aspect, the present disclosure also provides a tobacco variety, cultivar, or line comprising a mutation selected from the group consisting of a nic1b_erf mutation, a nic2 mutation, and a combination thereof, where the tobacco variety, cultivar, or line has a leaf grade comparable to the leaf grade of a control tobacco variety, cultivar, or line when grown in similar growth conditions, where the control tobacco variety shares an essentially identical genetic background with the tobacco variety, cultivar, or line except the mutation.

In an aspect, the present disclosure further provides non-transgenic tobacco plants, or part thereof, comprising a nicotine or total alkaloid level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%, where the tobacco plants are capable of producing leaves, when cured, having a USDA grade index value of 50 or more 55 or more, 60 or more, 65 or more, 70 or more, 75 or more, 80 or more, 85 or more, 90 or more, and 95 or more. In another aspect, such non-transgenic tobacco plants comprise a nicotine level of less than 2.0% and are capable of producing leaves, when cured, having a USDA grade index value of 70 or more. In a further aspect, such non-transgenic tobacco plants comprise a nicotine level of less than 1.0% and are capable of producing leaves, when cured, having a USDA grade index value of 70 or more.

In an aspect, the present disclosure also provides a tobacco plant, or part thereof, comprising a non-transgenic mutation, where the non-transgenic mutation reduces the nicotine or total alkaloid level of the tobacco plant to below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, where the tobacco plant is capable of producing leaves, when cured, having a USDA grade index value comparable to the USDA grade index value of the control plant, and where the control plant shares an essentially identical genetic background with the tobacco plant except the non-transgenic mutation.

In an aspect, the present disclosure provides tobacco plants, or part thereof, comprising a mutation in Nic1b_ERF locus, where the mutation is absent from LA Burley 21. In an aspect, tobacco plants provided herein comprise a shorter chromosomal introgression at Nic1b_ERF locus compared to LA Burley 21. In another aspect, tobacco plants provided herein comprise no deletion of a complete gene or a complete genic coding sequence in Nic1b_ERF locus. In an aspect, tobacco plants provided herein are homozygous at Nic1b_ERF locus. In another aspect, tobacco plants provided herein are heterozygous at Nic1b_ERF locus. In an aspect, tobacco plants provided herein comprise a Nic1b_ERF mutation selected from the group consisting of a point mutation, a deletion, an insertion, a duplication, and an inversion. In an aspect, Nic1b_ERF mutations in the tobacco plants provided herein are introduced by an approach selected from the group consisting of random mutagenesis and targeted mutagenesis. In another aspect, Nic1b_ERF mutations in the tobacco plants provided herein are introduced by a targeted mutagenesis approach selected from the group consisting of meganuclease, zinc finger nuclease, TALEN, and CRISPR.

In an aspect, tobacco plants provided herein comprise one or more mutations within one or more genes comprising a sequence having at least 80%, at least 85%, at least 90%, at least 95%, at least 97%, at least 98%, at least 99%, or 100% identity to a sequence selected from the group consisting of SEQ ID NOs: 3, 13, 14, 17 to 19, 153, 154, 202, 203, and 208 to 214, and fragments thereof. In an aspect, one or more mutations reduce the expression or activity of one or more genes comprising a sequence having at least 80%, at least 85%, at least 90%, at least 95%, at least 97%, at least 98%, at least 99%, or 100% identity to a sequence selected from the group consisting of SEQ ID NOs: 3, 13, 14, 17 to 19, 153, 154, 202, 203, and 208 to 214, and fragments thereof.

In an aspect, tobacco plants provided herein comprise one or more mutations within one or more genes comprising a coding sequence having at least 80%, at least 85%, at least 90%, at least 95%, at least 97%, at least 98%, at least 99%, or 100% identity to a sequence selected from the group consisting of SEQ ID NOs: 38, 48, 49, 52 to 54, 158, 159, 204, 205, and 215 to 221, and fragments thereof. In an aspect, one or more mutations reduce the expression or activity of one or more genes comprising a coding sequence having at least 80%, at least 85%, at least 90%, at least 95%, at least 97%, at least 98%, at least 99%, or 100% identity to a sequence selected from the group consisting of SEQ ID NOs: 38, 48, 49, 52 to 54, 158, 159, 204, 205, and 215 to 221, and fragments thereof.

In an aspect, tobacco plants provided herein comprise one or more mutations within one or more genes encoding a polypeptide having at least 80%, at least 85%, at least 90%, at least 95%, at least 97%, at least 98%, at least 99%, or 100% identity to a sequence selected from the group consisting of SEQ ID NOs: 73, 83, 84, 87 to 89, 180, 181, 206, and 207, and 222 to 228, and fragments thereof. In an aspect, one or more mutations reduce the expression or activity of one or more genes encoding a polypeptide having at least 80%, at least 85%, at least 90%, at least 95%, at least 97%, at least 98%, at least 99%, or 100% identity to a sequence selected from the group consisting of SEQ ID NOs: 73, 83, 84, 87 to 89, 180, 181, 206, and 207, and 222 to 228, and fragments thereof.

In an aspect, tobacco plants provided herein comprise one or more mutations within one or more genes comprising a sequence having at least 80%, at least 85%, at least 90%, at least 95%, at least 97%, at least 98%, at least 99%, or 100% identity to a sequence selected from the group consisting of SEQ ID NOs: 4, 14, 15, 17, 18, 19, 37, 39, 49, 50, 52, 53, 54, 202 to 205, and 72, and fragments thereof. In an aspect, one or more mutations reduce the expression or activity of one or more genes comprising a sequence having at least 80%, at least 85%, at least 90%, at least 95%, at least 97%, at least 98%, at least 99%, or 100% identity to a sequence selected from the group consisting of SEQ ID NOs: 4, 14, 15, 17, 18, 19, 37, 39, 49, 50, 52, 53, 54, 202 to 205, and 72, and fragments thereof.

In an aspect, tobacco plants provided herein comprise one or more mutations within one or more genes comprising a coding sequence having at least 80%, at least 85%, at least 90%, at least 95%, at least 97%, at least 98%, at least 99%, or 100% identity to a sequence selected from the group consisting of SEQ ID NOs: 49, 52, 53, 204, 205, and 54, and fragments thereof. In an aspect, one or more mutations reduce the expression or activity of one or more genes comprising a coding sequence having at least 80%, at least 85%, at least 90%, at least 95%, at least 97%, at least 98%, at least 99%, or 100% identity to a sequence selected from the group consisting of SEQ ID NOs: 49, 52, 53, 204, 205, and 54, and fragments thereof.

In an aspect, tobacco plants provided herein comprise one or more mutations within one or more genes encoding a polypeptide having at least 80%, at least 85%, at least 90%, at least 95%, at least 97%, at least 98%, at least 99%, or 100% identity to a sequence selected from the group consisting of SEQ ID NOs: 84, 87, 88, and 89, and fragments thereof. In an aspect, one or more mutations reduce the expression or activity of one or more genes encoding a polypeptide having at least 80%, at least 85%, at least 90%, at least 95%, at least 97%, at least 98%, at least 99%, or 100% identity to a sequence selected from the group consisting of SEQ ID NOs: 84, 87, 88, and 89, and fragments thereof.

LA Burley 21 (also referenced as LA BU21) is a low total alkaloid tobacco line produced by incorporation of a low alkaloid gene(s) from a Cuban cigar variety into Burley 21 through several backcrosses (Legg et al. 1970). It has approximately 0.2% total alkaloids (dry weight) compared to the about 3.5% (dry weight) of its parent, Burley 21. LA BU21 has a leaf grade well below commercially acceptable standards. LA BU21 also exhibits other unfavorable leaf phenotypes characterized by lower yields, delayed ripening and senescence, higher susceptibility to insect herbivory, and poor end-product quality after curing (Chaplin and Weeks, *Crop Sci.* 16: 416-418 (1976); Legg et al. *Crop. Sci.* 10: 212 (1970); Chaplin and Burk, *Crop Sci.* 75: 133-136 (1983)). LA BU21 leaves further exhibit traits such as higher polyamine content, higher chlorophyll content and more mesophyll cells per unit leaf area.

Unless specified otherwise, measurements of alkaloid, polyamine, or nicotine levels (or another leaf chemistry or property characterization) or leaf grade index values mentioned herein for a tobacco plant, variety, cultivar, or line refer to average measurements, including, for example, an average of multiple leaves of a single representative plant or an average measurement from a representative population of tobacco plants from a single variety, cultivar, or line. Unless specified otherwise, the nicotine, alkaloid, or polyamine level (or another leaf chemistry or property characterization) of a tobacco plant described here is measured two weeks after topping in a pooled leaf sample collected from leaf number 3, 4, and 5 after topping. In another aspect, the nicotine, alkaloid, or polyamine level (or another leaf chemistry or property characterization) of a tobacco plant is measured after topping in a leaf having the highest level of nicotine, alkaloid, or polyamine (or another leaf chemistry or property characterization). In an aspect, the nicotine, alkaloid, or polyamine level of a tobacco plant is measured after topping in leaf number 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30. In another aspect, the nicotine, alkaloid, or polyamine level (or another leaf chemistry or property characterization) of a tobacco plant is measured after topping in a pool of two or more leaves with consecutive leaf numbers selected from the group consisting of leaf number 1, 2, 3, 4, 5, 6, 7, 8, 9, 10, 11, 12, 13, 14, 15, 16, 17, 18, 19, 20, 21, 22, 23, 24, 25, 26, 27, 28, 29, and 30. In another aspect, the nicotine, alkaloid, or polyamine level (or another leaf chemistry or property characterization) of a tobacco plant is measured after topping in a leaf with a leaf number selected from the group consisting of between 1 and 5, between 6 and 10, between 11 and 15, between 16 and 20, between 21 and 25, and between 26 and 30. In another aspect, the nicotine, alkaloid, or polyamine level (or another leaf chemistry or property characterization) of a tobacco plant is measured after topping in a pool of two or more leaves with leaf numbers selected from the group consisting of between 1 and 5, between 6 and 10, between 11 and 15, between 16 and 20, between 21 and 25, and between 26 and 30. In another aspect, the nicotine, alkaloid, or polyamine level (or another leaf chemistry or property characterization) of a tobacco plant is measured after topping in a pool of three or more leaves with leaf numbers selected from the group consisting of between 1 and 5, between 6 and 10, between 11 and 15, between 16 and 20, between 21 and 25, and between 26 and 30.

As used herein, leaf numbering is based on the leaf position on a tobacco stalk with leaf number 1 being the youngest leaf (at the top) after topping and the highest leaf number assigned to the oldest leaf (at the bottom).

A population of tobacco plants or a collection of tobacco leaves for determining an average measurement (e.g., alkaloid or nicotine level or leaf grading) can be of any size, for example, 5, 10, 15, 20, 25, 30, 35, 40, or 50. Industry-accepted standard protocols are followed for determining average measurements or grad index values.

As used herein, "topping" refers to the removal of the stalk apex, including the SAM, flowers, and up to several adjacent leaves, when a tobacco plant is near vegetative maturity and around the start of reproductive growth. Typically, tobacco plants are topped in the button stage (soon after the flower begins to appear). For example, greenhouse or field-grown tobacco plants can be topped when 50% of the plants have at least one open flower. Topping a tobacco plant results in the loss of apical dominance and also induce increased alkaloid production.

Typically, the nicotine, alkaloid, or polyamine level (or another leaf chemistry or property characterization) of a tobacco plant is measured about 2 weeks after topping. Other time points can also be used. In an aspect, the nicotine, alkaloid, or polyamine level (or another leaf chemistry or property characterization) of a tobacco plant is measured about 1, 2, 3, 4, or 5 weeks after topping. In another aspect, the nicotine, alkaloid, or polyamine level (or another leaf chemistry or property characterization) of a tobacco plant is measured about 3, 5, 7, 10, 12, 14, 17, 19, or 21 days after topping.

As used herein, "similar growth conditions" or "comparable growth conditions" refer to similar environmental conditions and/or agronomic practices for growing and making meaningful comparisons between two or more plant genotypes so that neither environmental conditions nor agronomic practices would contribute to or explain any difference observed between the two or more plant genotypes. Environmental conditions include, for example, light, temperature, water (humidity), and nutrition (e.g., nitrogen and phosphorus). Agronomic practices include, for example, seeding, clipping, undercutting, transplanting, topping, and suckering. See Chapters 4B and 4C of Tobacco, Production, Chemistry and Technology, Davis & Nielsen, eds., Blackwell Publishing, Oxford (1999), pp 70-103.

"Alkaloids" are complex, nitrogen-containing compounds that naturally occur in plants, and have pharmacological effects in humans and animals. "Nicotine" is the primary natural alkaloid in commercialized cigarette tobacco and accounts for about 90 percent of the alkaloid content in *Nicotiana tabacum*. Other major alkaloids in tobacco include cotinine, nornicotine, myosmine, nicotyrine, anabasine and anatabine. Minor tobacco alkaloids include nicotine-n-oxide, N-methyl anatabine, N-methyl anabasine, pseudooxynicotine, 2,3 dipyridyl and others.

In an aspect, tobacco plants provided herein comprise a lower level of total alkaloid or an individual alkaloid compared to a control tobacco plant without a nic1b_erf mutation or a Nic1b_ERF-directed transgene when grown in similar growth conditions. In another aspect, tobacco plants provided herein comprise a lower level of one or more alkaloids selected from the group consisting of cotinine, nornicotine, myosmine, nicotyrine, anabasine and anatabine, compared to a control tobacco plant when grown in similar growth conditions. In an aspect, a lower alkaloid or nicotine level refers to an alkaloid or nicotine level of below 1%, below 2%, below 5%, below 8%, below 10%, below 12%, below 15%, below 20%, below 25%, below 30%, below 40%, below 50%, below 60%, below 70%, or below 80% of the alkaloid or nicotine level of a control tobacco plant. In another aspect, a lower alkaloid or nicotine level refers to an alkaloid or nicotine level of about between 0.5% and 1%, between 1% and 2%, between 2% and 3%, between 3% and 4%, between 4% and 5%, between 5% and 6%, between 6% and 7%, between 7% and 8%, between 8% and 9%, between 9% and 10%, between 11% and 12%, between 12% and 13%, between 13% and 14%, between 14% and 15%, between 15% and 16%, between 16% and 17%, between 17% and 18%, between 18% and 19%, between 19% and 20%, between 21% and 22%, between 22% and 23%, between 23% and 24%, between 24% and 25%, between 25% and 26%, between 26% and 27%, between 27% and 28%, between 28% and 29%, or between 29% and 30% of the alkaloid or nicotine level of a control tobacco plant. In a further aspect, a lower alkaloid or nicotine level refers to an alkaloid or nicotine level of about between 0.5% and 5%, between 5% and 10%, between 10% and 20%, between 20% and 30% of the alkaloid or nicotine level of a control tobacco plant.

Alkaloid levels can be assayed by methods known in the art, for example by quantification based on gas-liquid chromatography, high performance liquid chromatography, radio-immunoassays, and enzyme-linked immunosorbent assays. For example, nicotinic alkaloid levels can be measured by a GC-FID method based on CORESTA Recommended Method No. 7, 1987 and ISO Standards (ISO TC 126N 394 E. See also Hibi et al., *Plant Physiology* 100: 826-35 (1992) for a method using gas-liquid chromatography equipped with a capillary column and an FID detector. Unless specified otherwise, all alkaloid levels described here are measured using a method in accordance with CORESTA Method No 62, *Determination of Nicotine in Tobacco and Tobacco Products by Gas Chromatographic Analysis*, February 2005, and those defined in the Centers for Disease Control and Prevention's *Protocol for Analysis of Nicotine, Total Moisture and pH in Smokeless Tobacco Products*, as published in the Federal Register Vol. 64, No. 55 Mar. 23, 1999 (and as amended in Vol. 74, No. 4, Jan. 7, 2009).

Alternatively, tobacco total alkaloids can be measured using a segmented-flow colorimetric method developed for analysis of tobacco samples as adapted by Skalar Instrument Co (West Chester, PA) and described by Collins et al., *Tobacco Science* 13:79-81 (1969). In short, samples of tobacco are dried, ground, and extracted prior to analysis of total alkaloids and reducing sugars. The method then employs an acetic acid/methanol/water extraction and charcoal for decolorization. Determination of total alkaloids was based on the reaction of cyanogen chloride with nicotine alkaloids in the presence of an aromatic amine to form a colored complex which is measured at 460 nm. Unless specified otherwise, total alkaloid levels or nicotine levels shown herein are on a dry weight basis (e.g., percent total alkaloid or percent nicotine).

In an aspect, tobacco plants provided herein comprise a lower level of nicotine compared to a control tobacco plant without a nic1b_erf mutation or a Nic1b_ERF-directed transgene when grown in similar growth conditions. In an aspect, a lower nicotine level refers to an average nicotine level of below 1%, below 2%, below 5%, below 8%, below 10%, below 12%, below 15%, below 20%, below 25%, below 30%, below 40%, below 50%, below 60%, below 70%, or below 80% of the average nicotine level of a control tobacco plant. In another aspect, a lower nicotine level refers to an average nicotine level of about between 0.5% and 1%, between 1% and 2%, between 2% and 3%, between 3% and 4%, between 4% and 5%, between 5% and 6%, between 6% and 7%, between 7% and 8%, between 8% and 9%, between 9% and 10%, between 11% and 12%, between 12% and 13%, between 13% and 14%, between 14% and 15%, between 15% and 16%, between 16% and 17%, between 17% and 18%, between 18% and 19%, between 19% and 20%, between 21% and 22%, between 22% and 23%, between 23% and 24%, between 24% and 25%, between 25% and 26%, between 26% and 27%, between 27% and 28%, between 28% and 29%, or between 29% and 30% of the average nicotine level of a control tobacco plant. In a further aspect, a lower nicotine level refers to an average nicotine level of about between 0.5% and 5%, between 5% and 10%, between 10% and 20%, between 20% and 30% of the average nicotine level of a control tobacco plant.

In an aspect, tobacco plants provided herein comprise an average nicotine or total alkaloid level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In another aspect, tobacco plants provided herein comprise an average nicotine or total alkaloid level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In a further aspect, tobacco plants provided herein comprise an average nicotine or total alkaloid level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

The present disclosure also provides tobacco plants having altered nicotine levels without negative impacts over other tobacco traits, e.g., leaf grade index value. In an aspect, a low-nicotine or nicotine-free tobacco variety provides cured tobacco of commercially acceptable grade. Tobacco grades are evaluated based on factors including, but not limited to, the leaf stalk position, leaf size, leaf color, leaf uniformity and integrity, ripeness, texture, elasticity, sheen (related with the intensity and the depth of coloration of the leaf as well as the shine), hygroscopicity (the faculty of the tobacco leaves to absorb and to retain the ambient moisture), and green nuance or cast. Leaf grade can be determined, for example, using an Official Standard Grade published by the Agricultural Marketing Service of the US Department of Agriculture (7 U.S.C. § 511). See, e.g., Official Standard Grades for Burley Tobacco (U.S. Type 31 and Foreign Type 93), effective Nov. 5, 1990 (55 F.R. 40645); Official Standard Grades for Flue-Cured Tobacco (U.S. Types 11, 12, 13, 14 and Foreign Type 92), effective Mar. 27, 1989 (54 F.R. 7925); Official Standard Grades for Pennsylvania Seedleaf Tobacco (U.S. Type 41), effective Jan. 8, 1965 (29 F.R. 16854); Official Standard Grades for Ohio Cigar-Leaf Tobacco (U.S. Types 42, 43, and 44), effective Dec. 8, 1963 (28 F.R. 11719 and 28 F.R. 11926); Official Standard Grades for Wisconsin Cigar-Binder Tobacco (U.S. Types 54 and 55), effective Nov. 20, 1969 (34 F.R. 17061); Official Standard Grades for Wisconsin Cigar-Binder Tobacco (U.S. Types 54 and 55), effective Nov. 20, 1969 (34 F.R. 17061); Official Standard Grades for Georgia and Florida Shade-Grown Cigar-Wrapper Tobacco (U.S. Type 62), Effective April 1971. A USDA grade index value can be determined according to an industry accepted grade index. See, e.g., Bowman et al, *Tobacco Science*, 32:39-40 (1988); Legacy Tobacco Document Library (Bates Document #523267826-523267833, Jul. 1, 1988, Memorandum on the Proposed Burley Tobacco Grade Index); and Miller et al., 1990, *Tobacco Intern.*, 192:55-57 (all foregoing references are incorporated by inference in their entirety). Unless specified otherwise, a USDA grade index for any plant described here is a 0-100 numerical representation of federal grade received and is a weighted average of all stalk positions. A higher grade index indicates higher quality. Alternatively, leaf grade can be determined via hyper-spectral imaging. See e.g., WO 2011/027315 (published on Mar. 10, 2011, and incorporated by inference in its entirety).

In an aspect, tobacco plants provided herein comprise a similar level of one or more tobacco aroma compounds selected from the group consisting of 3-methylvaleric acid, valeric acid, isovaleric acid, a labdenoid, a cembrenoid, a sugar ester, and a reducing sugar, compared to control tobacco plants when grown in similar growth conditions. In another aspect, tobacco plants provided herein comprise a nic1b_erf mutation, a nic2 mutation, or a combination thereof having no impact over the level of one or more tobacco aroma compounds selected from the group consisting of 3-methylvaleric acid, valeric acid, isovaleric acid, a labdenoid, a cembrenoid, a sugar ester, and a reducing sugar.

As used herein, tobacco aroma compounds are compounds associated with the flavor and aroma of tobacco smoke. These compounds include, but are not limited to, 3-methylvaleric acid, valeric acid, isovaleric acid, cembrenoid and labdenoid diterpenes, and sugar esters. Concentrations of tobacco aroma compounds can be measured by any known metabolite profiling methods in the art including, without limitation, gas chromatography mass spectrometry (GC-MS), Nuclear Magnetic Resonance Spectroscopy, liquid chromatography-linked mass spectrometry. See The Handbook of Plant Metabolomics, edited by Weckwerth and Kahl, (Wiley-Blackwell) (May 28, 2013).

As used herein, "reducing sugar(s)" are any sugar (monosaccharide or polysaccharide) that has a free or potentially free aldehdye or ketone group. Glucose and fructose act as nicotine buffers in cigarette smoke by reducing smoke pH and effectively reducing the amount of "free" unprotonated nicotine. Reducing sugars balances smoke flavor, for example, by modifying the sensory impact of nicotine and other tobacco alkaloids. An inverse relationship between sugar content and alkaloid content has been reported across tobacco varieties, within the same variety, and within the same plant line caused by planting conditions. Reducing sugar levels can be measured using a segmented-flow colorimetric method developed for analysis of tobacco samples as adapted by Skalar Instrument Co (West Chester, PA) and described by Davis, *Tobacco Science* 20:139-144 (1976). For example, a sample is dialyzed against a sodium carbonate solution. Copper neocuproin is added to the sample and the solution is heated. The copper neocuproin chelate is reduced in the presence of sugars resulting in a colored complex which is measured at 460 nm.

In an aspect, tobacco plants provided herein comprise one or more non-naturally existing mutant alleles at Nic1b_ERF or Nic2 locus which reduce or eliminate one or more gene activity from Nic1b_ERF or Nic2 locus. In an aspect, these mutant alleles result in lower nicotine levels. Mutant Nic1b_ERF or Nic2 alleles can be introduced by any method known in the art including random or targeted mutagenesis approaches.

Such mutagenesis methods include, without limitation, treatment of seeds with ethyl methylsulfate (EMS) (Hildering and Verkerk, In, The use of induced mutations in plant breeding. Pergamon press, pp 317-320, 1965) or UV-irradiation, X-rays, and fast neutron irradiation (see, for example, Verkerk, *Neth. J. Agric. Sci.* 19:197-203, 1971; and Poehlman, Breeding Field Crops, Van Nostrand Reinhold, New York (3.sup.rd ed), 1987), transposon tagging (Fedoroff et al., 1984; U.S. Pat. Nos. 4,732,856 and 5,013,658), as well as T-DNA insertion methodologies (Hoekema et al., 1983; U.S. Pat. No. 5,149,645). EMS-induced mutagenesis consists of chemically inducing random point mutations over the length of the genome. Fast neutron mutagenesis consists of exposing seeds to neutron bombardment which causes large deletions through double stranded DNA breakage. Transposon tagging comprises inserting a transposon within an endogenous gene to reduce or eliminate expression of the gene. The types of mutations that may be present in a tobacco gene include, for example, point mutations, deletions, insertions, duplications, and inversions. Such mutations desirably are present in the coding region of a tobacco gene; however mutations in the promoter region, and intron, or an untranslated region of a tobacco gene may also be desirable.

In addition, a fast and automatable method for screening for chemically induced mutations, TILLING (Targeting Induced Local Lesions In Genomes), using denaturing HPLC or selective endonuclease digestion of selected PCR products is also applicable to the present disclosure. See, McCallum et al. (2000) *Nat. Biotechnol.* 18:455-457. Mutations that impact gene expression or that interfere with the function of genes can be determined using methods that are well known in the art. Insertional mutations in gene exons usually result in null-mutants. Mutations in conserved residues can be particularly effective in inhibiting the function of a protein. In an aspect, tobacco plants comprise a nonsense (e.g., stop codon) mutation is one or more NCG genes described herein.

Is an aspect, the present disclosure also provides tobacco lines with altered nicotine levels while maintaining commercially acceptable leaf quality. These lines can be produced by introducing mutations into one or more genes at Nic1b_ERF or Nic2 locus via precise genome engineering technologies, for example, Transcription activator-like effector nucleases (TALENs), meganuclease, zinc finger nuclease, and a clustered regularly-interspaced short palindromic repeats (CRISPR)/Cas9 system, a CRISPR/Cpf1 system, a CRISPR/Csm1 system, and a combination thereof (see, for example, U.S. Patent Application publication 2017/0233756). See, e.g., Gaj et al., *Trends in Biotechnology*, 31(7):397-405 (2013).

The screening and selection of mutagenized tobacco plants can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454), enzymatic assays for detecting enzyme or ribozyme activity of polypeptides and polynucleotides, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

In an aspect, a tobacco plant or plant genome provided herein is mutated or edited by a nuclease selected from the group consisting of a meganuclease, a zinc-finger nuclease (ZFN), a transcription activator-like effector nuclease (TALEN), a CRISPR/Cas9 nuclease, a CRISPR/Cpf1 nuclease, or a CRISPR/Csm1 nuclease.

As used herein, "editing" or "genome editing" refers to targeted mutagenesis of at least 1, at least 2, at least 3, at least 4, at least 5, at least 6, at least 7, at least 8, at least 9, or at least 10 nucleotides of an endogenous plant genome nucleic acid sequence, or removal or replacement of an endogenous plant genome nucleic acid sequence. In an aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with an endogenous nucleic acid sequence. In an aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide selected from the group consisting of SEQ ID NOs: 3, 13, 14, 17, 18, 19, 38, 48, 49, 52, 53, 54, 153, 154, 158, 159, 202 to 205, and 208 to 221, and fragments thereof. In another aspect, an edited nucleic acid sequence provided has at least 99.9%, at least 99.5%, at least 99%, at least 98%, at least 97%, at least 96%, at least 95%, at least 94%, at least 93%, at least 92%, at least 91%, at least 90%, at least 85%, at least 80%, or at least 75% sequence identity with a polynucleotide encoding a polypeptide selected from the group consisting of SEQ ID NOs: 3, 13, 14, 17, 18, 19, 38, 48, 49, 52, 53, 54, 153, 154, 158, 159, 202 to 205, and 208 to 221.

Meganucleases, ZFNs, TALENs, CRISPR/Cas9, CRISPR/Csm1 and CRISPR/Cpf1 induce a double-strand DNA break at a target site of a genomic sequence that is then repaired by the natural processes of homologous recombination (HR) or non-homologous end-joining (NHEJ). Sequence modifications then occur at the cleaved sites, which can include deletions or insertions that result in gene disruption in the case of NHEJ, or integration of donor nucleic acid sequences by HR. In an aspect, a method provided comprises editing a plant genome with a nuclease provided to mutate at least 1, at least 2, at least 3, at least 4, at least 5, at least 6, at least 7, at least 8, at least 9, at least 10, or more than 10 nucleotides in the plant genome via HR with a donor polynucleotide. In an aspect, a mutation provided is caused by genome editing using a nuclease. In another aspect, a mutation provided is caused by non-homologous end-joining or homologous recombination.

In an aspect, a mutation provided here provides a dominant mutant that activates the expression or activity of a gene of interest, e.g., a gene selected from the group consisting of a biosynthetic enzyme, a regulatory transcription factor, a transporter, a catabolic enzyme, or a combination thereof, for one or more antioxidants.

Meganucleases, which are commonly identified in microbes, are unique enzymes with high activity and long recognition sequences (>14 bp) resulting in site-specific digestion of target DNA. Engineered versions of naturally occurring meganucleases typically have extended DNA recognition sequences (for example, 14 to 40 bp). The engineering of meganucleases can be more challenging than that of ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity.

ZFNs are synthetic proteins consisting of an engineered zinc finger DNA-binding domain fused to the cleavage domain of the FokI restriction endonuclease. ZFNs can be designed to cleave almost any long stretch of double-stranded DNA for modification of the zinc finger DNA-binding domain. ZFNs form dimers from monomers composed of a non-specific DNA cleavage domain of FokI endonuclease fused to a zinc finger array engineered to bind a target DNA sequence.

The DNA-binding domain of a ZFN is typically composed of 3-4 zinc-finger arrays. The amino acids at positions −1, +2, +3, and +6 relative to the start of the zinc finger ∞-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

The FokI nuclease domain requires dimerization to cleave DNA and therefore two ZFNs with their C-terminal regions are needed to bind opposite DNA strands of the cleavage site (separated by 5-7 bp). The ZFN monomer can cute the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Without being limited by any scientific theory, because the DNA-binding specificities of zinc finger domains can in principle be re-engineered using one of various methods, customized ZFNs can theoretically be constructed to target nearly any gene sequence. Publicly available methods for engineering zinc finger domains include Context-dependent Assembly (CoDA), Oligomerized Pool Engineering (OPEN), and Modular Assembly.

TALENs are artificial restriction enzymes generated by fusing the transcription activator-like effector (TALE) DNA binding domain to a FokI nuclease domain. When each member of a TALEN pair binds to the DNA sites flanking a target site, the FokI monomers dimerize and cause a double-stranded DNA break at the target site. The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site.

Transcription activator-like effectors (TALEs) can be engineered to bind practically any DNA sequence. TALE proteins are DNA-binding domains derived from various plant bacterial pathogens of the genus *Xanthomonas*. The *Xanthomonas* pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity.

A relationship between amino acid sequence and DNA recognition of the TALE binding domain allows for designable proteins. Software programs such as DNA Works can be used to design TALE constructs. Other methods of designing TALE constructs are known to those of skill in the art. See Doyle et al., *Nucleic Acids Research* (2012) 40: W117-122.; Cermak et al., *Nucleic Acids Research* (2011). 39:e82; and tale-nt.cac.cornell.edu/about.

A CRISPR/Cas9 system, CRISPR/Csm1, or a CRISPR/Cpf1 system are alternatives to the FokI-based methods ZFN and TALEN. The CRISPR systems are based on RNA-guided engineered nucleases that use complementary base pairing to recognize DNA sequences at target sites.

CRISPR/Cas9, CRISPR/Csm1, and a CRISPR/Cpf1 systems are part of the adaptive immune system of bacteria and archaea, protecting them against invading nucleic acids such as viruses by cleaving the foreign DNA in a sequence-dependent manner. The immunity is acquired by the integration of short fragments of the invading DNA known as spacers between two adjacent repeats at the proximal end of a CRISPR locus. The CRISPR arrays, including the spacers, are transcribed during subsequent encounters with invasive DNA and are processed into small interfering CRISPR RNAs (crRNAs) approximately 40 nt in length, which combine with the trans-activating CRISPR RNA (tracrRNA) to activate and guide the Cas9 nuclease. This cleaves homologous double-stranded DNA sequences known as protospacers in the invading DNA. A prerequisite for cleavage is the presence of a conserved protospacer-adjacent motif (PAM) downstream of the target DNA, which usually has the sequence 5-NGG-3 but less frequently NAG. Specificity is provided by the so-called "seed sequence" approximately 12 bases upstream of the PAM, which must match between the RNA and target DNA. Cpf1 and Csm1 act in a similar manner to Cas9, but Cpf1 and Csm1 do not require a tracrRNA.

In still another aspect, a tobacco plant provided further comprises one or more mutations in one or more loci encoding a nicotine demethylase (e.g., CYP82E4, CYP82E5, CYP82E10) that confer reduced amounts of nornicotine (See U.S. Pat. Nos. 8,319,011; 8,124,851; 9,187,759; 9,228,194; 9,228,195; 9,247,706) compared to control plant lacking one or more mutations in one or more loci encoding a nicotine demethylase. In an aspect, a modified tobacco plant described further comprises reduced nicotine demethylase activity compared to a control plant when grown and cured under comparable conditions.

The present disclosure also provides compositions and methods for inhibiting the expression or function of one or more polypeptides from Nic1b_ERF locus in a plant, particularly plants of the *Nicotiana* genus, including tobacco plants of the various commercial varieties.

In an aspect, the present disclosure provides tobacco plants, or part thereof, comprising a heterologous expression cassette comprising a Nic1b_ERF inhibitory sequence of a gene comprising a sequence having at least 80%, at least 85%, at least 90%, at least 95%, at least 97%, at least 98%, at least 99%, or 100% identity to a sequence selected from the group consisting of SEQ ID NOs: 3, 13, 14, 17, 18, 19, 38, 48, 49, 52, 53, 54, 153, 154, 158, 159, and 202 to 205, and fragments thereof, where the inhibitory sequence is operably linked to a promoter that is functional in a plant cell, and where the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of the sequence having at least 80%, at least 85%, at least 90%, at least 95%, at least 97%, at least 98%, at least 99%, or 100% identity to a sequence selected from the group consisting of SEQ ID NOs: 3, 13, 14, 17, 18, 19, 38, 48, 49, 52, 53, 54, 153, 154, 158, 159, and 202 to 205, and fragments thereof. In another aspect, the present disclosure provides tobacco plants, or part thereof, comprising a heterologous expression cassette comprising a Nic1b_ERF inhibitory sequence of a gene comprising a sequence having at least 80%, at least 85%, at least 90%, at least 95%, at least 97%, at least 98%, at least 99%, or 100% identity to a sequence selected from the group consisting of SEQ ID NOs: 3, 13, 14, 17, 18, 19, 38, 48, 49, 52, 53, 54, 153, 154, 158, 159, and 202 to 205, and fragments thereof, where the inhibitory sequence is operably linked to a promoter that is functional in a plant cell, and where the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of the sequence having at least 80%, at least 85%, at least 90%, at least 95%, at least 97%, at least 98%, at least 99%, or 100% identity to a sequence selected from the group consisting of SEQ ID NOs: 3, 13, 14, 17, 18, 19, 38, 48, 49, 52, 53, 54, 153, 154, 158, 159, and 202 to 205, and fragments thereof. In an aspect, a Nic1b_ERF inhibitory sequence is capable of being transcribed as an inhibitory polynucleotide selected from the group consisting of a single-stranded RNA polynucleotide, a double-stranded RNA polynucleotide, and a combination thereof. In an aspect, a Nic1b_ERF inhibitory sequence comprises a sequence selected from the group consisting of SEQ ID Nos. 108 to 119.

As used herein, the terms "inhibit," "inhibition," and "inhibiting" are defined as any method known in the art or described herein that decreases the expression or function of a gene product of interest (e.g., a target gene product). "Inhibition" can be in the context of a comparison between two plants, for example, a genetically altered plant versus a wild-type plant. Alternatively, inhibition of expression or function of a target gene product can be in the context of a comparison between plant cells, organelles, organs, tissues, or plant parts within the same plant or between different plants, and includes comparisons between developmental or temporal stages within the same plant or plant part or between plants or plant parts. "Inhibition" includes any relative decrement of function or production of a gene product of interest, up to and including complete elimination of function or production of that gene product. The term "inhibition" encompasses any method or composition that down-regulates translation and/or transcription of the target gene product or functional activity of the target gene product. In an aspect, the mRNA or protein level of one or more genes from Nic1b locus in a modified plant is less than 95%, less than 90%, less than 80%, less than 70%, less than 60%, less than 50%, less than 40%, less than 30%, less than 20%, less than 10%, less than 5%, less than 4%, less than 3%, less than 2%, or less than 1% of the mRNA or protein level of the same gene in a plant that is not a mutant or that has not been genetically modified to inhibit the expression of that gene.

The term "inhibitory sequence" encompasses any polynucleotide or polypeptide sequence capable of inhibiting the expression or function of a gene involved in nicotine biosynthesis regulation from Nic1b_ERF locus in a plant, such as full-length polynucleotide or polypeptide sequences, truncated polynucleotide or polypeptide sequences, fragments of polynucleotide or polypeptide sequences, variants of polynucleotide or polypeptide sequences, sense-oriented nucleotide sequences, antisense-oriented nucleotide sequences, the complement of a sense- or antisense-oriented nucleotide sequence, inverted regions of nucleotide sequences, hairpins of nucleotide sequences, double-stranded nucleotide sequences, single-stranded nucleotide sequences, combinations thereof, and the like. The term "polynucleotide sequence" includes sequences of RNA, DNA, chemically modified nucleic acids, nucleic acid analogs, combinations thereof, and the like.

Inhibitory sequences are designated by the name of the target gene product. Thus, a "Nic1b_ERF inhibitory sequence" refers to an inhibitory sequence that is capable of inhibiting the expression of a gene involved in nicotine biosynthesis regulation from Nic1b_ERF locus in a plant, for example, at the level of transcription and/or translation, or which is capable of inhibiting the function of a gene product. When the phrase "capable of inhibiting" is used in the context of a polynucleotide inhibitory sequence, it is intended to mean that the inhibitory sequence itself exerts the inhibitory effect; or, where the inhibitory sequence encodes an inhibitory nucleotide molecule (for example, hairpin RNA, miRNA, or double-stranded RNA polynucleotides), or encodes an inhibitory polypeptide (e.g., a polypeptide that inhibits expression or function of the target gene product), following its transcription (for example, in the case of an inhibitory sequence encoding a hairpin RNA, miRNA, or double-stranded RNA polynucleotide) or its transcription and translation (in the case of an inhibitory sequence encoding an inhibitory polypeptide), the transcribed or translated product, respectively, exerts the inhibitory effect on the target gene product (e.g., inhibits expression or function of the target gene product).

A Nic1b_ERF inhibitory sequence disclosed can be a sequence triggering gene silencing via any silencing pathway or mechanism known in the art, including, but not limited to, sense suppression/cosuppression, antisense suppression, double-stranded RNA (dsRNA) interference, hairpin RNA interference and intron-containing hairpin RNA interference, amplicon-mediated interference, ribozymes, small interfering RNA, artificial or synthetic microRNA, and artificial trans-acting siRNA. A Nic1b_ERF inhibitory sequence may range from at least about 20 nucleotides, about 50 nucleotides, about 70 nucleotides, about 100 nucleotides, about 150 nucleotides, about 200 nucleotides, about 250 nucleotides, about 300 nucleotides, about 350 nucleotides, about 400 nucleotides, and up to the full-length polynucleotide encoding the proteins of the present disclosure, depending upon the desired outcome. In an aspect, a Nic1b_ERF inhibitory sequence can be a fragment of between about 50 and about 400 nucleotides, between about 70 and about 350 nucleotides, between about 90 and about 325 nucleotides, between about 90 and about 300 nucleotides, between about 90 and about 275 nucleotides, between about 100 and about 400 nucleotides, between about 100 and about 350 nucleotides, between about 100 and about 325 nucleotides, between about 100 and about 300 nucleotides, between about 125 and about 300 nucleotides, or between about 125 and about 275 nucleotides in length. In some embodiments, a fragment of a cytochrome P450 polynucleotide is about 50, about 60, about 70, about 80, about 90, about 100, about 125, about 150, about 175, about 200, about 225, about 250, about 275, about 300, about 325, about 350, about 400 nucleotides in length, and other such values between about 70 and about 400 nucleotides. In an aspect, a Nic1b_ERF inhibitory sequence may comprise about 20, 21, 22, 23, 24, 25, 26, 27, 28, 29, or 30 nucleotides.

The use of the term "polynucleotide" is not intended to limit the present disclosure to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the present disclosure also encompass all forms of sequences including, but not limited to, single-stranded forms, double-stranded forms, hairpins, stem-and-loop structures, and the like.

In an aspect, the present disclosure provides recombinant DNA constructs comprising a promoter that is functional in a tobacco cell and operably linked to a polynucleotide that encodes an RNA molecule capable of binding to an RNA encoding a polypeptide having an amino acid sequence at least 80%, at least 85%, at least 90%, at least 95%, at least 97%, at least 98%, at least 99% identical to an amino acid sequence selected from the group consisting of SEQ ID NOs: 73, 83, 84, 87 to 89, 180, 181, 206, and 207, and 222 to 228, and fragments thereof, and where the RNA molecule suppresses the expression of the polypeptide. In an aspect, the RNA molecule is selected from the group consisting of a microRNA, an siRNA, and a trans-acting siRNA. In another aspect, the recombinant DNA construct encodes a double stranded RNA. Also provided are transgenic tobacco plants or part thereof, cured tobacco material, or tobacco products comprising these recombinant DNA constructs. In an aspect, these transgenic plants, cured tobacco material, or tobacco products comprise a lower level of nicotine compared to a control tobacco plant without the recombinant DNA construct. Further provided are methods of reducing the nicotine level of a tobacco plant, the method comprising transforming a tobacco plant with any of these recombinant DNA constructs.

As used herein, "operably linked" refers to a functional linkage between two or more elements. For example, an operable linkage between a polynucleotide of interest and a regulatory sequence (e.g., a promoter) is a functional link that allows for expression of the polynucleotide of interest. Operably linked elements may be contiguous or non-contiguous.

As used herein and when used in reference to a sequence, "heterologous" refers to a sequence that originates from a foreign species, or, if from the same species, is substantially modified from its native form in composition and/or genomic locus by deliberate human intervention. The term also is applicable to nucleic acid constructs, also referred to herein as "polynucleotide constructs" or "nucleotide constructs." In this manner, a "heterologous" nucleic acid construct is intended to mean a construct that originates from a foreign species, or, if from the same species, is substantially modified from its native form in composition and/or genomic locus by deliberate human intervention. Heterologous nucleic acid constructs include, but are not limited to, recombinant nucleotide constructs that have been introduced into a plant or plant part thereof, for example, via transformation methods or subsequent breeding of a transgenic plant with another plant of interest. In an aspect, a promoter used is heterologous to the sequence driven by the promoter. In another aspect, a promoter used is heterologous to tobacco. In a further aspect, a promoter used is native to tobacco.

In an aspect, a modified tobacco plant described is a cisgenic plant. As used herein, "cisgenesis" or "cisgenic" refers to genetic modification of a plant, plant cell, or plant genome in which all components (e.g., promoter, donor nucleic acid, selection gene) have only plant origins (i.e., no non-plant origin components are used). In an aspect, a modified plant, plant cell, or plant genome provided is cisgenic. Cisgenic plants, plant cells, and plant genomes provided can lead to ready-to-use tobacco lines. In another aspect, a modified tobacco plant provided comprises no non-tobacco genetic material or sequences.

As used herein, "gene expression" refers to the biosynthesis or production of a gene product, including the transcription and/or translation of the gene product.

Also provided herein are compositions and methods for overexpressing one or more polypeptides from Nic1b_ERF locus in a plant, particularly plants of the *Nicotiana* genus, including tobacco plants of the various commercial varieties.

In an aspect, the present disclosure provides recombinant DNA constructs comprising a promoter that is functional in a tobacco cell and operably linked to a polynucleotide that encodes a polypeptide having an amino acid sequence at least 80%, at least 85%, at least 90%, at least 95%, at least 97%, at least 98%, at least 99%, or 100% identical to an amino acid sequence selected from the group consisting of SEQ ID NOs: 73, 83, 84, 87 to 89, 180, 181, 206, and 207, and 222 to 228, and fragments thereof. Also provided are transgenic tobacco plants or part thereof, cured tobacco material, or tobacco products comprising these recombinant DNA constructs. In an aspect, these transgenic plants, cured tobacco material, or tobacco products comprise an increased level of nicotine compared to a control tobacco plant without the recombinant DNA construct. Further provided are methods of increasing the nicotine level of a tobacco plant, the method comprising transforming a tobacco plant with any of these recombinant DNA constructs.

In an aspect, for each transgenic or mutant line that carries a Nic1b_ERF-related transgene or mutation, also provided is a combination of such transgenic or mutant line with a mutation or transgene event directed to one or more ERF genes of Nic2 locus. Such one or more Nic2 ERF genes include, but are not limited to ERF189, ERF115, ERF221, ERF104, ERF179, ERF17, and ERF168 (Shoji et al., *Plant Cell*, (10):3390-409 (2010)). Of particular interest and provided here is a plant having a combination of transgenic or mutagenic suppression of one or more, two or more, three or more, four or more, five or more, six or more, or seven or more Nic1b ERF-like genes (e.g., NCG1, NCG11, NCG12, NCG15, NCG16, NCG17, ERF101, ERF110, ERF16, ERF130) and one or more, two or more, three or more, four or more, or five or more Nic2 ERF genes (ERF189, ERF115, ERF221, ERF104, ERF179, ERF17, and ERF168). Of further particular interest and provided here is a plant having a combination of transgenic or mutagenic suppression of one or more, two or more, three or more, or all four Nic1b ERF-like genes (e.g., NCG12, NCG15, NCG16, NCG17, ERF101, ERF110, ERF16, ERF130) and transgenic or mutagenic suppression of ERF189, ERF115, or both. Further provided here is a plant having a combination of transgenic or mutagenic suppression of one or more, two or more, three or more, or all four Nic1b ERF-like genes (e.g., NCG12, NCG15, NCG16, NCG17, ERF101, ERF110, ERF16, ERF130) with transgenic or mutagenic suppression of ERF189. In another aspect, provided here is a plant having a combination of transgenic or mutagenic suppression of one or more, two or more, three or more, or all four Nic1b ERF-like genes (e.g., NCG12, NCG15, NCG16, NCG17, ERF101, ERF110, ERF16, ERF130) with transgenic or mutagenic suppression of ERF115. Of particular interest and provided here is a plant having a combination of transgenic or mutagenic suppression of one or more, two or more, three or more, or four or more Nic1b ERF-like genes (NCG1, NCG12, NCG15, NCG16, NCG17) and one or more, two or more, three or more, four or more, or five or more Nic2 ERF genes (ERF189, ERF115, ERF221, ERF104, ERF179, ERF17, and ERF168). Of further particular interest and provided here is a plant having a combination of transgenic or mutagenic suppression of one or more, two or more, three or more, or all four Nic1b ERF-like genes (NCG12, NCG15, NCG16, NCG17) and transgenic or mutagenic suppression of ERF189, ERF115, or both. Further provided here is a plant having a combination of transgenic or mutagenic suppression of one or more, two or more, three or more, or all four Nic1b ERF-like genes (NCG12, NCG15, NCG16, NCG17) with transgenic or mutagenic suppression of ERF189. In another aspect, provided here is a plant having a combination of transgenic or mutagenic suppression of one or more, two or more, three or more, or all four Nic1b ERF-like genes (NCG12, NCG15, NCG16, NCG17) with transgenic or mutagenic suppression of ERF115.

In a further aspect, a tobacco plant is provided having transgenic or mutagenic suppression of NCG12 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of NCG15 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of NCG16 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of NCG17 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of ERF101 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of ERF110 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of ERF16 and transgenic or mutagenic suppression of one or more, two or more, three or more, four or more, or five or more Nic2 ERF genes (ERF189, ERF115, ERF221, ERF104, ERF179, ERF17, and ERF168). In another aspect, a tobacco plant is provided having transgenic or mutagenic suppression of ERF130 and transgenic or mutagenic suppression of one or more, two or more, three or more, four or more, or five or more Nic2 ERF genes (ERF189, ERF115, ERF221, ERF104, ERF179, ERF17, and ERF168).

In an aspect, a tobacco plant is provided having transgenic or mutagenic suppression of one or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of one or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of two or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of two or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of three or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of three or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of four or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of four or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of five or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of five or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of six or more Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of six or more Nic1b_ERF genes and transgenic or mutagenic suppression of one or more, two or more, three or more, four or more, or five or more Nic2_ERF genes.

In an aspect, a tobacco plant is provided having transgenic or mutagenic suppression of fewer than two Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of fewer than two Nic1b_ERF genes and transgenic or mutagenic suppression of fewer than two, fewer than three, fewer than four, fewer than five, fewer than six, or fewer than seven Nic2_ERF genes.

In an aspect, a tobacco plant is provided having transgenic or mutagenic suppression of fewer than three Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of fewer than three Nic1b_ERF genes and transgenic or mutagenic suppression of fewer than two, fewer than three, fewer than four, fewer than five, fewer than six, or fewer than seven Nic2_ERF genes.

In an aspect, a tobacco plant is provided having transgenic or mutagenic suppression of fewer than four Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of fewer than four Nic1b_ERF genes and transgenic or mutagenic suppression of fewer than two, fewer than three, fewer than four, fewer than five, fewer than six, or fewer than seven Nic2_ERF genes.

In an aspect, a tobacco plant is provided having transgenic or mutagenic suppression of fewer than five Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of fewer than five Nic1b_ERF genes and transgenic or mutagenic suppression of fewer than two, fewer than three, fewer than four, fewer than five, fewer than six, or fewer than seven Nic2_ERF genes.

In an aspect, a tobacco plant is provided having transgenic or mutagenic suppression of fewer than six Nic1b_ERF genes. In an aspect, such a plant comprises a lower nicotine or total alkaloid level compared to a control plant lacking the transgenic or mutagenic suppression under comparable conditions. In an aspect, a tobacco plant is provided having transgenic or mutagenic suppression of fewer than six Nic1b_ERF genes and transgenic or mutagenic suppression of fewer than two, fewer than three, fewer than four, fewer than five, fewer than six, or fewer than seven Nic2_ERF genes.

In an aspect, a tobacco plant is provided having transgenic or mutagenic overexpression of one or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of one or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of two or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of two or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of three or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of three or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of four or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of four or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of five or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of five or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of six or more Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of six or more Nic1b_ERF genes and transgenic or mutagenic overexpression of one or more, two or more, three or more, four or more, or five or more Nic2_ERF genes.

In an aspect, a tobacco plant is provided having transgenic or mutagenic overexpression of fewer than two Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of fewer than two Nic1b_ERF genes and transgenic or mutagenic overexpression of fewer than two, fewer than three, fewer than four, fewer than five, fewer than six, or fewer than seven Nic2_ERF genes.

In an aspect, a tobacco plant is provided having transgenic or mutagenic overexpression of fewer than three Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of fewer than three Nic1b_ERF genes and transgenic or mutagenic overexpression of fewer than two, fewer than three, fewer than four, fewer than five, fewer than six, or fewer than seven Nic2_ERF genes.

In an aspect, a tobacco plant is provided having transgenic or mutagenic overexpression of fewer than four Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of fewer than four Nic1b_ERF genes and transgenic or mutagenic overexpression of fewer than two, fewer than three, fewer than four, fewer than five, fewer than six, or fewer than seven Nic2_ERF genes.

In an aspect, a tobacco plant is provided having transgenic or mutagenic overexpression of fewer than five Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of fewer than five Nic1b_ERF genes and transgenic or mutagenic overexpression of fewer than two, fewer than three, fewer than four, fewer than five, fewer than six, or fewer than seven Nic2_ERF genes.

In an aspect, a tobacco plant is provided having transgenic or mutagenic overexpression of fewer than six Nic1b_ERF genes. In an aspect, such a plant comprises a higher nicotine or total alkaloid level compared to a control plant lacking the transgenic or mutagenic overexpression under comparable conditions. In an aspect, a tobacco plant is provided having transgenic or mutagenic overexpression of fewer than six Nic1b_ERF genes and transgenic or mutagenic overexpression of fewer than two, fewer than three, fewer than four, fewer than five, fewer than six, or fewer than seven Nic2_ERF genes.

In an aspect, a tobacco plant is provided having transgenic or mutagenic suppression of one or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of two or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of three or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of four or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of five or more Nic2_ERF genes and transgenic or mutagenic suppression of one or more, two or more, three or more, four or more, or five or more Nic1b_ERF genes. In an aspect, any of the foregoing plants comprises a lower nicotine or total alkaloid level compared to a control plant having no such Nic2_ERF or Nic1b_ERF transgenic or mutagenic suppression under comparable conditions.

In an aspect, a tobacco plant is provided having transgenic or mutagenic suppression of fewer than two Nic2_ERF genes and transgenic or mutagenic suppression of fewer than two, fewer than three, fewer than four, fewer than five, or fewer than six Nic1b_ERF genes. In an aspect, a tobacco plant is provided having transgenic or mutagenic suppression of two or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of three or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of four or more Nic2_ERF genes and transgenic or mutagenic suppression of one or more, two or more, three or more, four or more, or five or more Nic1b_ERF genes. In an aspect, a tobacco plant is provided having transgenic or mutagenic suppression of five or more Nic2_ERF genes and transgenic or mutagenic suppression of one or more, two or more, three or more, four or more, or five or more Nic1b_ERF genes. In an aspect, any of the foregoing plants comprises a lower nicotine or total alkaloid level compared to a control plant having no Nic2_ERF or Nic1b_ERF transgenic or mutagenic suppression under comparable conditions.

In an aspect, a tobacco plant is provided having transgenic or mutagenic overexpression of one or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of two or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of three or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of four or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of five or more Nic2_ERF genes and transgenic or mutagenic overexpression of one or more, two or more, three or more, four or more, or five or more Nic1b_ERF genes. In an aspect, such a plant comprises a higher nicotine or total alkaloid level compared to a control plant having no such Nic2_ERF or Nic1b_ERF transgenic or mutagenic overexpression under comparable conditions.

In an aspect, a tobacco plant is provided having transgenic or mutagenic overexpression of fewer than two Nic2_ERF genes and transgenic or mutagenic overexpression of fewer than two, fewer than three, fewer than four, fewer than five, or fewer than six Nic1b_ERF genes. In an aspect, a tobacco plant is provided having transgenic or mutagenic overexpression of two or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of three or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of four or more Nic2_ERF genes and transgenic or mutagenic overexpression of one or more, two or more, three or more, four or more, or five or more Nic1b_ERF genes. In an aspect, a tobacco plant is provided having transgenic or mutagenic overexpression of five or more Nic2_ERF genes and transgenic or mutagenic overexpression of one or more, two or more, three or more, four or more, or five or more Nic1b_ERF genes. In an aspect, such a plant comprises a higher nicotine or total alkaloid level compared to a control plant having no Nic2_ERF or Nic1b_ERF transgenic or mutagenic overexpression under comparable conditions.

In an aspect, a tobacco plant is provided having transgenic or mutagenic suppression of one or two Nic2_ERF genes comprising a sequence at least 90%, 95%, 97%, 98%, 99% or 100% identical to a nucleotide sequence selected from the group consisting of 208, 212, 215, and 219, and further having transgenic or mutagenic suppression of one or more, two or more, three or more, four or more, or five or more Nic1b_ERF genes comprising a sequence at least 90%, 95%, 97%, 98%, 99% or 100% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 90%, 95%, 97%, 98%, 99% or 100% identical to an amino acid sequence selected from the group consisting of 222 and 226, and further having transgenic or mutagenic suppression of one or more, two or more, three or more, four or more, or five or more Nic1b_ERF genes encoding a polypeptide comprising a sequence at least 90%, 95%, 97%, 98%, 99% or 100% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 90%, 95%, 97%, 98%, 99% or 100% identical to a nucleotide sequence selected from the group consisting of 208, 212, 215, and 219, and further having transgenic or mutagenic suppression of one or more, two or more, three or more, four or more, or five or more Nic1b_ERF genes comprising a sequence at least 90%, 95%, 97%, 98%, 99% or 100% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 90%, 95%, 97%, 98%, 99% or 100% identical to an amino acid sequence selected from the group consisting of 222 and 226, and further having transgenic or mutagenic suppression of one or more, two or more, three or more, four or more, or five or more Nic1b_ERF genes encoding a polypeptide comprising a sequence at least 90%, 95%, 97%, 98%, 99% or 100% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of one or more Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of one or more Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of one or more Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of one or more Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of two or more Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of two or more Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of two or more Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of two or more Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of three or more Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of three or more Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of three or more Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of three or more Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than two Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than two Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than two Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than two Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than three Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than three Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than three Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than three Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than four Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than four Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than four Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than four Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than five Nic1b_ERF genes comprising a sequence at least 95% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than five Nic1b_ERF genes encoding a polypeptide comprising a sequence at least 95% identical to an amino acid sequence selected from the group consisting of SEQ ID Nos 73, 83, 84, 87 to 89, 180, 181, 206, and 207. In an aspect, a plant described in this paragraph comprises a lower nicotine or total alkaloid level compared to a control plant lacking such transgenic or mutagenic suppression under comparable conditions.

In an aspect, a tobacco plant is provided having transgenic or mutagenic suppression of one or two Nic2_ERF genes comprising a sequence at least 95% identical to a nucleotide sequence selected from the group consisting of 208, 212, 215, and 219, and further having transgenic or mutagenic suppression of fewer than five Nic1b_ERF genes comprising a sequence at least 95% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic suppression of one or two Nic2_ERF genes encoding a polypeptide comprising a sequence at least 95% identical to an amino acid sequence selected from the group consisting of 222 and 226, and further having transgenic or mutagenic suppression of fewer than five Nic1b_ERF genes encoding a polypeptide comprising a sequence at least 95% identical to an amino acid sequence selected from the group consisting of SEQ ID Nos 73, 83, 84, and 87 to 89. In an aspect, a plant described in this paragraph comprises a lower nicotine or total alkaloid level compared to a control plant lacking such transgenic or mutagenic suppression under comparable conditions.

In an aspect, mutagenic suppression of a Nic2_ERF gene does not contain a deletion of the entire Nic2_ERF gene or the entire Nic2_ERF coding region. In an aspect, mutagenic suppression of a Nic2_ERF gene contains a deletion of the entire Nic2_ERF gene or the entire Nic2_ERF coding region. In an aspect, mutagenic suppression of a Nic1b_ERF gene does not contain a deletion of the entire Nic1b_ERF gene or the entire Nic1b_ERF coding region. In an aspect, mutagenic suppression of a Nic1b_ERF gene contains a deletion of the entire Nic1b_ERF gene or the entire Nic1b_ERF coding region.

In an aspect, a tobacco plant is provided having transgenic or mutagenic overexpression of one or two Nic2_ERF genes comprising a sequence at least 90%, 95%, 97%, 98%, 99% or 100% identical to a nucleotide sequence selected from the group consisting of 208, 212, 215, and 219, and further having transgenic or mutagenic overexpression of one or more, two or more, three or more, four or more, or five or more Nic1b_ERF genes comprising a sequence at least 90%, 95%, 97%, 98%, 99% or 100% identical to a nucleotide sequence selected from the group consisting of SEQ ID Nos 3, 13, 14, 17, 18, 19, 38, 48, 49, 52, 53, 54, 153, 154, 158, 159, and 202 to 205. In an aspect, a tobacco plant is provided having transgenic or mutagenic overexpression of one or two Nic2_ERF genes encoding a polypeptide comprising a sequence at least 90%, 95%, 97%, 98%, 99% or 100% identical to an amino acid sequence selected from the group consisting of 222 and 226, and further having transgenic or mutagenic overexpression of one or more, two or more, three or more, four or more, or five or more Nic1b_ERF genes encoding a polypeptide comprising a sequence at least 90%, 95%, 97%, 98%, 99% or 100% identical to an amino acid sequence selected from the group consisting of SEQ ID Nos 73, 83, 84, 87 to 89, 180, 181, 206, and 207. In an aspect, a plant described in this paragraph comprises a higher nicotine or total alkaloid level compared to a control plant lacking such transgenic or mutagenic overexpression under comparable conditions.

In an aspect, a tobacco plant is provided having transgenic or mutagenic overexpression of one or two Nic2_ERF genes comprising a sequence at least 90%, 95%, 97%, 98%, 99% or 100% identical to a nucleotide sequence selected from the group consisting of 208, 212, 215, and 219, and further having transgenic or mutagenic overexpression of one or more, two or more, three or more, four or more, or five or more Nic1b_ERF genes comprising a sequence at least 90%, 95%, 97%, 98%, 99% or 100% identical to a nucleotide sequence selected from the group consisting of SEQ ID Nos 3, 13, 14, 17, 18, 19, 38, 48, 49, 52, 53, and 54. In an aspect, a tobacco plant is provided having transgenic or mutagenic overexpression of one or two Nic2_ERF genes encoding a polypeptide comprising a sequence at least 90%, 95%, 97%, 98%, 99% or 100% identical to an amino acid sequence selected from the group consisting of 222 and 226, and further having transgenic or mutagenic overexpression of one or more, two or more, three or more, four or more, or five or more Nic1b_ERF genes encoding a polypeptide comprising a sequence at least 90%, 95%, 97%, 98%, 99% or 100% identical to an amino acid sequence selected from the group consisting of SEQ ID Nos 73, 83, 84, and 87 to 89. In an aspect, a plant described in this paragraph comprises a higher nicotine or total alkaloid level compared to a control plant lacking such transgenic or mutagenic overexpression under comparable conditions.

In an aspect, a lower nicotine or total alkaloid level refers to at least 20%, 30%, 40%, 50%, 60%, 70%, 80%, 90%, 95%, 97%, or 99% reduced compared to a control plant under comparable conditions.

In an aspect, a higher nicotine or total alkaloid level refers to at least 20%, 30%, 40%, 50%, 60%, 70%, 80%, 90%, 100%, 150%, 200%, 300%, 400%, 500%, 600%, 700%, or 800% increased compared to a control plant under comparable conditions.

In an aspect, recombinant DNA constructs or expression cassettes can also comprise a selectable marker gene for the selection of transgenic cells. Selectable marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers include phenotypic markers such as β-galactosidase and fluorescent proteins such as green fluorescent protein (GFP).

In an aspect, recombinant DNA constructs or expression cassettes comprise a promoter selected from the group consisting of a constitutive promoter, an inducible promoter, and a tissue-preferred promoter (for example, a leaf-specific or root-specific promoter). Exemplary constitutive promoters include the core promoter of the Rsyn7 promoter and other constitutive promoters disclosed in U.S. Pat. No. 6,072,050; the core CaMV 35S promoter (Odell et al. (1985) Nature 313:810-812); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J 3:2723-2730); ALS promoter (U.S. Pat. No. 5,659,026), and the like. Exemplary chemical-inducible promoters include the tobacco PR-1a promoter, which is activated by salicylic acid. Other chemical-inducible promoters of interest include steroid-responsive promoters (see, for example, the glucocorticoid-inducible promoter in Schena et al. (1991) Proc. Natl. Acad. Sci. USA 88:10421-10425 and McNellis et al. (1998) Plant J. 14(2):247-257) and tetracycline-inducible promoters (see, for example, Gatz et al. (1991) Mol. Gen. Genet. 227:229-237, and U.S. Pat. Nos. 5,814,618 and 5,789,156). Additional exemplary promoters that can be used are those responsible for heat-regulated gene expression, light-regulated gene expression (for example, the pea rbcS-3A; the maize rbcS promoter; the chlorophyll alb-binding protein gene found in pea; or the Arabssu promoter), hormone-regulated gene expression (for example, the abscisic acid (ABA) responsive sequences from the Em gene of wheat; the ABA-inducible HVA1 and HVA22, and rd29A promoters of barley and *Arabidopsis*; and wound-induced gene expression (for example, of wunl), organ specific gene expression (for example, of the tuber-specific storage protein gene; the 23-kDa zein gene from maize described by; or the French bean (β-phaseolin gene), or pathogen-inducible promoters (for example, the PR-1, prp-1, or (β-1,3 glucanase promoters, the fungal-inducible wirla promoter of wheat, and the nematode-inducible promoters, TobRB7-5A and Hmg-1, of tobacco arid parsley, respectively).

In an aspect, a tobacco plant provided further comprises increased or reduced expression of activity of genes involved in nicotine biosynthesis or transport. Genes involved in nicotine biosynthesis include, but are not limited to, arginine decarboxylase (ADC), methylputrescine oxidase (MPO), NADH dehydrogenase, ornithine decarboxylase (ODC), phosphoribosylanthranilate isomerase (PRAI), putrescine N-methyltransferase (PMT), quinolate phosphoribosyl transferase (QPT), and S-adenosyl-methionine synthetase (SAMS). Nicotine Synthase, which catalyzes the condensation step between a nicotinic acid derivative and methylpyrrolinium cation, has not been elucidated although two candidate genes (A622 and NBB1) have been proposed. See US 2007/0240728 A1 and US 2008/0120737A1. A622 encodes an isoflavone reductase-like protein. In addition, several transporters may be involved in the translocation of nicotine. A transporter gene, named MATE, has been cloned and characterized (Morita et al., *PNAS* 106:2447-52 (2009)).

In an aspect, a tobacco plant provided further comprises an increased or reduced level of mRNA, protein, or both of one or more genes encoding a product selected from the group consisting of PMT, MPO, QPT, ADC, ODC, PRAI, SAMS, BBL, MATE, A622, and NBB1, compared to a control tobacco plant. In another aspect, a tobacco plants provided further comprises a transgene directly suppressing the expression of one or more genes encoding a product selected from the group consisting of PMT, MPO, QPT, ADC, ODC, PRAI, SAMS, BBL, MATE, A622, and NBB1. In another aspect, a tobacco plant provided further comprises a transgene or mutation suppressing the expression or activity of one or more genes encoding a product selected from the group consisting of PMT, MPO, QPT, ADC, ODC, PRAI, SAMS, BBL, MATE, A622, and NBB1. In another aspect, a tobacco plant provided further comprises a transgene overexpressing one or more genes encoding a product selected from the group consisting of PMT, MPO, QPT, ADC, ODC, PRAI, SAMS, BBL, MATE, A622, and NBB1.

Also disclosed are the transformation of tobacco plants with recombinant constructs or expression cassettes described using any suitable transformation methods known in the art. Methods for introducing polynucleotide sequences into tobacco plants are known in the art and include, but are not limited to, stable transformation methods, transient transformation methods, and virus-mediated methods. "Stable transformation" refers to transformation where the nucleotide construct of interest introduced into a plant integrates into the genome of the plant and is capable of being inherited by the progeny thereof. "Transient transformation" is intended to mean that a sequence is introduced into the plant and is only temporally expressed or is only transiently present in the plant.

Suitable methods of introducing polynucleotides into plant cells of the present disclosure include microinjection (Crossway et al. (1986) *Biotechniques* 4:320-334), electroporation (Shillito et al. (1987) *Meth. Enzymol.* 153:313-336; Riggs et al. (1986) *Proc. Natl. Acad. Sci. USA* 83:5602-5606), *Agrobacterium*-mediated transformation (U.S. Pat. Nos. 5,104,310, 5,149,645, 5,177,010, 5,231,019, 5,463, 174, 5,464,763, 5,469,976, 4,762,785, 5,004,863, 5,159,135, 5,563,055, and 5,981,840), direct gene transfer (Paszkowski et al. (1984) *EMBO J.* 3:2717-2722), and ballistic particle acceleration (see, for example, U.S. Pat. Nos. 4,945,050, 5,141,131, 5,886,244, 5,879,918, and 5,932,782; Tomes et al. (1995) in *Plant Cell, Tissue, and Organ Culture Fundamental Methods*, ed. Gamborg and Phillips (Springer-Verlag, Berlin); McCabe et al. (1988) *Biotechnology* 6:923-926). Also see Weissinger et al. (1988) *Ann. Rev. Genet.* 22:421-477; Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P: 175-182 (soybean); Singh et al. (1998) *Theor. Appl. Genet.* 96:319-324 (soybean); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation).

In another aspect, recombinant constructs or expression cassettes may be introduced into plants by contacting plants with a virus or viral nucleic acids. Generally, such methods involve incorporating an expression cassette of the present disclosure within a viral DNA or RNA molecule. It is recognized that promoters for use in expression cassettes also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866, 785, 5,589,367, 5,316,931, and Porta et al. (1996) *Molecular Biotechnology* 5:209-221.

Any plant tissue that can be subsequently propagated using clonal methods, whether by organogenesis or embryogenesis, may be transformed with a recombinant construct or an expression cassette. By "organogenesis" in intended the process by which shoots and roots are developed sequentially from meristematic centers. By "embryogenesis" is intended the process by which shoots and roots develop together in a concerted fashion (not sequentially), whether from somatic cells or gametes. Exemplary tissues that are suitable for various transformation protocols described include, but are not limited to, callus tissue, existing meristematic tissue (e.g., apical meristems, axillary buds, and root meristems) and induced meristem tissue (e.g., cotyledon meristem and hypocotyl meristem), hypocotyls, cotyledons, leaf disks, pollen, embryos, and the like.

In an aspect, a tobacco plant provided is from a tobacco type selected from the group consisting of flue-cured tobacco, air-cured tobacco, dark air-cured tobacco, dark fire-cured tobacco, Galpao tobacco, and Oriental tobacco. In another aspect, a tobacco plant provided is from a tobacco type selected from the group consisting of Burley tobacco, Maryland tobacco, and dark tobacco.

In an aspect, a tobacco plant provided is in a flue-cured tobacco background or exhibits one or more flue-cured tobacco characteristic described here. Flue-cured tobaccos (also called Virginia or bright tobaccos) amount to approximately 40% of world tobacco production. Flue-cured tobaccos are often also referred to as "bright tobacco" because of the golden-yellow to deep-orange color it reaches during curing. Flue-cured tobaccos have a light, bright aroma and taste. Flue-cured tobaccos are generally high in sugar and low in oils. Major flue-cured tobacco growing countries are Argentina, Brazil, China, India, Tanzania and the U.S. In an aspect, a low-alkaloid or low-nicotine tobacco plant or seed provided is in a flue-cured tobacco background selected from the group consisting of CC 13, CC 27, CC 33, CC 37, CC 65, CC 67, CC 700, GF 318, GL 338, GL 368, GL 939, K 346, K 399, K326, NC 102, NC 196, NC 291, NC 297, NC 299, NC 471, NC 55, NC 606, NC 71, NC 72, NC 92, PVH 1118, PVH 1452, PVH 2110, SPEIGHT 168, SPEIGHT 220, SPEIGHT 225, SPEIGHT 227, SPEIGHT 236, and any variety essentially derived from any one of the foregoing varieties. In another aspect, a low-alkaloid or low-nicotine tobacco plant or seed provided is in a flue-cured tobacco background selected from the group consisting of Coker 48, Coker 176, Coker 371-Gold, Coker 319, Coker 347, GL 939, K 149, K326, K 340, K 346, K 358, K 394, K 399, K 730, NC 27NF, NC 37NF, NC 55, NC 60, NC 71, NC 72, NC 82, NC 95, NC 297, NC 606, NC 729, NC 2326, McNair 373, McNair 944, Ox 207, Ox 414 NF, Reams 126, Reams 713, Reams 744, RG 8, RG 11, RG 13, RG 17, RG 22, RG 81, RG H4, RG H51, Speight H-20, Speight G-28, Speight G-58, Speight G-70, Speight G-108, Speight G-l11, Speight G-l17, Speight 168, Speight 179, Speight NF-3, Va 116, Va 182, and any variety essentially derived from any one of the foregoing varieties. See WO 2004/041006 A1. In a further aspect, low-alkaloid or low-nicotine tobacco plants, seeds, hybrids, varieties, or lines are in any flue cured background selected from the group consisting of K326, K346, and NC196. In one aspect, tobacco plants or seeds or modified tobacco plants or seeds provided herein are of a flue-cured tobacco variety selected from the group consisting of the varieties listed in Table 15, and any variety essentially derived from any one of the foregoing varieties. See WO 2004/041006 A1.

In an aspect, a tobacco plant provided is in an air-cured tobacco background or exhibits one or more air-cured tobacco characteristic described here. Air-cured tobaccos include Burley, Maryland, and dark tobaccos. The common factor is that curing is primarily without artificial sources of heat and humidity. Burley tobaccos are light to dark brown in color, high in oil, and low in sugar. Burley tobaccos are air-cured in barns. Major Burley growing countries are Argentina, Brazil, Italy, Malawi, and the U.S. Maryland tobaccos are extremely fluffy, have good burning properties, low nicotine and a neutral aroma. Major Maryland growing countries include the U.S. and Italy. In an aspect, a low-alkaloid or low-nicotine tobacco plant or seed provided is in a Burley tobacco background selected from the group consisting of Clay 402, Clay 403, Clay 502, Ky 14, Ky 907, Ky 910, Ky 8959, NC 2, NC 3, NC 4, NC 5, NC 2000, TN 86, TN 90, TN 97, R 610, R 630, R 711, R 712, NCBH 129, Bu 21×Ky 10, HB04P, Ky 14×L 8, Kt 200, Newton 98, Pedigo 561, Pf561 and Va 509. In one aspect, tobacco plants or seeds or modified tobacco plants or seeds provided herein are of a Burley tobacco variety selected from the group consisting of the tobacco varieties listed in Table 16, and any variety essentially derived from any one of the foregoing varieties. In a further aspect, low-alkaloid or low-nicotine tobacco plants, seeds, hybrids, varieties, or lines are in any Burley background selected from the group consisting of TN 90, KT 209, KT 206, KT212, and HB 4488. In another aspect, a low-alkaloid or low-nicotine tobacco plant or seed provided is in a Maryland tobacco background selected from the group consisting of Md 10, Md 40, Md 201, Md 609, Md 872 and Md 341. In another aspect, tobacco plants or seeds or modified tobacco plants or seeds provided herein are of a Maryland tobacco variety selected from the group consisting of the tobacco varieties listed in Table 17, and any variety essentially derived from any one of the foregoing varieties.

In an aspect, a tobacco plant provided is in a dark air-cured tobacco background or exhibits one or more dark air-cured tobacco characteristic described here. Dark air-cured tobaccos are distinguished from other types primarily by its curing process which gives dark air-cured tobacco its medium- to dark-brown color and distinct aroma. Dark air-cured tobaccos are mainly used in the production of chewing tobacco and snuff. In an aspect, a low-alkaloid or low-nicotine tobacco plant or seed provided is in a dark air-cured tobacco background selected from the group consisting of Sumatra, Jatim, Dominican Cubano, Besuki, One sucker, Green River, Virginia sun-cured, and Paraguan Passado, and any variety essentially derived from any one of the foregoing varieties.

In an aspect, a tobacco plant provided is in a dark fire-cured tobacco background or exhibits one or more dark fire-cured tobacco characteristic described here. Dark fire-cured tobaccos are generally cured with low-burning wood fires on the floors of closed curing barns. Their leaves have low sugar content but high nicotine content. Dark fire-cured tobaccos are used for making pipe blends, cigarettes, chewing tobacco, snuff and strong-tasting cigars. Major growing regions for dark fire-cured tobaccos are Tennessee, Kentucky, and Virginia, USA. In an aspect, a low-alkaloid or low-nicotine tobacco plant or seed provided is in a dark fire-cured tobacco background selected from the group consisting of Narrow Leaf Madole, Improved Madole, Tom Rosson Madole, Newton's VH Madole, Little Crittenden, Green Wood, Little Wood, Small Stalk Black Mammoth, DT 508, DT 518, DT 592, KY 171, DF 911, DF 485, TN D94, TN D950, VA 309, and VA 359. In one aspect, tobacco plants or seeds or modified tobacco plants or seeds provided herein are of a dark fire-cured tobacco variety selected from the group consisting of the tobacco varieties listed in Table 18, and any variety essentially derived from any one of the foregoing varieties.

In an aspect, a tobacco plant provided is in an Oriental tobacco background or exhibits one or more Oriental tobacco characteristic described here. Oriental tobaccos are also referred to as Greek, aroma and Turkish tobaccos due to the fact that they are typically grown in eastern Mediterranean regions such as Turkey, Greece, Bulgaria, Macedonia, Syria, Lebanon, Italy, and Romania. The small plant and leaf size, characteristic of today's Oriental varieties, as well as its unique aroma properties are a result of the plant's adaptation to the poor soil and stressful climatic conditions in which it develop over many past centuries. In an aspect, a low-alkaloid or low-nicotine tobacco plant or seed provided is in an Oriental tobacco background selected from the group consisting of Izmir, Katerini, Samsun, Basma and Krumovgrad, Trabzon, Thesalian, Tasova, Sinop, Izmit, Hendek, Edirne, Semdinli, Adiyanman, Yayladag, Iskenderun, Duzce, Macedonian, Mavra, Prilep, Bafra, Bursa, Bucak, Bitlis, Balikesir, and any variety essentially derived from any one of the foregoing varieties. In one aspect, tobacco plants or seeds or modified tobacco plants or seeds provided herein are of an Oriental tobacco variety selected from the group consisting of the tobacco varieties listed in Table 19, and any variety essentially derived from any one of the foregoing varieties.

In an aspect, tobacco plants or seeds or modified tobacco plants or seeds provided herein are of an cigar tobacco variety selected from the group consisting of the tobacco varieties listed in Table 20, and any variety essentially derived from any one of the foregoing varieties.

In an aspect, tobacco plants or seeds or modified tobacco plants or seeds provided herein are of a tobacco variety selected from the group consisting of the tobacco varieties listed in Table 21, and any variety essentially derived from any one of the foregoing varieties.

In an aspect, a modified tobacco plant, seed, or cell described here is from a variety selected from the group consisting of the tobacco varieties listed in Table 15, Table 16, Table 17, Table 18, Table 19, Table 20, and Table 21.

In an aspect, tobacco plants, seeds, hybrids, varieties, or lines described here (which can be low-alkaloid, low-nicotine, high-alkaloid, or high-nicotine) are essentially derived from or in the genetic background of BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, Galpao tobacco, GL 26H, GL 350, GL 600, GL 737, GL 939, GL 973, HB 04P, K 149, K 326, K 346, K 358, K394, K 399, K 730, KDH 959, KT 200, KT204LC, KY 10, KY 14, KY 160, KY 17, KY 171, KY 907, KY907LC, KTY14×L8 LC, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique' tobacco, PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN 97, TN97LC, TN D94, TN D950, TR (Tom Rosson) Madole, VA 309, or VA359, Maryland 609, HB3307PLC, HB4488PLC, KT206LC, KT209LC, KT210LC, KT212LC, R610LC, PVH2310, NC196, KTD14LC, KTD6LC, KTD8LC, PD7302LC, PD7305LC, PD7309LC, PD7318LC, PD7319LC, PD7312LC, ShireyLC, or any commercial tobacco variety according to standard tobacco breeding techniques known in the art.

All foregoing mentioned specific varieties of dark air-cured, Burley, Maryland, dark fire-cured, or Oriental type are listed only for exemplary purposes. Any additional dark air-cured, Burley, Maryland, dark fire-cured, Oriental varieties are also contemplated in the present application.

Also provided are populations of tobacco plants described. In an aspect, a population of tobacco plants has a planting density of between about 5,000 and about 8000, between about 5,000 and about 7,600, between about 5,000 and about 7,200, between about 5,000 and about 6,800, between about 5,000 and about 6,400, between about 5,000 and about 6,000, between about 5,000 and about 5,600, between about 5,000 and about 5,200, between about 5,200 and about 8,000, between about 5,600 and about 8,000, between about 6,000 and about 8,000, between about 6,400 and about 8,000, between about 6,800 and about 8,000, between about 7,200 and about 8,000, or between about 7,600 and about 8,000 plants per acre. In another aspect, a population of tobacco plants is in a soil type with low to medium fertility.

Also provided are containers of seeds from tobacco plants described. A container of tobacco seeds of the present disclosure may contain any number, weight, or volume of seeds. For example, a container can contain at least, or greater than, about 100, 200, 300, 400, 500, 600, 700, 800, 900, 1000, 1500, 2000, 2500, 3000, 3500, 4000 or more seeds. Alternatively, the container can contain at least, or greater than, about 1 ounce, 5 ounces, 10 ounces, 1 pound, 2 pounds, 3 pounds, 4 pounds, 5 pounds or more seeds. Containers of tobacco seeds may be any container available in the art. By way of non-limiting example, a container may be a box, a bag, a packet, a pouch, a tape roll, a tube, or a bottle.

Also provided is cured tobacco material made from a low-alkaloid or low-nicotine tobacco plant described. Further provided is cured tobacco material made from a tobacco plant described with higher levels of total alkaloid or nicotine.

"Curing" is the aging process that reduces moisture and brings about the destruction of chlorophyll giving tobacco leaves a golden color and by which starch is converted to sugar. Cured tobacco therefore has a higher reducing sugar content and a lower starch content compared to harvested green leaf. In an aspect, green leaf tobacco provided can be cured using conventional means, e.g., flue-cured, barn-cured, fire-cured, air-cured or sun-cured. See, for example, Tso (1999, Chapter 1 in Tobacco, Production, Chemistry and Technology, Davis & Nielsen, eds., Blackwell Publishing, Oxford) for a description of different types of curing methods. Cured tobacco is usually aged in a wooden drum (e.g., a hogshead) or cardboard cartons in compressed conditions for several years (e.g., two to five years), at a moisture content ranging from 10% to about 25%. See, U.S. Pat. Nos. 4,516,590 and 5,372,149. Cured and aged tobacco then can be further processed. Further processing includes conditioning the tobacco under vacuum with or without the introduction of steam at various temperatures, pasteurization, and fermentation. Fermentation typically is characterized by high initial moisture content, heat generation, and a 10 to 20% loss of dry weight. See, e.g., U.S. Pat. Nos. 4,528,993, 4,660,577, 4,848,373, 5,372,149; U.S. Publication No. 2005/0178398; and Tso (1999, Chapter 1 in Tobacco, Production, Chemistry and Technology, Davis & Nielsen, eds., Blackwell Publishing, Oxford). Cure, aged, and fermented tobacco can be further processed (e.g., cut, shredded, expanded, or blended). See, for example, U.S. Pat. Nos. 4,528,993; 4,660,577; and 4,987,907. In an aspect, the cured tobacco material of the present disclosure is sun-cured. In another aspect, the cured tobacco material of the present disclosure is flue-cured, air-cured, or fire-cured.

Tobacco material obtained from the tobacco lines, varieties or hybrids of the present disclosure can be used to make tobacco products. As used herein, "tobacco product" is defined as any product made or derived from tobacco that is intended for human use or consumption.

Tobacco products provided include, without limitation, cigarette products (e.g., cigarettes and bidi cigarettes), cigar products (e.g., cigar wrapping tobacco and cigarillos), pipe tobacco products, products derived from tobacco, tobacco-derived nicotine products, smokeless tobacco products (e.g., moist snuff, dry snuff, and chewing tobacco), films, chewables, tabs, shaped parts, gels, consumable units, insoluble matrices, hollow shapes, reconstituted tobacco, expanded tobacco, and the like. See, e.g., U.S. Patent Publication No. US 2006/0191548.

As used herein, "cigarette" refers a tobacco product having a "rod" and "filler". The cigarette "rod" includes the cigarette paper, filter, plug wrap (used to contain filtration materials), tipping paper that holds the cigarette paper (including the filler) to the filter, and all glues that hold these components together. The "filler" includes (1) all tobaccos, including but not limited to reconstituted and expanded tobacco, (2) non-tobacco substitutes (including but not limited to herbs, non-tobacco plant materials and other spices that may accompany tobaccos rolled within the cigarette paper), (3) casings, (4) flavorings, and (5) all other additives (that are mixed into tobaccos and substitutes and rolled into the cigarette).

As used herein, "reconstituted tobacco" refers to a part of tobacco filler made from tobacco dust and other tobacco scrap material, processed into sheet form and cut into strips to resemble tobacco. In addition to the cost savings, reconstituted tobacco is very important for its contribution to cigarette taste from processing flavor development using reactions between ammonia and sugars.

As used herein, "expanded tobacco" refers to a part of tobacco filler which is processed through expansion of suitable gases so that the tobacco is "puffed" resulting in reduced density and greater filling capacity. It reduces the weight of tobacco used in cigarettes.

Tobacco products derived from plants of the present disclosure also include cigarettes and other smoking articles, particularly those smoking articles including filter elements, where the rod of smokable material includes cured tobacco within a tobacco blend. In an aspect, a tobacco product of the present disclosure is selected from the group consisting of a cigarillo, a non-ventilated recess filter cigarette, a vented recess filter cigarette, a cigar, snuff, pipe tobacco, cigar tobacco, cigarette tobacco, chewing tobacco, leaf tobacco, hookah tobacco, shredded tobacco, and cut tobacco. In another aspect, a tobacco product of the present disclosure is a smokeless tobacco product. Smokeless tobacco products are not combusted and include, but not limited to, chewing tobacco, moist smokeless tobacco, snus, and dry snuff. Chewing tobacco is coarsely divided tobacco leaf that is typically packaged in a large pouch-like package and used in a plug or twist. Moist smokeless tobacco is a moist, more finely divided tobacco that is provided in loose form or in pouch form and is typically packaged in round cans and used as a pinch or in a pouch placed between an adult tobacco consumer's cheek and gum. Snus is a heat treated smokeless tobacco. Dry snuff is finely ground tobacco that is placed in the mouth or used nasally. In a further aspect, a tobacco product of the present disclosure is selected from the group consisting of loose leaf chewing tobacco, plug chewing tobacco, moist snuff, and nasal snuff. In yet another aspect, a tobacco product of the present disclosure is selected from the group consisting of an electronically heated cigarette, an e-cigarette, an electronic vaporing device.

In an aspect, a tobacco product of the present disclosure can be a blended tobacco product. In another aspect, a tobacco product of the present disclosure can be a low nicotine tobacco product. In a further aspect, a tobacco product of the present disclosure may comprise nornicotine at a level of less than about 3 mg/g. For example, the nornicotine content in such a product can be 3.0 mg/g, 2.5 mg/g, 2.0 mg/g, 1.5 mg/g, 1.0 mg/g, 750 µg/g, 500 pg/g, 250 pg/g, 100 pg/g, 75 pg/g, 50 pg/g, 25 pg/g, 10 pg/g, 7.0 pg/g, 5.0 pg/g, 4.0 pg/g, 2.0 pg/g, 1.0 pg/g, 0.5 pg/g, 0.4 pg/g, 0.2 pg/g, 0.1 pg/g, 0.05 pg/g, 0.01 pg/g, or undetectable.

In an aspect, cured tobacco material or tobacco products provided comprise an average nicotine or total alkaloid level selected from the group consisting of about 0.01%, 0.02%, 0.05%, 0.75%, 0.1%, 0.15%, 0.2%, 0.3%, 0.35%, 0.4%, 0.5%, 0.6%, 0.7%, 0.8%, 0.9%, 1%, 1.1%, 1.2%, 1.3%, 1.4%, 1.5%, 1.6%, 1.7%, 1.8%, 1.9%, 2%, 2.1%, 2.2%, 2.3%, 2.4%, 2.5%, 2.6%, 2.7%, 2.8%, 2.9%, 3%, 3.1%, 3.2%, 3.3%, 3.4%, 3.5%, 3.6%, 3.7%, 3.8%, 3.9%, 4%, 5%, 6%, 7%, 8%, and 9% on a dry weight basis. In another aspect, cured tobacco material or tobacco products provided comprise an average nicotine or total alkaloid level selected from the group consisting of about between 0.01% and 0.02%, between 0.02% and 0.05%, between 0.05% and 0.75%, between 0.75% and 0.1%, between 0.1% and 0.15%, between 0.15% and 0.2%, between 0.2% and 0.3%, between 0.3% and 0.35%, between 0.35% and 0.4%, between 0.4% and 0.5%, between 0.5% and 0.6%, between 0.6% and 0.7%, between 0.7% and 0.8%, between 0.8% and 0.9%, between 0.9% and 1%, between 1% and 1.1%, between 1.1% and 1.2%, between 1.2% and 1.3%, between 1.3% and 1.4%, between 1.4% and 1.5%, between 1.5% and 1.6%, between 1.6% and 1.7%, between 1.7% and 1.8%, between 1.8% and 1.9%, between 1.9% and 2%, between 2% and 2.1%, between 2.1% and 2.2%, between 2.2% and 2.3%, between 2.3% and 2.4%, between 2.4% and 2.5%, between 2.5% and 2.6%, between 2.6% and 2.7%, between 2.7% and 2.8%, between 2.8% and 2.9%, between 2.9% and 3%, between 3% and 3.1%, between 3.1% and 3.2%, between 3.2% and 3.3%, between 3.3% and 3.4%, between 3.4% and 3.5%, and between 3.5% and 3.6% on a dry weight basis. In a further aspect, cured tobacco material or tobacco products provided comprise an average nicotine or total alkaloid level selected from the group consisting of about between 0.01% and 0.1%, between 0.02% and 0.2%, between 0.03% and 0.3%, between 0.04% and 0.4%, between 0.05% and 0.5%, between 0.75% and 1%, between 0.1% and 1.5%, between 0.15% and 2%, between 0.2% and 3%, and between 0.3% and 3.5% on a dry weight basis.

The present disclosure also provides methods for breeding tobacco lines, cultivars, or varieties comprising a desirable level of total alkaloid or nicotine, e.g., low nicotine or nicotine free. Breeding can be carried out via any known procedures. DNA fingerprinting, SNP mapping, haplotype mapping or similar technologies may be used in a marker-assisted selection (MAS) breeding program to transfer or breed a desirable trait or allele into a tobacco plant. For example, a breeder can create segregating populations in a $F_2$ or backcross generation using F1 hybrid plants or further crossing the F1 hybrid plants with other donor plants with an agronomically desirable genotype. Plants in the $F_2$ or backcross generations can be screened for a desired agronomic trait or a desirable chemical profile using one of the techniques known in the art or listed herein. Depending on the expected inheritance pattern or the MAS technology used, self-pollination of selected plants before each cycle of backcrossing to aid identification of the desired individual plants can be performed. Backcrossing or other breeding procedure can be repeated until the desired phenotype of the recurrent parent is recovered. A recurrent parent in the present disclosure can be a flue-cured variety, a Burley variety, a dark air-cured variety, a dark fire-cured variety, or an Oriental variety. Other breeding techniques can be found, for example, in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y., incorporated herein by reference in their entirety.

Results of a plant breeding program using the tobacco plants described includes useful lines, cultivars, varieties, progeny, inbreds, and hybrids of the present disclosure. As used herein, the term "variety" refers to a population of plants that share constant characteristics which separate them from other plants of the same species. A variety is often, although not always, sold commercially. While possessing one or more distinctive traits, a variety is further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972; on Oct. 23, 1978; and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A first tobacco variety and a second tobacco variety from which the first variety is essentially derived, are considered as having essentially identical genetic background. A "line" as distinguished from a variety most often denotes a group of plants used non-commercially, for example in plant research. A line typically displays little overall variation between individuals for one or more traits of interest, although there may be some variation between individuals for other traits.

In an aspect, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, where the polymorphic marker is in a chromosomal interval flanked by any two of SNP markers selected from the group consisting of SEQ ID Nos. 125 to 145 and 193 to 201; and (c) selecting a progeny tobacco plant comprising the low nicotine trait. In another aspect, these methods further comprise backcrossing the selected progeny tobacco plant with the second tobacco variety. In a further aspect, these methods further comprise: (d) crossing the selected progeny plant with itself or with the second tobacco variety to produce one or more further progeny tobacco plants; and (e) selecting a further progeny tobacco plant comprising the low nicotine trait. In an aspect, the step (e) of selecting comprises marker-assisted selection. In an aspect, these methods produce a single gene conversion comprising a low nicotine trait. In an aspect, these methods produce a single gene conversion comprising a Nic1b_ERF introgression. In an aspect, the second tobacco variety is an elite variety. In another aspect, the genotyping step of these methods involve one or more molecular marker assays. In another aspect, the polymorphic marker used this method comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP. In another aspect, the selected progeny tobacco plant comprises a shorter chromosomal introgression at Nic1b_ERF locus compared to LA Burley 21.

In another aspect, the present disclosure provides a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, where the polymorphic marker is within 20 cM, 10 cM, 5 cM, 4 cM, 3 cM, 2 cM, 1 cM, 0.5 cM, or less than 0.5 cM of any one of SNP markers selected from the group consisting of SEQ ID Nos. 125 to 145 and 193 to 201, or any locus having a sequence selected from the group consisting of SEQ ID Nos. 1, 3 to 37, 146, 149, 152 to 156, 202, 203, and 184 to 186; and (c) selecting a progeny tobacco plant comprising the low nicotine trait. In an aspect, this method comprises selecting simultaneously or concurrently for one or more molecular markers associated with or closely linked to Nic1b ERF locus as well as one or more molecular markers associated with or closely linked to Nic2 locus.

In an aspect, the present disclosure provides a method of selecting a tobacco plant having a low nicotine trait, the method comprising: (a) isolating nucleic acids from a collection of tobacco germplasm; (b) assaying the nucleic acids for one or more markers closely linked to Nic1b_ERF locus; and (c) selecting a tobacco plant having a low nicotine trait based on the marker assay. In an aspect, the assayed one or more markers closely linked to Nic1b_ERF locus are within about 20 cM, 10 cM, 5 cM, 4 cM, 3 cM, 2 cM, 1 cM, 0.5 cM, or less than 0.5 cM of any one of SNP markers selected from the group consisting of SEQ ID Nos. 125 to 145 and 193 to 201, or any locus having a sequence selected from the group consisting of SEQ ID Nos. 3, 13, 14, 17, 18, 19, 38, 48, 49, 52, 53, 54, 153, 154, 158, 159, and 202 to 205. In another aspect, this method further comprising assaying for one or more markers closely linked to Nic2 locus. In an aspect, the assayed one or more markers closely linked to Nic2 locus are within about 20 cM, 10 cM, 5 cM, 4 cM, 3 cM, 2 cM, 1 cM, 0.5 cM, or less than 0.5 cM of any one of polymorphic loci located in one of ERF 189, ERF 115, ERF221, ERF 104, ERF 179, ERF 17, and ERF 168. In an aspect, this method further comprises determining the nicotine level of the selected plant to confirm the low nicotine trait.

Also disclosed is a method of introgressing a low nicotine trait into a tobacco variety, the method comprising: (a) crossing a first tobacco variety comprising a low nicotine trait with a second tobacco variety without the low nicotine trait to produce one or more progeny tobacco plants; (b) genotyping the one or more progeny tobacco plants for a polymorphic marker linked to the low nicotine trait, where the polymorphic marker is in a chromosomal interval flanked by any two of SNP markers selected from the group consisting of SEQ ID Nos. 125 to 145 and 193 to 201; and (c) selecting a progeny tobacco plant comprising the low nicotine trait. In an aspect, these methods produce a single gene conversion comprising a low nicotine trait. In an aspect, these methods produce a single gene conversion comprising a Nic2 introgression. In an aspect, the second tobacco variety is an elite variety. In another aspect, the genotyping step of these methods involve one or more molecular marker assays. In another aspect, the polymorphic marker used this method comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP. In another aspect, the selected progeny tobacco plant comprises a shorter chromosome deletion at Nic2 locus compared to LA Burley 21.

As used herein, "locus" is a chromosome region where a polymorphic nucleic acid, trait determinant, gene, or marker is located. The loci of this disclosure comprise one or more polymorphisms in a population; e.g., alternative alleles are present in some individuals. As used herein, "allele" refers to an alternative nucleic acid sequence at a particular locus. The length of an allele can be as small as 1 nucleotide base, but is typically larger. For example, a first allele can occur on one chromosome, while a second allele occurs on a second homologous chromosome, e.g., as occurs for different chromosomes of a heterozygous individual, or between different homozygous or heterozygous individuals in a population. As used herein, the term "chromosome interval" designates a contiguous linear span of genomic DNA that resides on a single chromosome.

As used herein, a centimorgan ("cM") is a unit of measure of recombination frequency. One cM is equal to a 1% chance that a marker at one genetic locus will be separated from a marker at, a second locus due to crossing over in a single generation. Genetic distances referred herein can be calculated from recombination values using the Kosambi function (Kosambi, The estimation of map distances from recombination values. *Annals of Eugenics,* 12:172-75 (1944)).

As used herein, "closely linked to" or "associated with" means that the marker or locus is within about 20 cM, 10 cM, 5 cM, 1 cM, 0.5 cM, or less than 0.5 cM of another marker or locus. For example, 20 cM means that recombination between the marker and the locus with a frequency of equal to or less than about 20%.

As used herein, "introgression" or "introgress" refers to the transmission of a desired allele of a genetic locus from one genetic background to another.

As used herein, "crossed" or "cross" means to produce progeny via fertilization (e.g. cells, seeds or plants) and includes crosses between plants (sexual) and self fertilization (selfing).

As used herein, "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. The initial cross gives rise to the F1 generation. The term "BC1" refers to the second use of the recurrent parent, "BC2" refers to the third use of the recurrent parent, and so on. In an aspect, a backcross is performed repeatedly, with a progeny individual of each successive backcross generation being itself backcrossed to the same parental genotype.

As used herein, "single gene converted" or "single gene conversion" refers to plants that are developed using a plant breeding technique known as backcrossing, or via genetic engineering, where essentially all of the desired morphological and physiological characteristics of a variety are recovered in addition to the single gene transferred into the variety via the backcrossing technique or via genetic engineering.

As used herein, "elite variety" means any variety that has resulted from breeding and selection for superior agronomic performance.

As used herein, "selecting" or "selection" in the context of marker-assisted selection or breeding refer to the act of picking or choosing desired individuals, normally from a population, based on certain pre-determined criteria.

As used herein, the term "trait" refers to one or more detectable characteristics of a cell or organism which can be influenced by genotype. The phenotype can be observable to the naked eye, or by any other means of evaluation known in the art, e.g., microscopy, biochemical analysis, genomic analysis, an assay for a particular disease tolerance, etc. In some cases, a phenotype is directly controlled by a single gene or genetic locus, e.g., a "single gene trait." In other cases, a phenotype is the result of several genes.

As used herein, "marker assay" means a method for detecting a polymorphism at a particular locus using a particular method, e.g., measurement of at least one phenotype (such as seed color, flower color, or other visually detectable trait), restriction fragment length polymorphism (RFLP), single base extension, electrophoresis, sequence alignment, allelic specific oligonucleotide hybridization (ASO), random amplified polymorphic DNA (RAPD), microarray-based technologies, and nucleic acid sequencing technologies, etc.

As used herein, "marker assisted selection" (MAS) is a process by which phenotypes are selected based on marker genotypes. "Marker assisted selection breeding" refers to the process of selecting a desired trait or traits in a plant or plants by detecting one or more nucleic acids from the plant, where the nucleic acid is linked to the desired trait, and then selecting the plant or germplasm possessing those one or more nucleic acids.

As used herein, "polymorphism" means the presence of one or more variations in a population. A polymorphism may manifest as a variation in the nucleotide sequence of a nucleic acid or as a variation in the amino acid sequence of a protein. Polymorphisms include the presence of one or more variations of a nucleic acid sequence or nucleic acid feature at one or more loci in a population of one or more individuals. The variation may comprise but is not limited to one or more nucleotide base changes, the insertion of one or more nucleotides or the deletion of one or more nucleotides. A polymorphism may arise from random processes in nucleic acid replication, through mutagenesis, as a result of mobile genomic elements, from copy number variation and during the process of meiosis, such as unequal crossing over, genome duplication and chromosome breaks and fusions. The variation can be commonly found or may exist at low frequency within a population, the former having greater utility in general plant breeding and the latter may be associated with rare but important phenotypic variation. Useful polymorphisms may include single nucleotide polymorphisms (SNPs), insertions or deletions in DNA sequence (Indels), simple sequence repeats of DNA sequence (SSRs), a restriction fragment length polymorphism (RFLP), and a tag SNP. A genetic marker, a gene, a DNA-derived sequence, a RNA-derived sequence, a promoter, a 5' untranslated region of a gene, a 3' untranslated region of a gene, microRNA, siRNA, a tolerance locus, a satellite marker, a transgene, mRNA, ds mRNA, a transcriptional profile, and a methylation pattern may also comprise polymorphisms. In addition, the presence, absence, or variation in copy number of the preceding may comprise polymorphisms.

As used herein, "SNP" or "single nucleotide polymorphism" means a sequence variation that occurs when a single nucleotide (A, T, C, or G) in the genome sequence is altered or variable. "SNP markers" exist when SNPs are mapped to sites on the genome.

As used herein, "marker" or "molecular marker" or "marker locus" is a term used to denote a nucleic acid or amino acid sequence that is sufficiently unique to characterize a specific locus on the genome. Any detectable polymorphic trait can be used as a marker so long as it is inherited differentially and exhibits linkage disequilibrium with a phenotypic trait of interest. Each marker is therefore an indicator of a specific segment of DNA, having a unique nucleotide sequence. The map positions provide a measure of the relative positions of particular markers with respect to one another. When a trait is stated to be linked to a given marker it will be understood that the actual DNA segment whose sequence affects the trait generally co-segregates with the marker. More precise and definite localization of a trait can be obtained if markers are identified on both sides of the trait. By measuring the appearance of the marker(s) in progeny of crosses, the existence of the trait can be detected by relatively simple molecular tests without actually evaluating the appearance of the trait itself, which can be difficult and time-consuming because the actual evaluation of the trait requires growing plants to a stage and/or under environmental conditions where the trait can be expressed. In an aspect, markers used exhibit LOD scores of 2 or greater, 3 or greater, 4 or greater, 5 or greater, 6 or greater, 7 or greater, 8 or greater, or 9 or greater with Nic1b_ERF or Nic2_ERF loci, measuring using a method known in the art such as Qgene Version 2.23 (1996) and default parameters.

It is understood that any tobacco plant of the present disclosure can further comprise additional agronomically desirable traits, for example, by transformation with a genetic construct or transgene using a technique known in the art. Without limitation, an example of a desired trait is herbicide resistance, pest resistance, disease resistance; high yield; high grade index value; curability; curing quality; mechanical harvestability; holding ability; leaf quality; height, plant maturation (e.g., early maturing, early to medium maturing, medium maturing, medium to late maturing, or late maturing); stalk size (e.g., a small, medium, or a large stalk); or leaf number per plant (e.g., a small (e.g., 5-10 leaves), medium (e.g., 11-15 leaves), or large (e.g., 16-21) number of leaves), or any combination. In an aspect, low-nicotine or nicotine-free tobacco plants or seeds disclosed comprise one or more transgenes expressing one or more insecticidal proteins, such as, for example, a crystal protein of *Bacillus thuringiensis* or a vegetative insecticidal protein from *Bacillus cereus*, such as VIP3 (see, for example, Estruch et al. (1997) *Nat. Biotechnol.*15:137). In another aspect, tobacco plants further comprise an introgressed trait conferring resistance to brown stem rot (U.S. Pat. No. 5,689,035) or resistance to cyst nematodes (U.S. Pat. No. 5,491,081).

The present disclosure also provides tobacco plants comprising an altered nicotine or total alkaloid level but having a yield comparable to the yield of corresponding initial tobacco plants without such a nicotine level alternation. In an aspect, a low-nicotine or nicotine-free tobacco variety provides a yield selected from the group consisting of about between 1200 and 3500, between 1300 and 3400, between 1400 and 3300, between 1500 and 3200, between 1600 and 3100, between 1700 and 3000, between 1800 and 2900, between 1900 and 2800, between 2000 and 2700, between 2100 and 2600, between 2200 and 2500, and between 2300 and 2400 lbs/acre. In another aspect, a low-nicotine or nicotine-free tobacco variety provides a yield selected from the group consisting of about between 1200 and 3500, between 1300 and 3500, between 1400 and 3500, between 1500 and 3500, between 1600 and 3500, between 1700 and 3500, between 1800 and 3500, between 1900 and 3500, between 2000 and 3500, between 2100 and 3500, between 2200 and 3500, between 2300 and 3500, between 2400 and 3500, between 2500 and 3500, between 2600 and 3500, between 2700 and 3500, between 2800 and 3500, between 2900 and 3500, between 3000 and 3500, and between 3100 and 3500 lbs/acre. In a further aspect, low-nicotine or nicotine-free tobacco plants provide a yield between 65% and 130%, between 70% and 130%, between 75% and 130%, between 80% and 130%, between 85% and 130%, between 90% and 130%, between 95% and 130%, between 100% and 130%, between 105% and 130%, between 110% and 130%, between 115% and 130%, or between 120% and 130% of the yield of a control plant having essentially identical genetic background except a nic1b_erf mutation, a nic2 mutation, a Nic1b_ERF transgene, a Nic2 transgene, or combinations thereof. In a further aspect, low-nicotine or nicotine-free tobacco plants provide a yield between 70% and 125%, between 75% and 120%, between 80% and 115%, between 85% and 110%, or between 90% and 100% of the yield of a control plant having essentially identical genetic background except a nic1b_erf mutation, a nic2 mutation, a Nic1b_ERF transgene, a Nic2 transgene, or combinations thereof.

In an aspect, a tobacco plant disclosed (e.g., a low-nicotine, nicotine-free, or low-alkaloid tobacco variety) does not exhibit one or more, two or more, three or more, or all of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing. In an aspect, a tobacco plant disclosed (e.g., a low-nicotine, nicotine-free, or low-alkaloid tobacco variety) does not exhibit two or more of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing. In an aspect, a tobacco plant disclosed (e.g., a low-nicotine, nicotine-free, or low-alkaloid tobacco variety) does not exhibit three or more of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing. In an aspect, a tobacco plant disclosed (e.g., a low-nicotine, nicotine-free, or low-alkaloid tobacco variety) exhibits at a lower level compared to LA BU21, LAFC53, or LN KY171, one or more, two or more, three or more, or all of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing. In an aspect, a tobacco plant disclosed (e.g., a low-nicotine, nicotine-free, or low-alkaloid tobacco variety) exhibits at a lower level compared to LA BU21, LAFC53, or LN KY171, two or more of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing. In an aspect, a tobacco plant disclosed (e.g., a low-nicotine, nicotine-free, or low-alkaloid tobacco variety) exhibits at a lower level compared to LA BU21, LAFC53, or LN KY171, three or more, or all of the LA BU21 traits selected from the group consisting of lower yield, delayed ripening and senescence, higher susceptibility to insect herbivory, increased polyamine content after topping, higher chlorophyll, more mesophyll cells per unit leaf area, and poor end-product quality after curing.

In an aspect, a modified tobacco plant disclosed (e.g., a low-nicotine, nicotine-free, or low-alkaloid tobacco variety) comprises a modification conferring a desired trait (e.g., low-nicotine, nicotine-free, or low-alkaloid) without substantially impacting a trait selected from the group consisting of yield, ripening and senescence, susceptibility to insect herbivory, polyamine content after topping, chlorophyll level, mesophyll cell number per unit leaf area, and end-product quality after curing.

In an aspect, a modified tobacco plant disclosed comprises a modification conferring a desired trait (e.g., low-nicotine, nicotine-free, or low-alkaloid) and further comprises a trait substantially comparable to an unmodified control plant, where the trait is selected from the group consisting of yield, ripening and senescence, susceptibility to insect herbivory, polyamine content after topping, chlorophyll level, mesophyll cell number per unit leaf area, and end-product quality after curing.

In an aspect, a modified tobacco plant disclosed comprises a modification conferring a desired trait (e.g., low-nicotine, nicotine-free, or low-alkaloid) and further comprises a yield which is more than 80%, more than 85%, more than 90%, more than 95%, more than 100%, more than 105%, more than 110%, more than 115%, more than 120%, more than 125%, more than 130%, more than 135%, or more than 140% relative to the yield of an unmodified control plant. In an aspect, a modified tobacco plant disclosed comprises a modification conferring a desired trait (e.g., low-nicotine, nicotine-free, or low-alkaloid) and further comprises a yield which is between 70% and 140%, between 75% and 135%, between 80% and 130%, between 85% and 125%, between 90% and 120%, between 95% and 115%, or between 100% and 110% relative to the yield of an unmodified control plant. In an aspect, a modified tobacco plant disclosed comprises a modification conferring a desired trait (e.g., low-nicotine, nicotine-free, or low-alkaloid) and further comprises a yield which is between 70% and 80%, between 75% and 85%, between 80% and 90%, between 85% and 95%, between 90% and 100%, between 95% and 105%, between 105% and 115%, between 110% and 120%, between 115% to 125%, between 120% and 130%, between 125 and 135%, or between 130% and 140% relative to the yield of an unmodified control plant.

In an aspect, a modified tobacco plant disclosed comprises a modification conferring a desired trait (e.g., low-nicotine, nicotine-free, or low-alkaloid) and further comprises a polyamine content after topping which is more than 80%, more than 85%, more than 90%, more than 95%, more than 100%, more than 105%, more than 110%, more than 115%, more than 120%, more than 125%, more than 130%, more than 135%, or more than 140% relative to the polyamine content after topping of an unmodified control plant. In an aspect, a modified tobacco plant disclosed comprises a modification conferring a desired trait (e.g., low-nicotine, nicotine-free, or low-alkaloid) and further comprises a polyamine content after topping which is between 70% and 140%, between 75% and 135%, between 80% and 130%, between 85% and 125%, between 90% and 120%, between 95% and 115%, or between 100% and 110% relative to the polyamine content after topping of an unmodified control plant. In an aspect, a modified tobacco plant disclosed comprises a modification conferring a desired trait (e.g., low-nicotine, nicotine-free, or low-alkaloid) and further comprises a polyamine content after topping which is between 70% and 80%, between 75% and 85%, between 80% and 90%, between 85% and 95%, between 90% and 100%, between 95% and 105%, between 105% and 115%, between 110% and 120%, between 115% to 125%, between 120% and 130%, between 125 and 135%, or between 130% and 140% relative to the polyamine content after topping of an unmodified control plant.

In an aspect, a modified tobacco plant disclosed comprises a modification conferring a desired trait (e.g., low-nicotine, nicotine-free, or low-alkaloid) and further comprises a chlorophyll level which is more than 80%, more than 85%, more than 90%, more than 95%, more than 100%, more than 105%, more than 110%, more than 115%, more than 120%, more than 125%, more than 130%, more than 135%, or more than 140% relative to the chlorophyll level of an unmodified control plant. In an aspect, a modified tobacco plant disclosed comprises a modification conferring a desired trait (e.g., low-nicotine, nicotine-free, or low-alkaloid) and further comprises a chlorophyll level which is between 70% and 140%, between 75% and 135%, between 80% and 130%, between 85% and 125%, between 90% and 120%, between 95% and 115%, or between 100% and 110% relative to the chlorophyll level of an unmodified control plant. In an aspect, a modified tobacco plant disclosed comprises a modification conferring a desired trait (e.g., low-nicotine, nicotine-free, or low-alkaloid) and further comprises a chlorophyll level which is between 70% and 80%, between 75% and 85%, between 80% and 90%, between 85% and 95%, between 90% and 100%, between 95% and 105%, between 105% and 115%, between 110% and 120%, between 115% to 125%, between 120% and 130%, between 125 and 135%, or between 130% and 140% relative to the chlorophyll level of an unmodified control plant.

In an aspect, a modified tobacco plant disclosed comprises a modification conferring a desired trait (e.g., low-nicotine, nicotine-free, or low-alkaloid) and further comprises a mesophyll cell number per unit leaf area which is more than 80%, more than 85%, more than 90%, more than 95%, more than 100%, more than 105%, more than 110%, more than 115%, more than 120%, more than 125%, more than 130%, more than 135%, or more than 140% relative to the mesophyll cell number per unit leaf area of an unmodified control plant. In an aspect, a modified tobacco plant disclosed comprises a modification conferring a desired trait (e.g., low-nicotine, nicotine-free, or low-alkaloid) and further comprises a mesophyll cell number per unit leaf area which is between 70% and 140%, between 75% and 135%, between 80% and 130%, between 85% and 125%, between 90% and 120%, between 95% and 115%, or between 100% and 110% relative to the mesophyll cell number per unit leaf area of an unmodified control plant. In an aspect, a modified tobacco plant disclosed comprises a modification conferring a desired trait (e.g., low-nicotine, nicotine-free, or low-alkaloid) and further comprises a mesophyll cell number per unit leaf area which is between 70% and 80%, between 75% and 85%, between 80% and 90%, between 85% and 95%, between 90% and 100%, between 95% and 105%, between 105% and 115%, between 110% and 120%, between 115% to 125%, between 120% and 130%, between 125 and 135%, or between 130% and 140% relative to the mesophyll cell number per unit leaf area of an unmodified control plant.

In an aspect, a low-nicotine or nicotine-free tobacco variety disclosed is adapted for machine harvesting. In another aspect, a low-nicotine or nicotine-free tobacco variety disclosed is harvested mechanically.

In an aspect, tobacco plants provided are hybrid plants. Hybrids can be produced by preventing self-pollination of female parent plants (e.g., seed parents) of a first variety, permitting pollen from male parent plants of a second variety to fertilize the female parent plants, and allowing F1 hybrid seeds to form on the female plants. Self-pollination of female plants can be prevented by emasculating the flowers at an early stage of flower development. Alternatively, pollen formation can be prevented on the female parent plants using a form of male sterility. For example, male sterility can be produced by male sterility (MS), or transgenic male sterility where a transgene inhibits microsporogenesis and/or pollen formation, or self-incompatibility. Female parent plants containing MS are particularly useful. In aspects in which the female parent plants are MS, pollen may be harvested from male fertile plants and applied manually to the stigmas of MS female parent plants, and the resulting F1 seed is harvested.

Plants can be used to form single-cross tobacco F1 hybrids. Pollen from a male parent plant is manually transferred to an emasculated female parent plant or a female parent plant that is male sterile to form F1 seed. Alternatively, three-way crosses can be carried out where a single-cross F1 hybrid is used as a female parent and is crossed with a different male parent. As another alternative, double-cross hybrids can be created where the F1 progeny of two different single-crosses are themselves crossed. Self-incompatibility can be used to particular advantage to prevent self-pollination of female parents when forming a double-cross hybrid.

In an aspect, a low-nicotine or nicotine-free tobacco variety is male sterile. In another aspect, a low-nicotine or nicotine-free tobacco variety is cytoplasmic male sterile. Male sterile tobacco plants may be produced by any method known in the art. Methods of producing male sterile tobacco are described in Wernsman, E. A., and Rufty, R. C. 1987. Chapter Seventeen. Tobacco. Pages 669-698 In: Cultivar Development. Crop Species. W. H. Fehr (ed.), MacMillan Publishing Go., Inc., New York, N.Y. 761 pp.

In a further aspect, tobacco parts provided include, but are not limited to, a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast. In an aspect, tobacco part provided does not include seed. In an aspect, this disclosure provides tobacco plant cells, tissues, and organs that are not reproductive material and do not mediate the natural reproduction of the plant. In another aspect, this disclosure also provides tobacco plant cells, tissues, and organs that are reproductive material and mediate the natural reproduction of the plant. In another aspect, this disclosure provides tobacco plant cells, tissues, and organs that cannot maintain themselves via photosynthesis. In another aspect, this disclosure provides somatic tobacco plant cells. Somatic cells, contrary to germline cells, do not mediate plant reproduction.

The provided cells, tissues and organs may be from seed, fruit, leaf, cotyledon, hypocotyl, meristem, embryos, endosperm, root, shoot, stem, pod, flower, infloresence, stalk, pedicel, style, stigma, receptacle, petal, sepal, pollen, anther, filament, ovary, ovule, pericarp, phloem, vascular tissue. In another aspect, this disclosure provides a tobacco plant chloroplast. In a further aspect, this disclosure provides epidermal cells, stomata cell, leaf or root hairs, a storage root, or a tuber. In another aspect, this disclosure provides a tobacco protoplast.

Skilled artisans understand that tobacco plants naturally reproduce via seeds, not via asexual reproduction or vegetative propagation. In an aspect, this disclosure provides tobacco endosperm. In another aspect, this disclosure provides tobacco endosperm cells. In a further aspect, this disclosure provides a male or female sterile tobacco plant, which cannot reproduce without human intervention.

In an aspect, the present disclosure provides a nucleic acid molecule comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% identity to a sequence selected from the group consisting of SEQ ID NOs: 1 to 72, 147, 150, 157 to 161, 187 to 189, and 202 to 205 and fragments thereof. In an aspect, the present disclosure provides a polypeptide or protein comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% identity to an amino acid sequence selected from the group consisting of SEQ ID NOs:73 to 107, 148, 151, 180 to 183, 206, 207, and 190 to 192. In another aspect, the present disclosure provides a polypeptide or protein comprising at least about 40%, 45%, 50%, 55%, 60%, 65%, 70%, 75%, 80%, 85%, 90%, 91%, 92%, 93%, 94%, 95%, 96%, 97%, 98%, 99%, or 100% sequence similarity to an amino acid sequence selected from the group consisting of SEQ ID NOs: 73 to 107, 148, 151, 180 to 183, 206, 207, and 190 to 192. In another aspect, the present disclosure provides a biologically active variant of a protein having an amino acid sequence selected from the group consisting of SEQ ID NOs: 73 to 107, 148, 151, 180 to 183, 206, 207, and 190 to 192. A biologically active variant of a protein of the present disclosure may differ from that protein by as few as 1-15 amino acid residues, as few as 10, as few as 9, as few as 8, as few as 7, as few as 6, as few as 5, as few as 4, as few as 3, as few as 2, or as few as 1 amino acid residue. Also provided are orthologous genes or proteins of genes or proteins from Nic1b_ERF locus. "Orthologs" are genes derived from a common ancestral gene and which are found in different species as a result of speciation. Orthologs may share at least 60%, 70%, 75%, 80%, 85%, 90%, 91%, 92%, 93%, 94%, 95%, 96%, 97%, 98%, 99%, or greater sequence identity or similarity at the nucleotide sequence and/or the protein sequence level. Functions of orthologs are often highly conserved among species.

As used herein, the term "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are deemed to have "sequence similarity" or "similarity."

Nucleic acid molecules, polypeptides, or proteins provided can be isolated or substantially purified. An "isolated" or "purified" nucleic acid molecule, polypeptide, protein, or biologically active portion thereof, is substantially or essentially free from components that normally accompany or interact with the polynucleotide or protein as found in its naturally occurring environment. For example, an isolated or purified polynucleotide or protein is substantially free of other cellular material, or culture medium when produced by recombinant techniques, or substantially free of chemical precursors or other chemicals when chemically synthesized.

The present disclosure further provides a method manufacturing a tobacco product comprising tobacco material from tobacco plants disclosed. In an aspect, methods comprise conditioning aged tobacco material made from tobacco plants to increase its moisture content from between about 12.5% and about 13.5% to about 21%, blending the conditioned tobacco material to produce a desirable blend. In an aspect, the method of manufacturing a tobacco product further comprises casing or flavoring the blend. Generally, during the casing process, casing or sauce materials are added to blends to enhance their quality by balancing the chemical composition and to develop certain desired flavor characteristics. Further details for the casing process can be found in *Tobacco Production, Chemistry and Technology*, Edited by L. Davis and M. Nielsen, Blackwell Science, 1999.

Tobacco material provided can be also processed using methods including, but not limited to, heat treatment (e.g., cooking, toasting), flavoring, enzyme treatment, expansion and/or curing. Both fermented and non-fermented tobaccos can be processed using these techniques. Examples of suitable processed tobaccos include dark air-cured, dark fire cured, burley, flue cured, and cigar filler or wrapper, as well as the products from the whole leaf stemming operation. In an aspect, tobacco fibers include up to 70% dark tobacco on a fresh weight basis. For example, tobacco can be conditioned by heating, sweating and/or pasteurizing steps as described in U.S. Publication Nos. 2004/0118422 or 2005/0178398.

Tobacco material provided can be subject to fermentation. Fermenting typically is characterized by high initial moisture content, heat generation, and a 10 to 20% loss of dry weight. See, e.g., U.S. Pat. Nos. 4,528,993; 4,660,577; 4,848,373; and 5,372,149. In addition to modifying the aroma of the leaf, fermentation can change either or both the color and texture of a leaf. Also during the fermentation process, evolution gases can be produced, oxygen can be taken up, the pH can change, and the amount of water retained can change. See, for example, U.S. Publication No. 2005/0178398 and Tso (1999, Chapter 1 in Tobacco, Production, Chemistry and Technology, Davis & Nielsen, eds., Blackwell Publishing, Oxford). Cured, or cured and fermented tobacco can be further processed (e.g., cut, expanded, blended, milled or comminuted) prior to incorporation into the oral product. The tobacco, in some cases, is long cut fermented cured moist tobacco having an oven volatiles content of between 48 and 50 weight percent prior to mixing with the copolymer and optionally flavorants and other additives.

In an aspect, tobacco material provided can be processed to a desired size. In an aspect, tobacco fibers can be processed to have an average fiber size of less than 200 micrometers. In an aspect, tobacco fibers are between 75 and 125 micrometers. In another aspect, tobacco fibers are processed to have a size of 75 micrometers or less. In an aspect, tobacco fibers include long cut tobacco, which can be cut or shredded into widths of about 10 cuts/inch up to about 110 cuts/inch and lengths of about 0.1 inches up to about 1 inch. Double cut tobacco fibers can have a range of particle sizes such that about 70% of the double cut tobacco fibers falls between the mesh sizes of −20 mesh and 80 mesh.

Tobacco material provided can be processed to have a total oven volatiles content of about 10% by weight or greater; about 20% by weight or greater; about 40% by weight or greater; about 15% by weight to about 25% by weight; about 20% by weight to about 30% by weight; about 30% by weight to about 50% by weight; about 45% by weight to about 65% by weight; or about 50% by weight to about 60% by weight. Those of skill in the art will appreciate that "moist" tobacco typically refers to tobacco that has an oven volatiles content of between about 40% by weight and about 60% by weight (e.g., about 45% by weight to about 55% by weight, or about 50% by weight). As used herein, "oven volatiles" are determined by calculating the percentage of weight loss for a sample after drying the sample in a pre-warmed forced draft oven at 110° C. for 3.25 hours. The oral product can have a different overall oven volatiles content than the oven volatiles content of the tobacco fibers used to make the oral product. The processing steps described can reduce or increase the oven volatiles content.

The following list provides a first set of exemplary embodiments.

1. A tobacco plant, or tobacco genotype or tobacco part thereof, comprising a mutation in a Nic1b locus, wherein the tobacco plant is capable of producing a leaf, when cured, having a USDA grade index value of 50 or more.
2. The tobacco plant, or tobacco genotype or tobacco part thereof, of Embodiment 1, wherein the tobacco plant further comprises a mutation in an ERF gene of a Nic2 locus.
3. The tobacco plant, or tobacco genotype or tobacco part thereof, of Embodiment 1, wherein the tobacco plant further comprises one or more mutations in two or more, three or more, four or more, five or more, six or more, or all seven genes selected from the group consisting of ERF 189, ERF 115, ERF221, ERF 104, ERF 179, ERF 17, and ERF 168.
4. The tobacco plant, or tobacco genotype or tobacco part thereof, of Embodiment 1, wherein the tobacco plant further comprises one or more mutations in ERF 189, ERF 115, or both.
5. The tobacco plant, or tobacco genotype or tobacco part thereof, of Embodiment 1, wherein the tobacco plant is capable of producing a leaf, when cured, having a USDA grade index value selected from the group consisting of 55 or more, 60 or more, 65 or more, 70 or more, 75 or more, 80 or more, 85 or more, 90 or more, and 95 or more.
6. The tobacco plant, or tobacco genotype or tobacco part thereof, of Embodiment 1, wherein the tobacco plant is capable of producing a leaf, when cured, having a USDA grade index value comparable to that of a control plant when grown and cured in similar conditions, wherein the control plant shares an essentially identical genetic background with the tobacco plant except the mutation.
7. The tobacco plant, or tobacco genotype or tobacco part thereof, of Embodiment 1, wherein the tobacco plant is capable of producing a leaf, when cured, having a USDA grade index value of at least about 65%, at least about 70%, at least about 75%, at least about 80%, at least about 85%, at least about 90%, at least about 95%, or at least about 98% of the USDA grade index value of a control plant when grown and cured in similar conditions, wherein the control plant shares an essentially identical genetic background with the tobacco plant except the mutation.
8. The tobacco plant, or tobacco genotype or tobacco part thereof, of Embodiment 1, wherein the tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein the control plant shares an essentially identical genetic background with the tobacco plant except the mutation.

9. The tobacco plant, or tobacco genotype or tobacco part thereof, of Embodiment 1, wherein the tobacco plant comprises a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%.

10. The tobacco plant, or tobacco genotype or tobacco part thereof, of Embodiment 1, wherein the tobacco plant further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

11. A tobacco plant, or tobacco genotype or tobacco part thereof, comprising a mutation in a Nic1b locus, wherein the tobacco plant is capable of producing a leaf, when cured, having a USDA grade index value comparable to that of a control plant when grown and cured in similar conditions, wherein the control plant shares an essentially identical genetic background with the tobacco plant except the mutation.

12. The tobacco plant, or tobacco genotype or tobacco part thereof, of Embodiment 11, wherein the tobacco plant further comprises a mutation in an ERF gene of a Nic2 locus.

13. The tobacco plant, or tobacco genotype or tobacco part thereof, of Embodiment 11, wherein the tobacco plant further comprises one or more mutations in two or more, three or more, four or more, five or more, six or more, or all seven genes selected from the group consisting of ERF 189, ERF 115, ERF221, ERF 104, ERF 179, ERF 17, and ERF 168.

14. The tobacco plant, or tobacco genotype or tobacco part thereof, of Embodiment 11, wherein the tobacco plant further comprises one or more mutations in ERF 189, ERF 115, or both.

15. The tobacco plant, or tobacco genotype or tobacco part thereof, of Embodiment 11, wherein the tobacco plant is capable of producing a leaf, when cured, having a USDA grade index value selected from the group consisting of 55 or more, 60 or more, 65 or more, 70 or more, 75 or more, 80 or more, 85 or more, 90 or more, and 95 or more.

16. The tobacco plant, or tobacco genotype or tobacco part thereof, of Embodiment 11, wherein the tobacco plant is capable of producing a leaf, when cured, having a USDA grade index value of at least about 65%, at least about 70%, at least about 75%, at least about 80%, at least about 85%, at least about 90%, at least about 95%, or at least about 98% of the grading index of the control plant.

17. The tobacco plant, or tobacco genotype or tobacco part thereof, of Embodiment 11, wherein the tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of the control plant when grown in similar growth conditions.

18. The tobacco plant, or tobacco genotype or tobacco part thereof, of Embodiment 11, wherein the tobacco plant further comprises a transgene or mutation directly suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

19. A plant or tobacco genotype of a tobacco variety comprising a nic1b mutation, wherein the tobacco variety has a leaf grading index comparable to the leaf grading index of a control tobacco variety when grown in similar growth conditions, wherein the control tobacco variety shares an essentially identical genetic background with the tobacco variety except the mutation.

20. The plant or tobacco genotype of Embodiment 19, wherein the tobacco variety further comprises a mutation in an ERF gene of a Nic2 locus.

21. The plant or tobacco genotype of Embodiment 19, wherein the tobacco plant further comprises one or more mutations in two or more, three or more, four or more, five or more, six or more, or all seven genes selected from the group consisting of ERF 189, ERF 115, ERF221, ERF 104, ERF 179, ERF 17, and ERF 168.

22. The plant or tobacco genotype of Embodiment 19, wherein the tobacco plant further comprises one or more mutations in ERF 189, ERF 115, or both.

23. A non-transgenic tobacco plant, or tobacco genotype or tobacco part thereof, comprising a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%, wherein the tobacco plant is capable of producing a leaf, when cured, having a USDA grade index value of 50 or more 55 or more, 60 or more, 65 or more, 70 or more, 75 or more, 80 or more, 85 or more, 90 or more, and 95 or more.

24. The non-transgenic tobacco plant, or tobacco genotype or tobacco part thereof, of Embodiment 23, wherein the non-transgenic tobacco plant comprises a nicotine level of less than 2.0% and is capable of producing a leaf, when cured, having a USDA grade index value of 70 or more.

25. The non-transgenic tobacco plant, or tobacco genotype or tobacco part thereof, of Embodiment 23, wherein the non-transgenic tobacco plant comprises a nicotine level of less than 1.0% and is capable of producing a leaf, when cured, having a USDA grade index value of 70 or more.

26. A tobacco plant, or tobacco genotype or tobacco part thereof, comprising a non-transgenic mutation in a Nic1b locus, wherein the non-transgenic mutation reduces the nicotine level of the tobacco plant to below 1%, below 2%, below 5%, below 8%, below 10%, below 12%, below 15%, below 20%, below 25%, below 30%, below 40%, below 50%, below 60%, below 70%, or below 80% of the nicotine level of a control plant when grown in similar growth conditions, wherein the tobacco plant is capable of producing a leaf, when cured, having a USDA grade index value comparable to the USDA grade index value of the control plant, and wherein the control plant shares an essentially identical genetic background with the tobacco plant except the non-transgenic mutation.
27. A population of the tobacco plants of any one of Embodiments 1 to 26.
28. Cured tobacco material from the tobacco plant of any one of Embodiments 1 to 26.
29. The cured tobacco material of Embodiment 28, wherein the cured tobacco material is made by a curing process selected from the group consisting of flue curing, air curing, fire curing, and sun curing.
30. A tobacco blend comprising the cured tobacco material of Embodiment 28.
31. The tobacco blend of Embodiment 30, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in the tobacco blend by weight.
32. The tobacco blend of Embodiment 30, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in the tobacco blend by volume.
33. A tobacco product comprising the cured tobacco material of Embodiment 28.
34. The tobacco product of Embodiment 33, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.
35. The tobacco product of Embodiment 33, wherein the tobacco product is a smokeless tobacco product.
36. The tobacco product of Embodiment 35, wherein the smokeless tobacco product is selected from the group consisting of loose leaf chewing tobacco, plug chewing tobacco, moist snuff, and nasal snuff.
37. A reconstituted tobacco comprising the cured tobacco material of Embodiment 28.
38. A tobacco plant, or tobacco genotype or tobacco part thereof, comprising a mutation in a Nic1b locus, wherein the mutation is absent from a LA Burley 21 variety.
39. The tobacco plant, or tobacco genotype or tobacco part thereof, of Embodiment 38, wherein the tobacco plant comprises a shorter chromosomal introgression at a Nic1b locus compared to the LA Burley 21 variety.
40. The tobacco plant, or tobacco genotype or tobacco part thereof, of Embodiment 38, wherein the tobacco plant comprises a lower level of nicotine compared to a control tobacco plant without the mutation when grown in similar growth conditions.
41. The tobacco plant, or tobacco genotype or tobacco part thereof, of Embodiment 38, wherein the tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level in a control tobacco plant without the mutation when grown in similar growth conditions.
42. The tobacco plant, or tobacco genotype or tobacco part thereof, of Embodiment 38, wherein the tobacco plant comprises a lower level of total alkaloid compared to a control tobacco plant without the mutation when grown in similar growth conditions.
43. The tobacco plant, or tobacco genotype or tobacco part thereof, of Embodiment 38, wherein the tobacco plant comprises a lower level of one or more alkaloid selected from the group consisting of nicotine, nornicotine, anabasine, and anatabine, compared to a control tobacco plant without the mutation when grown in similar growth conditions.
44. The tobacco plant, or tobacco genotype or tobacco part thereof, of Embodiment 38, wherein the tobacco plant comprises a similar level of one or more compounds selected from the group consisting of 3-methylvaleric acid, valeric acid, isovaleric acid, a labdenoid, a cembrenoid, a sugar ester, and a reducing sugar, compared to a control tobacco plant without the mutation when grown in similar growth conditions.
45. The tobacco plant, or tobacco genotype or tobacco part thereof, of Embodiment 38, wherein the mutation is homozygous.
46. The tobacco plant, or tobacco genotype or tobacco part thereof, of Embodiment 38, wherein the mutation is heterozygous.
47. The tobacco plant, or tobacco genotype or tobacco part thereof, of Embodiment 38, wherein the mutation is selected from the group consisting of a point mutation, a deletion, an insertion, a duplication, and an inversion.
48. The tobacco plant, or tobacco genotype or tobacco part thereof, of Embodiment 38, wherein the mutation is introduced by an approach selected from the group consisting of random mutagenesis and targeted mutagenesis.
49. The tobacco plant, or tobacco genotype or tobacco part thereof, of Embodiment 48, wherein the targeted mutagenesis is mediated by meganuclease, zinc finger nuclease, TALEN, or CRISPR.
50. The tobacco plant, or tobacco genotype or tobacco part thereof, of Embodiment 38, wherein the tobacco plant further comprises a mutation in an ERF gene of a Nic2 locus.
51. The tobacco plant, or tobacco genotype or tobacco part thereof, of Embodiment 38, wherein the mutation is located within a gene comprising a sequence having at least 80%, at least 85%, at least 90%, at least 95%, at least 97%, at least 98%, at least 99% identity to a sequence selected from the group consisting of SEQ ID NOs: 3 to 37, 146, 149, 152 to 156, 202, 203, and 184 to 186, and fragments thereof.
52. The tobacco plant, or tobacco genotype or tobacco part thereof, of Embodiment 38, wherein the mutation reduces the expression or activity of the gene.
53. The tobacco plant, or tobacco genotype or tobacco part thereof, of Embodiment 38, wherein the mutation is located within a gene comprising a sequence having at least 80%, at least 85%, at least 90%, at least 95%, at least 97%, at least 98%, at least 99% identity to a sequence selected from the group consisting of SEQ ID NOs:4, 14, 15, 17, 18, 19, 37, 39, 49, 50, 52, 53, 54, 202 to 205, and 72, and fragments thereof.

54. The tobacco plant, or tobacco genotype or tobacco part thereof, of Embodiment 38, wherein the mutation is located within a gene comprising a sequence having at least 80%, at least 85%, at least 90%, at least 95%, at least 97%, at least 98%, at least 99% identity to a sequence selected from the group consisting of SEQ ID NOs: 14, 17, 18, 19, 49, 52, 53, 202 to 205, and 54, and fragments thereof.

55. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 4, 14, 15, 17, 18, 19, 37, 39, 49, 50, 52, 53, 202 to 205, 54, and 72, and fragments thereof.

56. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 14, 17, 18, 19, 49, 52, 53, 202 to 205, and 54, and fragments thereof.

57. The tobacco plant, or tobacco genotype or tobacco part thereof, of Embodiment 38, wherein the mutation is located within a gene comprising a coding sequence having at least 80%, at least 85%, at least 90%, at least 95%, at least 97%, at least 98%, at least 99% identity to a sequence selected from the group consisting of SEQ ID NOs:49, 52, 53, 204, 205, and 54, and fragments thereof.

58. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 49, 52, 53, 204, 205, and 54, and fragments thereof.

59. The tobacco plant, or tobacco genotype or tobacco part thereof, of Embodiment 38, wherein the mutation is located within a gene encoding a polypeptide having at least 80%, at least 85%, at least 90%, at least 95%, at least 97%, at least 98%, at least 99% identity to a sequence selected from the group consisting of SEQ ID NOs: 84, 87, 88, and 89, and fragments thereof.

60. The tobacco plant, or tobacco genotype or tobacco part thereof, of Embodiment 38, wherein the plant further comprises a reduced level of mRNA, protein, or both of one or more genes encoding a product selected from the group consisting of PMT, MPO, QPT, BBL, MATE, and A622, compared to a tobacco plant without the mutation when grown in similar growth conditions.

61. The tobacco plant, or tobacco genotype or tobacco part thereof, of Embodiment 38, wherein the plant further comprises a transgene or mutation suppressing the expression or activity of one or more genes encoding a product selected from the group consisting of PMT, MPO, QPT, BBL, A622, aspartate oxidase, agmatine deiminase (AIC), arginase, diamine oxidase, ornithine decarboxylase, arginine decarboxylase, nicotine uptake permease (NUP), and MATE transporter.

62. The tobacco plant, or tobacco genotype or tobacco part thereof, of Embodiment 38, wherein the tobacco plant is a hybrid.

63. The tobacco plant, or tobacco genotype or tobacco part thereof, of Embodiment 38, wherein the part is selected from the group consisting of a leaf, a stem, a root, a seed, a flower, pollen, an anther, an ovule, a pedicel, a fruit, a meristem, a cotyledon, a hypocotyl, a pod, an embryo, endosperm, an explant, a callus, a tissue culture, a shoot, a cell, and a protoplast.

64. The tobacco plant, or tobacco genotype or tobacco part thereof, of Embodiment 38, wherein the tobacco plant is from a variety selected from the group consisting of flue-cured tobacco, air-cured tobacco, dark fire-cured tobacco, and Galpao tobacco, and Oriental tobacco.

65. The tobacco plant, or tobacco genotype or tobacco part thereof, of Embodiment 38, wherein the tobacco plant is from a variety selected from the group consisting of Burley tobacco, Maryland tobacco, and dark air-cured tobacco.

66. A population of the tobacco plants of Embodiment 38.

67. Cured tobacco material from the tobacco plant of Embodiment 38.

68. The cured tobacco material of Embodiment 67, wherein the cured tobacco material comprises a lower level of nicotine compared to cured tobacco material from a control tobacco plant without the mutation.

69. The cured tobacco material of Embodiment 67, wherein the tobacco plant comprises nicotine at a level between 0.2% and 0.6%.

70. The cured tobacco material of Embodiment 67, wherein the tobacco plant comprises nicotine at a level between 1.0% and 3.0%.

71. The cured tobacco material of Embodiment 67, wherein the cured tobacco material is made by a curing process selected from the group consisting of flue curing, air curing, fire curing, and sun curing.

72. A tobacco blend comprising the cured tobacco material of Embodiment 67.

73. A tobacco product comprising the cured tobacco material of Embodiment 67.

74. The tobacco product of Embodiment 73, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

75. The tobacco product of Embodiment 73, wherein the tobacco product is a smokeless tobacco product.

76. The tobacco product of Embodiment 75, wherein the smokeless tobacco product is selected from the group consisting of loose leaf chewing tobacco, plug chewing tobacco, moist snuff, and nasal snuff.

77. A reconstituted tobacco comprising the cured tobacco material of Embodiment 67.

78. A recombinant DNA construct comprising a promoter that is functional in a tobacco cell and operably linked to a polynucleotide that encodes a polypeptide having an amino acid sequence at least 80%, at least 85%, at least 90%, at least 95%, at least 97%, at least 98%, at least 99% identical to an amino acid sequence selected from the group consisting of SEQ ID NOs: 73 to 107, 148, 151, 180 to 183, 206, 207, and 190 to 192, and fragments thereof.

79. A tobacco plant, or tobacco genotype or tobacco part thereof, comprising the recombinant DNA construct of Embodiment 78.
80. A tobacco plant, or tobacco genotype or tobacco part thereof, of Embodiment 79, wherein the tobacco plant comprises a higher level of nicotine compared to a control tobacco plant without the recombinant DNA construct.
81. Cured tobacco material from the tobacco plant of Embodiment 79.
82. A tobacco product comprising the cured tobacco material of Embodiment 81.
83. A method of increasing the nicotine level of a tobacco plant, the method comprising transforming a tobacco plant with the recombinant DNA construct of Embodiment 78.
84. A recombinant DNA construct comprising a promoter that is functional in a tobacco cell and operably linked to a polynucleotide that encodes an RNA molecule capable of binding to an RNA encoding a polypeptide having an amino acid sequence at least 80%, at least 85%, at least 90%, at least 95%, at least 97%, at least 98%, at least 99% identical to an amino acid sequence selected from the group consisting of SEQ ID NO: 73 to 107, 148, 151, 180 to 183, 206, 207, and 190 to 192, and fragments thereof, and wherein the RNA molecule suppresses the expression of the polypeptide.
85. A tobacco plant, or tobacco genotype or tobacco part thereof, comprising the recombinant DNA construct of Embodiment 84.
86. The tobacco plant, or tobacco genotype or tobacco part thereof, of Embodiment 85, wherein the RNA molecule is selected from the group consisting of a microRNA, an siRNA, and a trans-acting siRNA.
87. The tobacco plant, or tobacco genotype or tobacco part thereof, of Embodiment 85, wherein the polynucleotide encodes a double stranded RNA.
88. The tobacco plant, or tobacco genotype or tobacco part thereof, of Embodiment 85, wherein the tobacco plant comprises a lower level of nicotine compared to a control tobacco plant without the recombinant DNA construct.
89. Cured tobacco material from the tobacco plant of Embodiment 85.
90. A tobacco product comprising the cured tobacco material of Embodiment 89.
91. A method of reducing the nicotine level of a tobacco plant, the method comprising transforming a tobacco plant with the recombinant DNA construct of Embodiment 84.
92. A tobacco plant, or tobacco genotype or tobacco part thereof, comprising a heterologous expression cassette comprising a Nic1b inhibitory sequence of a gene comprising a sequence selected from the group consisting of SEQ ID NOs: 3 to 37, 146, 149, 152 to 156, 202, 203, and 184 to 186, and fragments thereof, wherein the inhibitory sequence is operably linked to a promoter that is functional in a plant cell, and wherein the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of sequence selected from the group consisting of SEQ ID NOs: 3 to 37, 146, 149, 152 to 156, 202, 203, and 184 to 186, and fragments thereof.
93. The tobacco plant, or tobacco genotype or tobacco part thereof, of Embodiment 92, wherein the Nic1b inhibitory sequence is capable of being transcribed as an inhibitory polynucleotide selected from the group consisting of a single-stranded RNA polynucleotide, a double-stranded RNA polynucleotide, and a combination thereof.
94. The tobacco plant, or tobacco genotype or tobacco part thereof, of Embodiment 92, wherein the promoter is selected from the group consisting of a constitutive promoter, an inducible promoter, and a tissue-preferred promoter.
95. The tobacco plant, or tobacco genotype or tobacco part thereof, of Embodiment 92, wherein the promoter is a root-specific promoter.
96. A tobacco plant, or tobacco genotype or tobacco part thereof, comprising a heterologous expression cassette comprising a Nic1b inhibitory sequence of a gene comprising a sequence selected from the group consisting of SEQ ID NOs: 4, 14, 15, 17, 18, 19, 37, 39, 49, 50, 52, 53, 54, 202 to 205, and 72, and fragments thereof, wherein the inhibitory sequence is operably linked to a promoter that is functional in a plant cell, and wherein the inhibitory sequence has at least 90% sequence identity to a fragment of at least 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides of sequence selected from the group consisting of SEQ ID NOs: 4, 14, 15, 17, 18, 19, 37, 39, 49, 50, 52, 53, 54, 202 to 205, and 72, and fragments thereof.
97. A method of introgressing a low nicotine trait into a tobacco variety, the method comprising:
  a. crossing a first tobacco variety comprising a low nicotine trait with a second tobacco variety without the low nicotine trait to produce one or more progeny tobacco plants;
  b. genotyping the one or more progeny tobacco plants for a polymorphic marker linked to the low nicotine trait, wherein the polymorphic marker is in a chromosomal interval flanked by any two of SNP markers selected from the group consisting of SEQ ID Nos. 125 to 145 and 193 to 201; and
  c. selecting a progeny tobacco plant comprising the low nicotine trait.
98. The method of Embodiment 97, wherein the method further comprises backcrossing the selected progeny tobacco plant with the second tobacco variety.
99. The method of Embodiment 97, wherein the method further comprises:
  d. crossing the selected progeny plant with itself or with the second tobacco variety to produce one or more further progeny tobacco plants; and
  e. selecting a further progeny tobacco plant comprising the low nicotine trait.
100. The method of Embodiment 99, wherein the step (e) of selecting comprises marker-assisted selection.
101. The method of Embodiment 97, wherein the method produces a single gene conversion comprising the low nicotine trait.
102. The method of Embodiment 97, wherein the second tobacco variety is an elite variety.
103. The method of Embodiment 97, wherein the genotyping involves one or more molecular marker assays.

104. The method of Embodiment 97, wherein the polymorphic marker comprises a polymorphism selected from the group consisting of single nucleotide polymorphisms (SNPs), insertions or deletions in DNA sequence (Indels), simple sequence repeats of DNA sequence (SSRs), a restriction fragment length polymorphism (RFLP), and a tag SNP.

105. The method of Embodiment 97, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 3 to 37, 146, 149, 152 to 156, 202, 203, and 184 to 186, and fragments thereof.

106. The method of Embodiment 97, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID Nos: 4, 14, 15, 17, 18, 19, 37, 39, 49, 50, 52, 53, 54, 202 to 205, and 72, and fragments thereof.

107. The method of Embodiment 97, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID Nos: 14, 17, 18, 19, 49, 52, 53, 202 to 205, and 54, and fragments thereof.

108. The method of Embodiment 97, wherein the first tobacco variety is selected from the group consisting of LA Burley 21, LAFC53, and LN KY171.

109. The method of Embodiment 97, wherein the selected progeny tobacco plant comprises a shorter chromosomal introgression at a Nic1b locus compared to LA Burley 21, LAFC53, and LNKY171.

110. A method of introgressing a low nicotine trait into a tobacco variety, the method comprising:
 a. crossing a first tobacco variety comprising a low nicotine trait with a second tobacco variety without the low nicotine trait to produce one or more progeny tobacco plants;
 b. genotyping the one or more progeny tobacco plants for a polymorphic marker linked to the low nicotine trait, wherein the polymorphic marker is within 20 cM of any one of SNP markers selected from the group consisting of SEQ ID Nos. 125 to 145 and 193 to 201, or any locus having a sequence selected from the group consisting of SEQ ID Nos. 1, 3 to 37, 146, 149, 152 to 156, 202, 203, and 184 to 186; and
 c. selecting a progeny tobacco plant comprising the low nicotine trait.

111. The method of Embodiment 110, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 3 to 37, 146, 149, 152 to 156, 202, 203, and 184 to 186, and fragments thereof.

112. The method of Embodiment 110, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 4, 14, 15, 17, 18, 19, 37, 39, 49, 50, 52, 53, 54, 202 to 205, and 72, and fragments thereof.

113. The method of Embodiment 110, wherein the genotyping comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 14, 17, 18, 19, 49, 52, 53, 202 to 205, and 54, and fragments thereof.

114. A method of selecting a tobacco plant having a low nicotine trait, the method comprising:
 a. isolating nucleic acids from a collection of tobacco germplasm;
 b. assaying the nucleic acids for one or more markers closely linked to a Nic1b locus; and
 c. selecting a tobacco plant having a low nicotine trait based on the marker assay.

115. The method of Embodiment 114, wherein the one or more markers are within about 20 cM, 10 cM, 5 cM, 4 cM, 3 cM, 2 cM, 1 cM, 0.5 cM, or less than 0.5 cM of any one of SNP markers selected from the group consisting of SEQ ID Nos. 125 to 145 and 193 to 201, or any locus having a sequence selected from the group consisting of SEQ ID Nos. 1, 3 to 37, 146, 149, 152 to 156, 202, 203, and 184 to 186.

116. The method of Embodiment 114, wherein the assaying comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 3 to 37, 146, 149, 152 to 156, 202, 203, and 184 to 186, and fragments thereof.

117. The method of Embodiment 114, wherein the assaying comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 4, 14, 15, 17, 18, 19, 37, 39, 49, 50, 52, 53, 54, 202 to 205, and 72, and fragments thereof.

118. The method of Embodiment 114, wherein the assaying comprises assaying for a nucleic acid sequence located within a sequence having at least 80%, at least 85%, at least 90%, at least 95%, at least 97%, at least 98%, at least 99% identity to a sequence selected from the group consisting of SEQ ID NOs: 14, 17, 18, 19, 49, 52, 53, 202 to 205, and 54, and fragments thereof.

119. The method of Embodiment 114, wherein the method further comprises determining the nicotine level of the selected plant to confirm the low nicotine trait.

120. The method of Embodiment 114, wherein the collection of tobacco germplasm is a haploid breeding population.

121. A tobacco plant, or tobacco genotype or tobacco part thereof, comprising a chromosomal introgression obtainable from any one of LA Burley 21, LAFC53, and LN KY171, and flanked by and not comprising any two of SNP markers selected from the group consisting of SEQ ID Nos. 125 to 145 and 193 to 201, or flanked by any two loci having sequences selected from the group consisting of SEQ ID Nos. 1, 3 to 37, 146, 149, 152 to 156, 202, 203, and 184 to 186, wherein the tobacco plant is capable of producing a leaf, when cured, having a USDA grade index value of 50 or more, 55 or more, 60 or more, 65 or more, 70 or more, 75 or more, 80 or more, 85 or more, 90 or more, or 95 or more.
122. The tobacco plant, or tobacco genotype or tobacco part thereof, of Embodiment 121, wherein the tobacco plant comprises a nicotine level selected from the group consisting of less than 3%, less than 2.75%, less than 2.5%, less than 2.25%, less than 2.0%, less than 1.75%, less than 1.5%, less than 1.25%, less than 1%, less than 0.9%, less than 0.8%, less than 0.7%, less than 0.6%, less than 0.5%, less than 0.4%, less than 0.3%, less than 0.2%, less than 0.1%, and less than 0.05%.
123. The tobacco plant, or tobacco genotype or tobacco part thereof, of Embodiment 121, wherein the chromosomal introgression is flanked by and not comprising any two of SNP markers selected from the group consisting of SEQ ID Nos. 126 to 135.
124. The tobacco plant, or tobacco genotype or tobacco part thereof, of Embodiment 121, wherein the chromosomal introgression is flanked by and not comprising SNP markers SEQ ID Nos. 129 to 132.
125. A tobacco plant, or tobacco genotype or tobacco part thereof, comprising a first chromosomal introgression obtainable from any one of LA Burley 21, LAFC53, and LN KY171, and flanked by and not comprising any two of Nic1b Marker Nos. 1 to 207, wherein the tobacco plant is capable of producing a leaf, when cured, having a USDA grade index value comparable to that of a control plant when grown in similar growth conditions, wherein the control plant shares an essentially identical genetic background with the tobacco plant except the mutation.
126. The tobacco plant, or tobacco genotype or tobacco part thereof, of Embodiment 125, wherein the tobacco plant comprises nicotine at a level below 1%, below 2%, below 5%, below 8%, below 10%, below 12%, below 15%, below 20%, below 25%, below 30%, below 40%, below 50%, below 60%, below 70%, or below 80% of the nicotine level of the control plant when grown in similar growth conditions.
127. A population of the tobacco plants of any one of Embodiments 121 to 126 and 136 to 141.
128. Cured tobacco material from the tobacco plant of any one of Embodiments 121 to 126.
129. The cured tobacco material of Embodiment 128, wherein the cured tobacco material is made by a curing process selected from the group consisting of flue curing, air curing, fire curing, and sun curing.
130. A tobacco blend comprising the cured tobacco material of Embodiment 128.
131. The tobacco blend of Embodiment 130, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in the tobacco blend by weight.
132. The tobacco blend of Embodiment 130, wherein the cured tobacco material constitutes about at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of cured tobacco in the tobacco blend by volume.
133. A tobacco product comprising the cured tobacco material of Embodiment 128.
134. The tobacco product of Embodiment 133, wherein the tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.
135. The tobacco product of Embodiment 133, wherein the tobacco product is selected from the group consisting of loose leaf chewing tobacco, plug chewing tobacco, moist snuff, and nasal snuff.
136. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 3, 13, 14, 146, 153, 154, 17, 18, 19, 202, and 203, and fragments thereof.
137. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 3, 13, 14, 153, 154, 17, 18, 19, 202, and 203, and fragments thereof.
138. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 3, 13, 14, 153, 154, 17, 18, 19, and 203, and fragments thereof.
139. The tobacco plant, or tobacco genotype or tobacco part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 3, 13, 17, 18, and 19, and fragments thereof.
140. The tobacco plant, or part thereof, of Embodiment 38, wherein the mutation is located within a sequence having at least 80%, at least 85%, at least 90%, at least 95%, at least 97%, at least 98%, at least 99% identity to a sequence selected from the group consisting of SEQ ID NOs: 3, 18, and 19, and fragments thereof.
141. The tobacco plant, or tobacco genotype or tobacco part thereof, of Embodiment 38, wherein the mutation is located within a gene encoding a polypeptide having at least 80%, at least 85%, at least 90%, at least 95%, at least 97%, at least 98%, at least 99% identity to a sequence selected from the group consisting of SEQ ID NOs: 73, 83, 84, 87, 88, 89, 180, 181, 206, and 207, and fragments thereof.

The following list provides a second set of exemplary embodiments.
1. A tobacco plant, or part thereof, comprising a mutation in a Nic1b_ERF locus, wherein said tobacco plant is capable of producing a leaf, when cured, having a USDA grade index value of 50 or more.
2. The tobacco plant, or part thereof, of Embodiment 1, wherein said tobacco plant is a *Nicotiana tabacum* plant.

3. The tobacco plant, or part thereof, of Embodiment 2, wherein said tobacco plant further comprises a mutation in an ERF gene of a Nic2 locus.
4. The tobacco plant, or part thereof, of Embodiment 2, wherein said tobacco plant further comprises one or more mutations in two or more, three or more, four or more, five or more, six or more, or all seven genes selected from the group consisting of ERF189, ERF 115, ERF221, ERF 104, ERF 179, ERF 17, and ERF 168.
5. The tobacco plant, or part thereof, of Embodiment 2, wherein said tobacco plant is capable of producing a leaf, when cured, having a USDA grade index value of 70 or more.
6. The tobacco plant, or part thereof, of Embodiment 2, wherein said tobacco plant is capable of producing a leaf, when cured, having a USDA grade index value comparable to that of a control plant when grown and cured in similar conditions, wherein said control plant shares an essentially identical genetic background with said tobacco plant except said mutation.
7. The tobacco plant, or part thereof, of Embodiment 2, wherein said tobacco plant comprises nicotine at a level below 40% of the nicotine level of a control plant when grown in similar growth conditions, wherein said control plant shares an essentially identical genetic background with said tobacco plant except said mutation.
8. The tobacco plant, or part thereof, of Embodiment 2, wherein said tobacco plant comprises a nicotine level less than 2.0%.
9. A tobacco plant, or part thereof, comprising a non-transgenic mutation in a Nic1b_ERF locus, wherein said non-transgenic mutation reduces the nicotine level of said tobacco plant to below 60% of the nicotine level of a control plant when grown in similar growth conditions, wherein said tobacco plant is capable of producing a leaf, when cured, having a USDA grade index value comparable to the USDA grade index value of said control plant, and wherein said control plant shares an essentially identical genetic background with said tobacco plant except said non-transgenic mutation, wherein said tobacco plant is a *Nicotiana tabacum* plant.
10. A population of the tobacco plants of Embodiment 2.
11. Cured tobacco material from the tobacco plant of Embodiment 2.
12. The cured tobacco material of Embodiment 11, wherein said cured tobacco material is made by a curing process selected from the group consisting of flue curing, air curing, fire curing, and sun curing.
13. A tobacco blend comprising said cured tobacco material of Embodiment 11.
14. A tobacco product comprising the cured tobacco material of Embodiment 11.
15. The tobacco product of Embodiment 14, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.
16. The tobacco product of Embodiment 14, wherein said tobacco product is a smokeless tobacco product.
17. The tobacco product of Embodiment 16, wherein said smokeless tobacco product is selected from the group consisting of loose leaf chewing tobacco, plug chewing tobacco, moist snuff, and nasal snuff.
18. A tobacco plant, or part thereof, comprising a mutation in a Nic1b_ERF locus, wherein said mutation is absent from LA Burley 21, LAFC53, and LN KY171.
19. The tobacco plant, or part thereof, of Embodiment 18, wherein said tobacco plant further comprises a mutation in an ERF gene of a Nic2 locus.
20. The tobacco plant, or part thereof, of Embodiment 18, wherein said mutation is located within a sequence having at least 80%, at least 85%, at least 90%, at least 95%, at least 97%, at least 98%, at least 99% identity to a sequence selected from the group consisting of SEQ ID NOs: 3, 13, 14, 17, 18, 19, 38, 48, 49, 52, 53, 54, and 202 to 205, and fragments thereof.
21. The tobacco plant, or part thereof, of Embodiment 18, wherein said mutation is located within a gene encoding a polypeptide having at least 80% identity to a sequence selected from the group consisting of SEQ ID NOs: 73, 83, 84, 87, 88, 89, 180, 181, 206, and 207.
22. The tobacco plant, or part thereof, of Embodiment 18, wherein said tobacco plant is from a variety selected from the group consisting of flue-cured tobacco, air-cured tobacco, dark fire-cured tobacco, and Galpao tobacco, and Oriental tobacco.
23. The tobacco plant, or part thereof, of Embodiment 18, wherein said tobacco plant is from a variety selected from the group consisting of Burley tobacco, Maryland tobacco, and dark air-cured tobacco.
24. Cured tobacco material from the tobacco plant of Embodiment 18.
25. The cured tobacco material of Embodiment 24, wherein said tobacco plant comprises nicotine at a level between 0.2% and 0.6%.
26. The cured tobacco material of Embodiment 24, wherein said tobacco plant comprises nicotine at a level between 1.0% and 3.0%.
27. The cured tobacco material of Embodiment 24, wherein said cured tobacco material is made by a curing process selected from the group consisting of flue curing, air curing, fire curing, and sun curing.
28. A tobacco product comprising the cured tobacco material of Embodiment 24.
29. The tobacco product of Embodiment 24, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.
30. The tobacco product of Embodiment 24, wherein said tobacco product is a smokeless tobacco product.

The following provides a third set of exemplary embodiments:

1. A tobacco plant, or part thereof, comprising a mutation in a Nic1b_ERF locus, wherein said tobacco plant is capable of producing a leaf, when cured, having a USDA grade index value of 50 or more.
2. The tobacco plant, or part thereof, of Embodiment 1, wherein said tobacco plant is a *Nicotiana tabacum* plant.
3. The tobacco plant, or part thereof, of Embodiment 1 or 2, wherein said tobacco plant further comprises a mutation in an ERF gene of a Nic2 locus.
4. The tobacco plant, or part thereof, of any of the previous Embodiments, wherein said ERF gene of a Nic2 locus is NCG1.

5. The tobacco plant, or part thereof, of any of the previous Embodiments, wherein said ERF gene of a Nic2 locus is ERF16.
6. The tobacco plant, or part thereof, of any of the previous Embodiments, wherein said ERF gene of a Nic2 locus is NCG15.
7. The tobacco plant, or part thereof, of any of the previous Embodiments, wherein said ERF gene of a Nic2 locus is NCG17.
8. The tobacco plant, or part thereof, of any of the previous Embodiments, wherein said ERF gene of a Nic2 locus is ERF130.
9. The tobacco plant, or part thereof, of Embodiment 2, wherein said tobacco plant further comprises one or more mutations in two or more, three or more, four or more, five or more, six or more, or all seven genes selected from the group consisting of ERF189, ERF115, ERF221, ERF104, ERF 179, ERF 17, and ERF 168.
10. The tobacco plant, or part thereof, of Embodiment 2, wherein said tobacco plant is capable of producing a leaf, when cured, having a USDA grade index value of 70 or more.
11. The tobacco plant, or part thereof, of Embodiment 2, wherein said tobacco plant is capable of producing a leaf, when cured, having a USDA grade index value comparable to that of a control plant when grown and cured in similar conditions, wherein said control plant shares an essentially identical genetic background with said tobacco plant except said mutation.
12. The tobacco plant, or part thereof, of Embodiment 2, wherein said tobacco plant comprises nicotine at a level below 40% of the nicotine level of a control plant when grown in similar growth conditions, wherein said control plant shares an essentially identical genetic background with said tobacco plant except said mutation.
13. The tobacco plant, or part thereof, of Embodiment 2, wherein said tobacco plant comprises a nicotine level less than 2.0%.
14. A tobacco plant, or part thereof, comprising a non-transgenic mutation in a Nic1b_ERF locus, wherein said non-transgenic mutation reduces the nicotine level of said tobacco plant to below 60% of the nicotine level of a control plant when grown in similar growth conditions, wherein said tobacco plant is capable of producing a leaf, when cured, having a USDA grade index value comparable to the USDA grade index value of said control plant, and wherein said control plant shares an essentially identical genetic background with said tobacco plant except said non-transgenic mutation, wherein said tobacco plant is a *Nicotiana tabacum* plant.
15. A population of the tobacco plants of Embodiment 2 or 14.
16. Cured tobacco material from the tobacco plant of Embodiment 2 or 14.
17. The cured tobacco material of Embodiment 16, wherein said cured tobacco material is made by a curing process selected from the group consisting of flue curing, air curing, fire curing, and sun curing.
18. A tobacco blend comprising said cured tobacco material of Embodiment 16.
19. A tobacco product comprising the cured tobacco material of Embodiment 16.
20. The tobacco product of Embodiment 19, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.
21. The tobacco product of Embodiment 19, wherein said tobacco product is a smokeless tobacco product.
22. The tobacco product of Embodiment 21, wherein said smokeless tobacco product is selected from the group consisting of loose leaf chewing tobacco, plug chewing tobacco, moist snuff, and nasal snuff.
23. A tobacco plant, or part thereof, comprising a mutation in a Nic1b_ERF locus, wherein said mutation is absent from LA Burley 21, LAFC53, and LN KY171.
24. The tobacco plant, or part thereof, of Embodiment 23, wherein said tobacco plant further comprises a mutation in an ERF gene of a Nic2 locus.
25. The tobacco plant, or part thereof, of Embodiment 23 or 24, wherein said ERF gene of a Nic2 locus is NCG1.
26. The tobacco plant, or part thereof, of any one of Embodiments 23 to 25, wherein said ERF gene of a Nic2 locus is ERF16.
27. The tobacco plant, or part thereof, of any of Embodiments 23 to 26, wherein said ERF gene of a Nic2 locus is NCG15.
28. The tobacco plant, or part thereof, of any of Embodiments 23 to 27, wherein said ERF gene of a Nic2 locus is NCG17.
29. The tobacco plant, or part thereof, of any of Embodiments 23 to 28, wherein said ERF gene of a Nic2 locus is ERF130.
30. The tobacco plant, or part thereof, of any one of Embodiments 23 to 29, wherein said mutation is located within a sequence having at least 80%, at least 85%, at least 90%, at least 95%, at least 97%, at least 98%, at least 99% identity to a sequence selected from the group consisting of SEQ ID NOs: 3, 13, 14, 17, 18, 19, 38, 48, 49, 52, 53, 54, and 202 to 205, and fragments thereof.
31. The tobacco plant, or part thereof, of any one of Embodiments 23 to 30, wherein said mutation is located within a gene encoding a polypeptide having at least 80% identity to a sequence selected from the group consisting of SEQ ID NOs: 73, 83, 84, 87, 88, 89, 180, 181, 206, and 207.
32. The tobacco plant, or part thereof, of any one of Embodiments 23 to 31, wherein said tobacco plant is from a variety selected from the group consisting of flue-cured tobacco, air-cured tobacco, dark fire-cured tobacco, and Galpao tobacco, and Oriental tobacco.
33. The tobacco plant, or part thereof, of any one of Embodiments 23 to 32, wherein said tobacco plant is from a variety selected from the group consisting of Burley tobacco, Maryland tobacco, and dark air-cured tobacco.
34. Cured tobacco material from the tobacco plant of any one of Embodiments 23 to 33.
35. The cured tobacco material of Embodiment 34, wherein said tobacco plant comprises nicotine at a level between 0.2% and 0.6%.
36. The cured tobacco material of Embodiment 34, wherein said tobacco plant comprises nicotine at a level between 1.0% and 3.0%.
37. The cured tobacco material of Embodiment 34, wherein said cured tobacco material is made by a curing process selected from the group consisting of flue curing, air curing, fire curing, and sun curing.

38. A tobacco product comprising the cured tobacco material of Embodiment 34.

39. The tobacco product of Embodiment 34, wherein said tobacco product is selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco.

40. The tobacco product of Embodiment 34, wherein said tobacco product is a smokeless tobacco product.

41. A modified tobacco plant, or part thereof, comprising a non-natural mutation in a polynucleotide having at least 90% identity to a polynucleotide sequence selected from the group consisting of SEQ ID NOs: 3, 13, 14, 17-19, 38, 48, 49, 52-54, 153, 154, 158, 159, 202, 203, 204, and 205.

42. The modified tobacco plant, or part thereof, of embodiment 41, wherein said polynucleotide has at least 95% identity to a polynucleotide sequence selected from the group consisting of SEQ ID NOs: 3, 13, 14, 17-19, 38, 48, 49, 52-54, 153, 154, 158, 159, 202, 203, 204, and 205.

43. The modified tobacco plant, or part thereof, of embodiment 41 or 42, wherein said polynucleotide has 100% identity to a polynucleotide sequence selected from the group consisting of SEQ ID NOs: 3, 13, 14, 17-19, 38, 48, 49, 52-54, 153, 154, 158, 159, 202, 203, 204, and 205.

44. The modified tobacco plant, or part thereof, of any one of embodiments 41 to 43, wherein said at least one modified tobacco plant comprises a reduced amount of at least one alkaloid as compared to a control tobacco plant lacking said mutation.

45. The modified tobacco plant, or part thereof, of any one of embodiments 41 to 44, wherein said at least one alkaloid is selected from the group consisting of anabasine, anatabine, nicotine, and nornicotine.

46. A modified tobacco plant, or part thereof, comprising a non-natural mutation in a polynucleotide having a nucleic acid sequence encoding a polypeptide having at least 90% identity or similarity to an amino acid sequence selected from the group consisting of SEQ ID NOs: 73, 83, 84, 87-89, 180, 181, 206, and 207.

47. The modified tobacco plant, or part thereof, of embodiment 46, wherein said polynucleotide has a nucleic acid sequence encoding a polypeptide having at least 95% identity or similarity to an amino acid sequence selected from the group consisting of SEQ ID NOs: 73, 83, 84, 87-89, 180, 181, 206, and 207.

48. The modified tobacco plant, or part thereof, of embodiment 46 or 47, wherein said polynucleotide has a nucleic acid sequence encoding a polypeptide having 100% identity or similarity to an amino acid sequence selected from the group consisting of SEQ ID NOs: 73, 83, 84, 87-89, 180, 181, 206, and 207.

49. The modified tobacco plant, or part thereof, of any one of embodiments 46 to 48, wherein said modified tobacco plant comprises a reduced level of at least one alkaloid as compared to a control tobacco plant lacking said mutation relative to a control plant not having said genetic modification or mutation or recombinant nucleic acid construct.

50. The modified tobacco plant, or part thereof, of any one of embodiments 46 to 49, wherein said higher USDA grade index value is at least 5% higher than that of said comparable leaf of said control plant.

51. The tobacco plant, or part thereof, of any one of the preceding embodiment, wherein said at least one alkaloid is selected from the group consisting of anabasine, anatabine, nicotine, and nornicotine.

52. Cured tobacco material from the tobacco plant of any one of the preceding embodiments.

53. A tobacco product comprising the cured tobacco material of embodiment 52.

54. The tobacco product of embodiment 53, wherein said tobacco product is a selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, and cut tobacco, reconstituted tobacco, loose leaf chewing tobacco, plug chewing tobacco, moist snuff, snus, and nasal snuff, or a smokeless tobacco product.

55. A method of producing a modified tobacco plant comprising:
    (a) inducing a non-natural mutation in at least one tobacco cell in an endogenous nucleic acid sequence encoding a polypeptide comprising an amino acid sequence at least 90% identical or similar to an amino acid sequence selected from the group consisting of SEQ ID NOs: 73, 83, 84, 87-89, 180, 181, 206, and 207;
    (b) selecting at least one tobacco cell comprising said non-natural mutation from step (a); and
    (c) regenerating at least one modified tobacco plant from said at least one tobacco cell selected in step (b);
    wherein said at least one modified tobacco plant comprises a reduced amount of at least one alkaloid as compared to a control tobacco plant lacking said mutation.

56. The method of embodiment 55, wherein said at least one modified tobacco plant comprises a reduced amount of at least one alkaloid as compared to a control tobacco plant lacking said mutation.

57. The method of any one of embodiment 55 or 56, wherein said endogenous nucleic acid sequence is at least 90% identical to a sequence selected from the group consisting of SEQ ID NOs: 3, 13, 14, 17-19, 38, 48, 49, 52-54, 153, 154, 158, 159, 202, 203, 204, and 205.

58. The method of any one of embodiment 55 to 57, wherein said at least one alkaloid is selected from the group consisting of anabasine, anatabine, nicotine, and nornicotine.

59. The method of any one of embodiment 55 to 58, wherein said method further comprises:
    (d) growing said modified tobacco plant regenerated in step (c).

60. The method of any one of embodiment 55 to 59, wherein said method further comprises:
  (e) crossing said modified tobacco plant grown in step (d) with a second tobacco plant; and
  (f) obtaining at least one seed from said crossing in step (e).
61. The modified tobacco plant, or part thereof, of any one of embodiments 1 to 60, wherein said at least one modified tobacco plant comprises a reduced amount of at least one alkaloid as compared to a control tobacco plant lacking said mutation.
62. The modified tobacco plant, or part thereof, of embodiment 61, wherein said at least one alkaloid is anabasine.
63. The modified tobacco plant, or part thereof, of embodiment 61 or 62, wherein said at least one alkaloid is anatabine.
64. The modified tobacco plant, or part thereof, of embodiment 61, 62, or 63, wherein said at least one alkaloid is nicotine.
65. The modified tobacco plant, or part thereof, of embodiment 61, 62, 63, or 64, wherein said at least one alkaloid is nornicotine.

Having now generally described the disclosure, the same will be more readily understood through reference to the following examples that are provided by way of illustration, and are not intended to be limiting of the present disclosure, unless specified.

As shown in FIG. 1, 22 F3 plants are screened on the Axiome® array developed based on approximately 170,000 polymorphic SNPs observed in several resequenced lines belonging to different tobacco types (Flue, Dark, Oriental and Burley) with respect to a TN90 tobacco genome sequence database. Plant 22-6 shows about 40.6% recipient parent genome recovery and is chosen for further advancement. The F3 generation also exhibits low alkaloid levels, consistent with that observed in LABU21. The F4 generation is screened using Nic1 and Nic2 KASP assays (see SEQ ID Nos: 135 and 137 of US 2016/0374387, corresponding to Nic1$^{KASP}$ and Nic2$^{KASP}$ markers, respectively). All of the 192 screened F4 plants harbor the 2 deletions and 3 plants (ds1059-138, ds1059-143 and ds1059-192) are selected for further advancement. Selfed seed from these 3 plants are further bulked and the F5 generation is evaluated. All 220 F5 plants are homozygous for both nic1$^{KASP}$ and nic2$^{KASP}$ deletion alleles. Alkaloid levels in F5 plants are determined by measuring a pooled leaf sample collected from the $3^{rd}$, $4^{th}$, and $5^{th}$ leaves from the top of the plant, and 2 weeks after topping. Not all plants exhibit the low alkaloid trait, and striking differences in leaf phenotype are also observed, with several lines exhibiting good leaf quality consistent with those observed in commercial Burley tobacco (Table 1).

TABLE 1

The alkaloid levels and leaf phenotype selected F5 plants and control plants. All F5 plants are homozygous for both nic1$^{KASP}$ and nic2$^{KASP}$ deletion alleles.

| Plant ID | Leaf Phenotype Good | Leaf Phenotype Poor | Nicotine | Nornicotine | Anabasine | Anatabine | Total Alks |
|---|---|---|---|---|---|---|---|
| G61-31 |  | X | 0.417301 | 0.0016 | 0.0006 | 0.013401 | 0.432902 |
| G61-36 | X |  | 3.901918 | 0.108273 | 0.020413 | 0.150738 | 4.181342 |
| G61-37 |  | X | 0.379678 | 0.0016 | 0.0006 | 0.012404 | 0.394282 |
| G61-39 | X |  | 4.157288 | 0.139291 | 0.018432 | 0.143015 | 4.458026 |
| TN90 | X |  | 3.844 | 0.072 | 0.016 | 0.108 | 4.040 |
| TN90 | X |  | 3.929 | 0.062 | 0.015 | 0.096 | 4.102 |
| TN90 | X |  | 5.063 | 0.098 | 0.019 | 0.156 | 5.336 |
| TN90 | X |  | 3.959 | 0.072 | 0.015 | 0.106 | 4.153 |
| TN90 | X |  | 3.976 | 0.080 | 0.014 | 0.091 | 4.161 |
| LA BU21 |  | X | 0.171 | 0.002 | 0.001 | 0.006 | 0.179 |
| LA BU21 |  | X | 0.222 | 0.002 | 0.001 | 0.007 | 0.231 |
| LA BU21 |  | X | 0.188 | 0.002 | 0.001 | 0.008 | 0.198 |
| LA BU21 |  | X | 0.249 | 0.002 | 0.001 | 0.007 | 0.258 |

EXAMPLES

Example 1: Development of TN90 Lines with Low Alkaloid Trait and Plants with High Intermediate Alkaloid Trait Harboring nic1 and nic2 Deletion Marker Alleles A breeding population is developed from a cross between LA BU21 (Low Alkaloid Burley 21 harboring nic1 and nic2 mutations, donor parent) and the elite cultivar, TN90 (recipient parent). The goal is to obtain a low alkaloid plant that also has improved leaf quality when compared to the parent LA BU21 line, which has inferior leaf characteristics. An F2 plant with desired characteristics (low alkaloid levels, improved leaf quality) is further selfed to obtain the F3 generation, and subsequently the F5 generation. FIG. 1 shows the breeding process followed for development of selfed TN90 lines harboring the low alkaloid trait.

Example 2: Identification of Additional Genomic Regions Associated with Low Alkaloid Trait The F5 plants from Example 1 having high alkaloid levels, despite carrying homozygous nic1$^{KASP}$ and nic2$^{KASP}$ deletion alleles, suggest that nic1$^{KASP}$ and nic2$^{KASP}$ deletion markers do not exhibit 100% linkage with the low alkaloid trait. To investigate this observation, further resequencing is carried out for LAFC53 (Flue cured version carrying nic1 and nic2 introgressions), LN KY171 (Dark version carrying nic1 and nic2 introgressions), and KY171 (Dark variety without nic1 and nic2 introgressions), as well as two (2) F5 lines homozygous for nic1$^{KASP}$ and nic2$^{KASP}$ deletion alleles but exhibiting high alkaloid levels (G61-36 and G61-39), and two (2) F5 lines homozygous for nic1$^{KASP}$ and nic2$^{KASP}$ deletion alleles and exhibiting low alkaloid levels (G61-31 and G61-37). These 7 lines, in addition to the previously re-sequenced lines; BU21, HI BU21, LI BU21 and LA BU21, were mapped using a TN90 genome database.

Coverage analysis of the mapped reads leads to the identification of a 2000-3000 bp region (SEQ ID No. 1, hereinafter "LA_associated_region"), approximately 2 million bps downstream of the nic1 deletion segment NT1.0-Scaffold0002504 previously described in US 2016/0374387. The LA_associated_region is deleted in LA BU21, LI BU21, LN KY171, LAFC53 as well as the low alkaloid, homozygous nic1$^{KASP}$ nic2$^{KASP}$ F5 lines, G61-31 and G61-37. In contrast, the LA_associated_region is not deleted (i.e., present) in wild types (e.g., TN90, BU21, K326, NLM, Katerini) as well as the high alkaloid, homozygous nic1$^{KASP}$ nic2$^{KASP}$ F5 lines G61-36 and G61-39. The LA_associated_region has no known genes. A serine threonine protein phosphatase gene is found 4877 bps upstream of this region and an ERF (homolog of ERF189) is found 59,945 bps downstream of this region.

Further, SNP genotyping of the F3 plant (22-6) reveals that a genomic region, starting from 1,256,063 bps and ending at 2,766,118 bps (~1,510,055 bps long, SEQ ID No. 2, herein referred to as "Nic1b Region") downstream of the nic1 deletion segment NT1.0-Scaffold0002504, is heterozygous in the F3 plant (including the LA_associated_region). This suggests that a low-alkaloid allele of the Nic1b Region likely originates from cigar (LA BU21 was developed from a cross between BU21 and a low-alkaloid Cuban cigar variety) and segregates in the resulting F4 and later generations.

Also, 47 F4 plants and 48 F5 plants are genotyped using the ~170,000 SNP containing Axiome array to further validate the correlation between alkaloid levels and the LA_associated_region as well as the Nic1b Region. Analysis of the 3 progenitor F4 generation plants (ds1059-138, ds1059-143 and ds1059-192) shows the LA_associated_region and the Nic1b Region as being heterozygous or as carrying the LA BU21 like (B) allele. Similarly, the 48 F5 generation plants show segregation in the LA_associated_region and the Nic1b Region, with individuals having the B allele (LA BU21 like) exhibiting low alkaloid levels (0.137% to 0.417%, dry weight) and individuals with the heterozygous state (H) or the wild type allele (A) exhibiting moderate to high alkaloid levels (1.793% to 5.419%, dry weight).

Example 3: Identification of Genes and Markers in the Nic1b Region

Sequence analysis of the Nic1b Region reveals at least 35 annotated genes from the region (Table 2). These genes are referred to as Nic1b Cigar Genes ("NCG") 1 to 35. Among these NCG genes, six ethylene-responsive transcription factor-like (ERF-like) genes are identified. RNA-seq data show that 10 NCGs exhibit reduced expression in LA BU21 plants related to BU21, from root samples collected 72 hours post topping. Seven NCGs, including four of the six ERF-like genes, are down-regulated, whereas three other NCGs are up-regulated in LA BU21 compared to BU21.

Each of the 35 NCGs in LA BU21, TN90, and selected F5 plants is re-sequenced to identify specific natural mutations that are present in LA BU21 and may cause a loss of gene function. Additional re-sequencing analysis is also performed to identify mutations in non-coding sequences (e.g., promoters) that may cause dysregulation of gene expression.

In addition, polymorphisms within and flanking the Nic1b Region are also identified to develop SNP markers. Twenty one SNP markers are developed for genotyping the Nic1b Region (Table 3). Further SNP markers are provided in Table 4. These markers are within the Nic1b Region and immediately next to various ERF genes. They have alleles that can be used to distinguish normal alkaloid lines from low alkaloid lines.

TABLE 2

Figure 2:
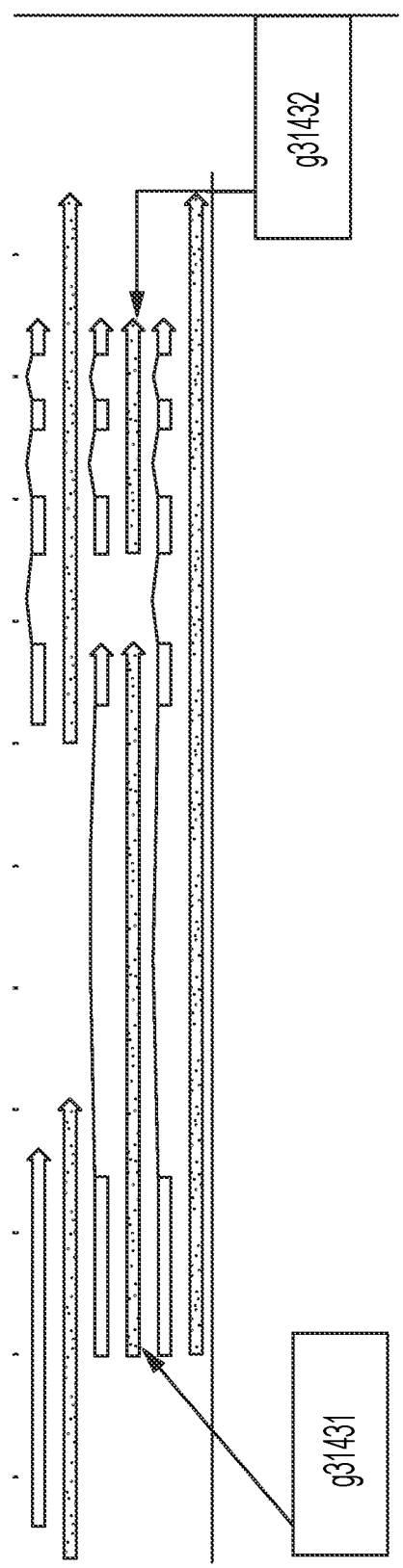
FIG. 2: Potential alternative splicing variants around gene locus g31431 and gene locus g31432. Darker boxes denote detected transcripts, whereas lighter boxes represent in-silico generated CDS models.

Annotated genes the Nic1b Region. $^a$g31431 and g31432 appears to represent alternative splicing (see FIG. 2). $^b$g31446 may represent another alternative splicing.

| Gene Name | Gene No. | Location start | Location end | Functional Description | RNA-seq (RPKM) 72 hr post-topping LA BU21 | RNA-seq (RPKM) 72 hr post-topping BU21 | Relative expression in LA (p <0.1) | SEQ ID No. gDNA | SEQ ID No. cDNA | SEQ ID No. Protein | Exemplary mature artificial miRNA SEQ ID No.(sense/antisense) | Exemplary guide RNA SEQ ID No. |
|---|---|---|---|---|---|---|---|---|---|---|---|---|
| NCG1 | g31420 | 80937073 | 80937738 | ethylene-responsive transcription factor 13-like [Nicotiana tabacum] | 0.053 | 0.06 | | 3 | 38 | 73 | 108/114 | 120 |
| NCG2 | g31421 | 80969813 | 80970221 | Heterodisulfide reductase subunit A | 0.66 | 0 | Down | | 4 | 39 | 74 | |
| NCG3 | g31422 | 81191288 | 81191800 | zinc finger BED domain-containing protein RICESLEEPER 3-like [Nicotiana tomentosiformis] | 0 | 0 | | 5 | 40 | 75 | | |
| NCG4 | g31423 | 81373969 | 81374515 | SC35-like splicing factor 33 | 0 | 0 | | 6 | 41 | 76 | | |
| NCG5 | g31424 | 81384086 | 81384310 | Plant Tudor-like RNA binding protein | 0 | 0 | | 7 | 42 | 77 | | |

TABLE 2-continued

Annotated genes the Nic1b Region. [a]g31431 and g31432 appears to represent alternative splicing (see FIG. 2). [b]g31446 may represent another alternative splicing.

| Gene Name | Location Gene No. | start | end | Functional Description | RNA-seq (RPKM) 72 hr post-topping LA BU21 | | Relative expression in LA BU21 (p <0.1) | SEQ ID No. gDNA | cDNA | Protein | Exemplary mature artificial miRNA SEQ ID No.(sense/antisense) | Exemplary guide RNA SEQ ID No. |
|---|---|---|---|---|---|---|---|---|---|---|---|---|
| | | | | | BU21 | BU21 | | | | | | |
| NC G6 | g31425 | 81384503 | 81385746 | Aminotransferase-like, plant mobile domain family protein | 0 | 0 | | 8 | 43 | 78 | | |
| NC G7 | g31426 | 81391218 | 81391750 | Xanthine/uracil permease family protein | 0 | 0 | | 9 | 44 | 79 | | |
| NC G8 | g31427 | 81391973 | 81392478 | Cobalamin biosynthesis protein CbiX | 0 | 0 | | 10 | 45 | 80 | | |
| NC G9 | g31428 | 81392698 | 81392986 | Aminotransferase-like, plant mobile domain family protein | 0 | 0 | | 11 | 46 | 81 | | |
| NC G10 | g31429 | 81393124 | 81393975 | Serine/threonine-protein phosphatase 7 like | 0 | 0 | | 12 | 47 | 82 | | |
| NC G11 | g31430 | 81460946 | 81461665 | ethylene-responsive transcription factor 13-like [Nicotiana tabacum] | 0.76 | 0.63 | | 13 | 48 | 83 | 109/115 | 121 |
| NC G12 | g31431 | 81636198 | 81637364 | ethylene-responsive transcription factor 13-like [Nicotiana tomentosiformis] | 1.69 | 0.75 | Down | 14 | 49 | 84 | 110/116 | |
| | g31432[a] | | | | | | | 146 | 147 | 148 | | |
| NC G13 | g31433 | 81731664 | 81731954 | MerR family transcriptional regulator | 2.11 | 0 | Down | 15 | 50 | 85 | | |
| NC G14 | g31434 | 81745530 | 81746785 | Clathrin heavy chain 1 | 0 | 0 | | 16 | 51 | 86 | | |
| NC G15 | g31435 | 81752543 | 81753226 | ethylene-responsive transcription factor 1-like [Nicotiana sylvestris] | 5.72 | 0.46 | Down | 17 | 52 | 87 | 111/117 | 122 |
| NC G16 | g31436 | 81848443 | 81849006 | ethylene-responsive transcription factor 13-like [Nicotiana sylvestris] | 4.38 | 0.33 | Down | 18 | 53 | 88 | 112/118 | 123 |
| NC G17 | g31437 | 81862134 | 81862760 | ethylene-responsive transcription factor 13-like [Nicotiana tabacum] | 45.75 | 6.23 | Down | 19 | 54 | 89 | 113/119 | 124 |
| NC G18 | g31438 | 81868638 | 81876132 | COP9 signalosome complex subunit 7 isoform X1 [Nicotiana sylvestris] | 6.55 | 6.41 | | 20 | 55 | 90 | | |
| NC G19 | g31439 | 81908399 | 81908794 | HpcH/HpaI aldolase family protein | 0 | 0 | | 21 | 56 | 91 | | |

TABLE 2-continued

Annotated genes the Nic1b Region. [a]g31431 and g31432 appears to represent alternative splicing (see FIG. 2). [b]g31446 may represent another alternative splicing.

| Gene Name | Gene No. | Location start | Location end | Functional Description | RNA-seq (RPKM) 72 hr post-topping LA BU21 | | Relative expression in LA BU21 (p <0.1) | SEQ ID No. gDNA | SEQ ID No. cDNA | SEQ ID No. Protein | Exemplary mature artificial miRNA SEQ ID No.(sense/ antisense) | Exemplary guide RNA SEQ ID No. |
|---|---|---|---|---|---|---|---|---|---|---|---|---|
| NC G20 | g31440 | 8195 9838 | 8197 1528 | leucine carboxyl methyltransferase 1 isoform X4 [Nicotiana sylvestris] | 7.9 | 6.97 | | 22 | 57 | 92 | | |
| NC G21 | g31441 | 8197 9991 | 8198 4723 | uncharacterized protein L0C104242706 [Nicotiana sylvestris] | 4.06 | 18.37 | Up | 23 | 58 | 93 | | |
| NC G22 | g31442 | 8202 5072 | 8202 7902 | serine/threonine-protein kinase D6PKL1 [Nicotiana sylvestris] | 3.27 | 6.23 | Up | 24 | 59 | 94 | | |
| NC G23 | g31443 | 8205 8104 | 8209 1727 | GRAM domain-containing protein 1A [Nicotiana sylvestris] | 11.73 | 12.31 | | 25 | 60 | 95 | | |
| NC G24 | g31444 | 8212 9721 | 8213 4890 | E3 ubiquitin-protein ligase RNF25 isoform X1 [Nicotiana sylvestris] | 19.31 | 23.07 | Up | 26 | 61 | 96 | | |
| NC G25 | g31445 | 8216 6384 | 8216 7631 | phospholipase A(1) DAD1, chloroplastic-like [Nicotiana sylvestris] | 0 | 0 | | 27 | 62 | 97 | | |
| | g31446[b] | | | uncharacterized protein L0C109224119 [Nicotiana attenuata] | | | | 149 | 150 | 151 | | |
| NC G26 | g31447 | 8219 2312 | 8222 3682 | glycine--tRNA ligase 2, chloroplastic/mitochondrial isoform X2 [Nicotiana sylvestris] | 3.00 | 6 | Up | 28 | 63 | 98 | | |
| NC G27 | g31448 | 8225 5656 | 8225 5832 | Phage tail protein | 0 | 0 | | 29 | 64 | 99 | | |
| NC G28 | g31449 | 8230 1836 | 8230 2177 | Endonuclease-reverse transcriptase | 0 | 0 | | 30 | 65 | 100 | | |
| NC G29 | g31450 | 8230 3411 | 8230 7034 | plasminogen activator inhibitor 1 RNA-binding protein-like [Nicotiana sylvestris] | 35.03 | 40.26 | Up | 31 | 66 | 101 | | |
| NC G30 | g31451 | 8230 8544 | 8231 2164 | ras-related protein RABD2a-like [Nicotiana sylvestris] | 29.92 | 24.36 | Down | 32 | 67 | 102 | | |
| NC G31 | g31452 | 8253 0120 | 8253 0440 | Thermosome subunit | 0 | 0 | | 33 | 68 | 103 | | |
| NC G32 | g31453 | 8261 8287 | 8261 8637 | Electroneutral sodium bicarbonate exchanger 1 | 0 | 0 | | 34 | 69 | 104 | | |

TABLE 2-continued

Annotated genes the Nic1b Region. ᵃg31431 and g31432 appears to represent alternative splicing (see FIG. 2). ᵇg31446 may represent another alternative splicing.

| Gene Name | Gene No. | Location start | end | Functional Description | RNA-seq (RPKM) 72 hr post-topping LA BU21 | | Relative expression in LA BU21 (p <0.1) | SEQ ID No. gDNA | cDNA | Protein | Exemplary mature artificial miRNA SEQ ID No.(sense/antisense) | Exemplary guide RNA SEQ ID No. |
|---|---|---|---|---|---|---|---|---|---|---|---|---|
| NC G33 | g31454 | 82642024 | 82643581 | putative inactive flavonol synthase 2 [*Nicotiana sylvestris*] | 4.26 | 3.48 | | 35 | 70 | 105 | | |
| NC G34 | g31455 | 82659401 | 82659712 | Gag-Pol polyprotein | 0 | 0 | | 36 | 71 | 106 | | |
| NC G35 | g31456 | 82726641 | 82728203 | protein DMR6-LIKE OXYGENASE 2-like [*Nicotiana tabacum*] | 5.44 | 0.9 | Down | 37 | 72 | 107 | | |

TABLE 3

Markers in and around the Nic1b Region.

| Marker Name | Location* | SEQ ID No. | SNP Marker Sequence | Low-alkaloid Allele | High-alkaloid Allele |
|---|---|---|---|---|---|
| Nb1_SNP9 | 80,053,989 | 125 | CCAGATGCCCCTAAAAAGTGGTTTGACTGTTTCTTNAAGGAAAAACACTCCACAGTTGCAAAGGTACATTA | G | C |
| Nb1_SNP1 | 81,179,741 | 126 | ACCGCACTTGCAGTTTGGTTTCCGTAGGTGCGGCGNAGCAGAAGCGTCTAACAGGCCACAAAAAAGAAATT | C | T |
| Nb1_SNP2 | 81,333,419 | 127 | TCGAGAGGCATAGACATGTTTACTTCATTTCCCCTNGAGGACTGGTTCTGCATAATAATCGGGTTAAGTGT | G | A |
| Nb1_SNP10 | 81,386,529 | 128 | AATTTAAGAAGGAAATAATTGGTAGTAACAGAGGGNATCCAGGTCTCAAAGAGAAATATCACATATTAAAA | G | A |
| Nb1_SNP11 | 81,540,487 | 129 | ACACTCGAAATAACATACGGTTTGTGCGGGATTTTNGGGGAGGAGTTGCAGGGGTTCAAACTGGTTTTCTT | T | C |
| Nb1_SNP12 | 81,701,916 | 130 | CATCCTCCCAGGCCCTTTCAGTCAGCTCTTCAGGTNTCTCACGATGCTTCATGTAGCTGTGGTCCGTAGAT | T | C |
| Nb1_SNP13 | 81,955,719 | 131 | TCTAACTCCAAAAGGATAACTTTTCTCCCAAGTCANATTTTATCCAAGTGTGTTAAGGTTTTTACTAGGTA | T | C |
| Nb1_SNP3 | 81,961,686 | 132 | TACATTCCTTTGACATCCAACTTGGTGTTTAGTAGNGAAATTTTGACTTATCAAAGAAACATCGTGTAGTC | T | A |
| Nb1_SNP14 | 82,004,963 | 133 | AAGTATTTGTAAGATATTATGAGGTGTCAGATAGGNATATGATGTAATTGGGTGTCGCCCTTGAAGACCGC | G | C |
| Nb1_SNP15 | 82,030,356 | 134 | ATTGAAACGTACCGTGCCCTATCGGATTCAAATGGNGACTCTTGGGTTTCGTGCTCGGGGAATTTATGTCT | C | T |
| Nb1_SNP4 | 82,086,894 | 135 | ATTCATCTTCAAGCATCATATAAAAATTGGCAATTNTCAATTCTGTAAAAATGGTTGTTCAGTTAGACATA | C | G |
| Nb1_SNP16 | 82,088,111 | 136 | GATAGTAAAAGTGATATGCCTCTAAAGCACATGTTNGTACAAGCCGACCAGAAGAAGTAATCGTCAATTAC | T | A |
| Nb1_SNP17 | 82,194,591 | 137 | CATGTTGAAATTTCATTAGCACATCTAAAATATAANAGTAGTTTGATTATTTTGTAAATGCACTAATGAGT | A | T |
| Nb1_SNP18 | 82,243,421 | 138 | ACCAGGCTTAACAGAAAGCTTCACTCGATCTATTCNGTTTTGGTTAGAATTCGTTAGGTTTCGTGAAGGAA | C | T |

TABLE 3-continued

Markers in and around the Nic1b Region.

| Marker Name | Location* | SEQ ID No. | SNP Marker Sequence | Low-alkaloid Allele | High-alkaloid Allele |
|---|---|---|---|---|---|
| Nb1_SNP19 | 82,300,329 | 139 | AACATGCTAATTCTATTAACAGTAACCCCATACCCNCATGGATT ACTGACGTGCTAATTCTATTAACAATA | A | G |
| Nb1_SNP20 | 82,418,346 | 140 | TATACCACACTGCTAGACAAGGTAACTCCGAAAGANGGGGAGC TTACTGATAAAGCTAAACTCGGGCAACA | T | C |
| Nb1_SNP5 | 82,460,663 | 141 | CTGAACTGGCACGAATTATCGAGGATTGAACTAACNTGAATATC TGCTCACTGAACTCACATCAATACCTG | A | G |
| Nb1_SNP21 | 82,492,227 | 142 | GCAATCGAGTTGCAAGCTTTAAATGGTGAAAGGAANTTTTTGGT GAGTGGTCATCGAGTCAAGCACTATTA | T | G |
| Nb1_SNP6 | 82,554,565 | 143 | CCCTAGCTAGGGTACTTCTGAACCCTCCCGAAAATNGGGGCCTC TTATCCTACTGAATCTACTCTCTACCC | T | C |
| Nb1_SNP7 | 82,689,866 | 144 | CTCAAAAGCTCGACCAAATCTACCCGACTTCGCATNTGTGGCAT GCAAGGTTAAGCCCCAAGCCTTCAAGT | C | T |
| Nb1_SNP8 | 82,762,168 | 145 | CATGAACAACTTCATGACTCAAACCTAGATCAACANCGTGCTTC AGCCTCTTGCACCATCTATGAATGTCA | G | A |

*genomic location is based on a TN90 genome which is also used for denoting NCG gene locations.

TABLE 4

SNP markers in close proximity to multiple ERF genes from the Nic1b Region.

| Marker Name | Location* | SEQ ID No. | SNP Marker Sequence | Low-alkaloid Allele | High-alkaloid Allele |
|---|---|---|---|---|---|
| Nb1_SNP22 | 807 189 70 | 193 | TGAAAAGGGAGATACTGCTCCTACTTCATTACAACCGTGCCATAACCAAGG AAGTAAGTCGCGTGGTGTANACGATCCACCAAACTGGAGGAGATACAGAG GCGTGAGGCGGCGCCCGTGGGGAAAGTTCGCGGCAGAGAT | T | C |
| Nb1_SNP23 | 814 590 75 | 194 | TTTATTAACTTGAGTTCAGCTTAAATTAACTCATAAGCTAATATGTTTGTAG TCCAACCTATTAATCTCTNGATAGATTGGGCAAGTTGAATGGATTTAAGCTC AAATTACCACCCCGGTATATAGCATAAAAAAATGAGT | A | G |
| Nb1_SNP24 | 814 682 45 | 195 | GACTTACATCCTCCCCCGCTTAGGATCATTCGTCATCGAATGAGGGTAAAAT CTACCATTATCATCCACTNTGGCCCAACTATTACTTCATACACCAGTGGTAC CAAATTTTAACTAACTCCCTAAATTTTCAAAATTTTT | A | G |
| Nb1_SNP25 | 816 390 43 | 196 | AATAATATGTCTGACCAGCACGATAAGCAGCCCTACCAAAATCTAATGAAC CCATAGATTATACATTGGANACCAGGCAATATTCTCATGAAAGAAAAGAA GAAGAAAAAAAAGCTGCTGGACGACGACTTGTAAATGT | C | T |
| Nb1_SNP26 | 817 324 73 | 197 | TGTTATTTCCCATTTGTAATAAACTATGTAATGACTCTTAGTATGTGTTTTTA ATAAATGTCTTTATTACNAAAAAAAAAAAAAGGATGCAGCTAAAGAAACC TGAGAGTAATTGAGGGGTAAATTTCACAAATGGTCATA | C<br>A<br>A<br>A | C,<br>A,<br>C<br>A |
| Nb1_SNP27 | 817 448 87 | 198 | CTCTGAATCACATGCTACCTTCTCTAAGAGGGGATTTTGTTTATCATTTTT GTGCCGATAAAATTGGCCNAAAAAAGGAAGGGAAATAAGAATCCCAAGA TAAAAAAAATTTACAAAGTAAAGAAGGGAGAGAAGGAAA | T | T<br>A |
| Nb1_SNP28 | 817 641 26 | 199 | ATTTCAGATGGGATACTTACTGGTTACATATTGTTTATGTACTCATACTACA CTTCTGTACTTAATTATANAGTGAGGCAGGTACATCTTGCTACCAGTCTGGT GCGCGCCCCTAACTTATAGTTCGAGACTTCCACGGTG | T | C |
| Nb1_SNP29 | 818 676 16 | 200 | TTTTCAGGCTTTCTTTGATGTTGTGTACTGCAAGTTGTATAATAACACGCCA AACAAGTAGGGTTTGGANAAAAAAAAATAAGAATTCTAAAAAAAGTAG CTTTTGAAGTTAAGTTGAAAAATTATATTTGGAATTTGA | C | C<br>A |
| Nb1_SNP30 | 822 817 93 | 201 | TGAAGAGGGTTATGGGGTTTGTTGGTTTTTGGGTTATGTTGCTGAAGCAGAA AAATGAAAAAAACGGGGNGGGGGGGGGAGGTTCGAAGAAGACGACCT CGGGGGGGTTTCAAAAGCTGTGCAGCCTTTTCTGTCAGCT | A | A<br>G |

*genomic location is based on a reference TN90 genome.

Example 4: Transgenic Approaches to Develop Tobacco Varieties with Desirable Nicotine Levels Both overexpression and suppression approaches are taken to investigate the function of NCGs and develop tobacco varieties with desirable nicotine levels. Two sets of transgenic plants are generated, one being an overexpression approach using the full length coding sequence and the other being a suppression approach using an artificial microRNA or RNAi sequence. All 35 NCGs (NCG1 to NCG35) are tested, with a focus on all NCGs exhibiting differential expression between TN90 and LA BU21, especially the NCGs encoding ERF-like proteins. Some of the overexpression studies are conducted in a nic1 nic2 double mutant background (e.g., LA BU21) to test the ability of the identified genes (individually or in combination) to complement or rescue the low-alkaloid mutant phenotype from a mutant nic1 allele.

For the expression of a full length coding sequence or an artificial microRNA sequence, an expression vector is constructed to have a CsVMV promoter and a NOS terminator, as well as a cassette having a Kanamycin selection marker (NPT II) under direction of an actin2 promoter and having a NOS terminator. Exemplary artificial microRNA sequences can be found in Table 2. One of ordinary skill in the art understands that other target sequences can be used in constructing suppression constructs or other transgenic approach for gene silencing (e.g., RNAi, trans-acting siRNA, etc.).

Nucleic acid constructs carrying transgenes of interest are introduced into tobacco leaf disc using DNA bombardment or a biolistic approach. See, for example, Sanford et al., 1993, Methods Enzymol., 217:483-510; and Okuzaki and Tabei, 2012, Plant Biotechnology, 29:307-310. Briefly, the plasmid DNA containing the transformation cassette is coated on 1 μm gold particles (DNA/gold) as follows. The 1 μm gold particles are baked at 180° C. for 12 hours, and a stock solution (40 mg/ml) is prepared. To make a mixture for 10 shots, 100 μl of the stock solution is mixed with 40 μl of expression vector DNA (1 μg/μl), 100 μl of 2.5 M CaCl$_2$, and 40 μl of 0.1 M spermidine in a 1.5-ml tube. The mixture is centrifuged for 30 s at 13,000×g, and the pellet is washed with 500 μl 100% ethanol. The DNA/gold mixture is suspended in 100 μl of water, and 10 μl is applied onto a macrocarrier, dried, and then bombarded. Two shots are bombarded per plate using a 1,100 psi rupture disc under partial vacuum (711 mmHg) in a PDS-1000/He system (Bio-Rad Laboratories, Hercules, CA, USA). Narrow Leaf Madole (NLM) and Tennessee 90 (TN90) tobacco leaf discs are used for transformation with the RNAi constructs, and with the full length gene constructs. Whole tobacco leaf (about 45×30 mm in length) is placed on the MS medium overnight, and the leaf disc is bombarded with the construct on the second day. Leaves are then cut into small pieces (about 5×5 mm) and replaced on the TOM medium (MS medium with 20 g sucrose/L; 1 mg/L IAA and 2.5 mg/L BAP) to grow at 27° C. for 3-5 days, then transferred to TOM medium to grow, which contains 300 mg/l Kanamycin (TOM-Kan). Tissues are transferred to new TOM-Kan plates every 2-3 weeks for 4-6 weeks (27° C., 16 h light). Kanamycin-resistant primary shoots are regenerated at 4-6 weeks after bombardment. Shoots are transferred to MS-Kanamycin plates to grow root. The leaves and/or roots from T1 plants (and subsequent generations) are then evaluated to determine the amount of one or more alkaloids.

Example 5: Random Mutagenesis to Develop Novel Mutations in or Around the Nic1b Region Conferring a Low-Alkaloid Trait Random mutagenesis of tobacco plants are performed using Ethyl methanesulfonate (EMS) mutagenesis or fast neutron bombardment. EMS mutagenesis consists of chemically inducing random point mutations over the length of the genome. Fast neutron mutagenesis consists of exposing seeds to neutron bombardment which causes large deletions through double stranded DNA breakage.

For EMS mutagenesis, one gram (approximately 10,000 seeds) of Tennessee 90 tobacco (TN90) seeds are washed in 0.1% Tween for fifteen minutes and then soaked in 30 ml of ddH2O for two hours. One hundred fifty (150) μl of 0.5% EMS (Sigma, Catalogue No. M-0880) is then mixed into the seed/ddH2O solution and incubated for 8-12 hours (rotating at 30 rpm) under a hood at room temperature (RT; approximately 20° C.). The liquid then is removed from the seeds and mixed into 1 M NaOH overnight for decontamination and disposal. The seeds are then washed twice with 100 ml ddH2O for 2-4 hours. The washed seeds were then suspended in 0.1% agar solution.

The EMS-treated seeds in the agar solution are evenly spread onto water-soaked Carolina's Choice Tobacco Mix (Carolina Soil Company, Kinston, NC) in flats at ~2000 seeds/flat. The flats are then covered with plastic wrap and placed in a growth chamber. Once the seedlings emerge from the soil, the plastic wrap is punctured to allow humidity to decline gradually. The plastic wrap is completely removed after two weeks. Flats are moved to a greenhouse and fertilized with NPK fertilizer. The seedlings re plugged into a float tray and grown until transplanting size. The plants are subsequently transplanted into a field. During growth, the plants self-pollinate to form M1 seeds. At the mature stage, five capsules are harvested from each plant and individual designations are given to the set of seeds from each plant. This forms the M1 population. A composite of M1 seed from each M0 plant are grown, and leaves from M1 plants are collected for DNA extraction. Target genes within, around, or flanking the Nic1b Region are amplified and sequenced for mutation identification. Mutations are identified in all 35 NCGs (NCG1 to NCG35), with a focus on all NCGs exhibiting differential expression between TN90 and LA BU21, especially the NCGs encoding ERF-like proteins.

Example 6: Targeted Mutagenesis to Develop Novel Mutations in or Around the Nic1b Region Conferring a Low-Alkaloid Trait Tobacco lines with low nicotine while maintaining high leaf quality are produced by introducing mutations into and around Nic1b locus (e.g., ERF101, ERF110, ERF16, ERF130, and NCGs) via precise genome engineering technologies, for example, Transcription activator-like effector nucleases (TALENs), meganuclease, zinc finger nuclease, and CRISPR(Cas9 system, Cpf1 system, or Csm1 system). Genome modifications are made in commercial tobacco varieties such as TN90, K326 and Narrow Leaf Madole. All 35 NCGs (NCG1 to NCG35) are edited, with a focus on all NCGs exhibiting differential expression between TN90 and LA BU21, especially the NCGs encoding ERF-like proteins.

For example, CRISPR guide RNAs are designed and synthesized to recognize specific target sequences from NCG genes. Exemplary guide RNA sequences are provided in Table 2. Guide RNA(s) and an accompanying nucleic acid encoding a Cas9, Cpf1, or Csm1 protein (either as a DNA plasmid form or as a mRNA form) are then used to transform tobacco protoplasts. CRISPR-Cas9/Cpf1/Csm1 ribonucleoprotein complexes recognize specific NCG target sequences and introduce a double strand break (DSB). The endogenous non-homologous end-joining (NHEJ) DNA repair system fix the DSB, which may introduce nucleotide deletion, insertion, or substitution and result in potential loss-of-function mutations. Alternatively, a donor nucleic acid molecule with a desired sequence is included in protoplast transformation to serve as a template molecule to introduce the desired sequence at or around the CRISPR target site.

Tobacco protoplasts are isolated from TN90 tobacco leaves growing in Magenta boxes in a growth chamber. Well-expanded leaves (5 cm) from 3-4-week-old plants are cut into 0.5 to 1-mm leaf strips from the middle part of a leaf. Leaf strips are transferred into the prepared enzyme solution (1% cellulase R10, 0.25% macerozyme R10, 0.4 M mannitol, 20 mM KCl, 20 mM MES (pH 5.7), 10 mM CaCl2, 0.1% BSA) by dipping both sides of the strips. Leaf strips are vacuum infiltrated for 30 min in the dark using a desiccator with continuing digestion in the dark for 4 hour to overnight at room temperature without shaking. Protoplasts are filtered in 100 μm nylon filter and purified with 3 ml Lymphoprep. Protoplasts are centrifuged and washed with W5n solution (154 mM NaCl, 125 mM $CaCl_2$, 5 mM KCl, 2 mM MES, 991 mg/l glucose pH 5.7) and suspended in W5n solution at the concentration of 5×105/ml. Protoplasts are kept on ice for 30 min to settle at the bottom of the tube by gravity. W5n solution was moved and protoplasts were re-suspended in P2 solution at room temperature. 50 μl DNA (10-20 μg of plasmid), 500 μl protoplasts (2×105 protoplasts) and 550 μl of PEG solution (40%, v/v 10 ml 4 g PEG4000, 0.2 M mannitol, 0.1 M CaCl2) are mixed gently in a 15-ml microfuge tube, and the mixture incubated at room temperature for 5 min.

Protoplasts are pelleted and re-suspended with 1 ml 2× 8EN1 (8EN1: MS salt without $NH_4NO_3$, MS vitamin, 0.2% myo-Inositol, 4 mM MES, 1 mg/l NAA, 1 mg/l IAA, 0.5 M mannitol, 0.5 mg/l BAP, 1.5% sucrose). Transformed protoplasts are jellified with equal amount of low-meting agarose (LMA), and 0.2 ml of protoplast-LAM is dropped to form a bead. 10 ml 8EN1 is added to the bead, and in 7 days, 5 ml 8EN1 is taken out and 5 ml 8EN2 (8EN1 with 0.25 M mannitol) is added; after another 7 days (14 day), 10 ml 8EN2 is taken out and 10 ml 8EN2 is added; in another 7 days (21 day), 5 ml 8EN2 is taken out and 5 ml 8EN3 (8EN1 with 3% sucrose and without mannitol) is added; after another 7 days (28 day), 10 ml 8EN3 is taken out and 10 ml 8EN3 is added. Protoplasts are kept for two weeks until micro-callus growth. Callus is transferred to NCM solid media until it reaches about 5 mm (usually about two weeks). Callus was transferred to TOM-Kan solid media to grow shoots, and transformed tobacco plants were regenerated using the methods described herein. Callus or regenerated plants are tested and selected for gene editing events with desired mutations in NCG genes. Both loss-of-function NCG alleles (e.g., early stop codon or frame shift) or other types of mutations (e.g., gain-of-function or neomorphic) are generated.

Similarly, ERF genes from Nic2 locus is also edited (ERF 189, ERF 115, ERF221, ERF 104, ERF 179, ERF 17, and ERF 168) using a genome editing technique (e.g., Cas9, Cpf1, or Csm1-mediated CRISPR editing system). Both loss-of-function ERF mutations (e.g., early stop codon) or other types of mutations (e.g., gain-of-function or neomorphic) are generated.

Example 7: Use of Dominant Repressors to Suppress ERF-Like Gene in Nic1b Region and Generate Low-Alkaloid Tobacco Dominant repressors are developed for one or more ERF-like genes from the Nic1b Region (e.g., NCG1, NCG11, NCG12, NCG15, NCG16, ERF101, ERF110, ERF16, ERF130, and NCG17) by attaching to their C termini an ERF-associated amphiphilic repression (EAR) motif. When attached to a transcription factor, the EAR motif has been shown actively to repress expression of target genes of the transcription factor (Hiratsu et al., *Plant J.* 34:733-739 (2003)).

In short, ERF-EAR constructs are placed under the control of a constitutive promoter (e.g., the cauliflower mosaic virus (CaMV) 35S promoter) and used to transform wild-type tobacco by protoplast transformation or *Agrobacterium*, thereby generating transgenic lines for each construct, as well as a control line which was transformed with an empty vector (VC). Transgene expression is validated. Both nicotine levels and the expression of nicotine biosynthesis-related enzymes (putrescine N-methyltransferase (PMT), N-methylputrescine oxidase (MPO), aspartate oxidase (AO), quinolinic acid synthase (QS), quinolinic acid phosphoribosyl transferase (QPT), and PIP family oxidoreductase A622) and Tonoplast-localized MATE family transporters MATE1 and MATE2 (MATE1/2) are tested, together with the expression level of ornithine decarboxylase (ODC), arginine decarboxylase (ADC), spermidine synthase (SPDS), S-adenosylmethionine decarboxylase (SAMDC), and S-adenosylmethionine synthase (SAMS) genes.

Example 8: Breeding of Tobacco Varieties Containing Low Nicotine

Assisted by the identified Nic1b Region, genes within, and molecular markers associated therewith, low alkaloid tobacco hybrids, varieties, and lines comprising a nic1b_erf mutation (e.g., a complete or partial deletion of the Nic1b Region) with commercially acceptable leaf quality, are bred and produced. The NCG genes and markers are also used to screen for additional nic1b_erf alleles from various *Nicotiana* germplasm, for example, different *Nicotiana* species or *Nicotiana tabacum* lines. A collection of forty-three *Nicotiana* species, forty-nine *Nicotiana rustica* lines, and approximately six hundred *Nicotiana tabacum* lines that can be screened is provided in Table 8 of U.S. Pat. No. 7,700, 834.

Germplasm identified as having novel nic1b_erf alleles is used as source material for breeding with cultivated tobaccos. Interspecific or intraspecific hybridization methods combined with standard breeding methods, such as backcrossing or the pedigree method, may be used to transfer a desirable nic1b_erf or nic2 mutant allele from the donor source to cultivated tobaccos. For example, a low-nicotine variety comprising a nic1, nic2, or both mutant alleles (e.g., a donor parent such as LA Burley 21) is crossed to an elite high-nicotine variety having a desirable genetic background and agronomically elite traits. $F_1$ progeny plants from this cross is optionally assayed for one or more molecular markers exemplified in Table 3. An $F_1$ progeny plant is then backcrossed with the parent elite high-nicotine variety (recurrent parent). Plants from the BC1 generation are genotyped using molecular markers described and disclosed here to select for tobacco plants with smaller nic1b_erf or nic2 deletion segments. After multiple rounds of backcrossing (e.g., 5-7 generations), an new elite tobacco variety is obtained comprising both a low-alkaloid trait and other desirable traits from the recurrent parent elite line. This new elite tobacco variety is also free to any genetic drag associated with the low-alkaloid trait due to genetic recombination events around Nic1b and Nic2 loci. These recombination events unlink nic1b_erf and nic2 mutations from any associated detrimental mutations and thus reduce or avoid genetic drag. Using the above breeding and marker-assisted selection strategy, one can also achieve the pyramiding or stacking of a low-nicotine trait with other transgenes or natural alleles that reduce alkaloid or TSNA levels.

Low-alkaloid tobacco hybrids, varieties, or lines can be made as a Burley type, a dark type, a flue-cured type, a Maryland type or an Oriental type tobacco, or can be essentially derived from BU 64, CC 101, CC 200, CC 27, CC 301, CC 400, CC 500, CC 600, CC 700, CC 800, CC 900, Coker 176, Coker 319, Coker 371 Gold, Coker 48, CU 263, DF911, Galpao tobacco, GL 26H, GL 350, GL 600, GL 737, GL 939, GL 973, HB 04P, K 149, K 326, K 346, K 358, K394, K 399, K 730, KDH 959, KT 200, KT204LC, KY 10, KY 14, KY 160, KY 17, KY 171, KY 907, KY907LC, KTY14×L8 LC, Little Crittenden, McNair 373, McNair 944, msKY 14×L8, Narrow Leaf Madole, NC 100, NC 102, NC 2000, NC 291, NC 297, NC 299, NC 3, NC 4, NC 5, NC 6, NC7, NC 606, NC 71, NC 72, NC 810, NC BH 129, NC 2002, Neal Smith Madole, OXFORD 207, 'Perique' tobacco, PVH03, PVH09, PVH19, PVH50, PVH51, R 610, R 630, R 7-11, R 7-12, RG 17, RG 81, RG H51, RGH 4, RGH 51, RS 1410, Speight 168, Speight 172, Speight 179, Speight 210, Speight 220, Speight 225, Speight 227, Speight 234, Speight G-28, Speight G-70, Speight H-6, Speight H20, Speight NF3, TI 1406, TI 1269, TN 86, TN86LC, TN 90, TN 97, TN97LC, TN D94, TN D950, TR (Tom Rosson) Madole, VA 309, or VA359, Maryland 609, HB3307PLC, HB4488PLC, KT206LC, KT209LC, KT210LC, KT212LC, R610LC, PVH2310, NC196, KTD14LC, KTD6LC, KTD8LC, PD7302LC, PD7305LC, PD7309LC, PD7318LC, PD7319LC, PD7312LC, ShireyLC, or any commercial tobacco variety according to standard tobacco breeding techniques known in the art.

Example 9: Additional Genes from the Nic1b Region

Several genes, including a non-coding RNA, are identified from the Nic1b Region. They are listed in Table 5. Except for ERF16, all these genes exhibit higher expression levels in TN90 and high-alkaloid F5 sibling plants compared to LA BU21 and low-alkaloid F5 sibling plants. ERF16 appears to express at relatively similar levels in high-alkaloid and low-alkaloid plants. These additional genes are further studied as outlined in Examples 4 to 7. For example, both overexpression and suppression approaches are taken to investigate the function of these genes and develop tobacco varieties with desirable nicotine levels. Two sets of transgenic plants are generated, one being an overexpression approach using the full length coding sequence and the other being a suppression approach using an artificial microRNA or RNAi sequence. Further, mutational approaches (either random mutagenesis or targeted editing) are also taken to produce mutant alleles of these genes.

Figure 3:
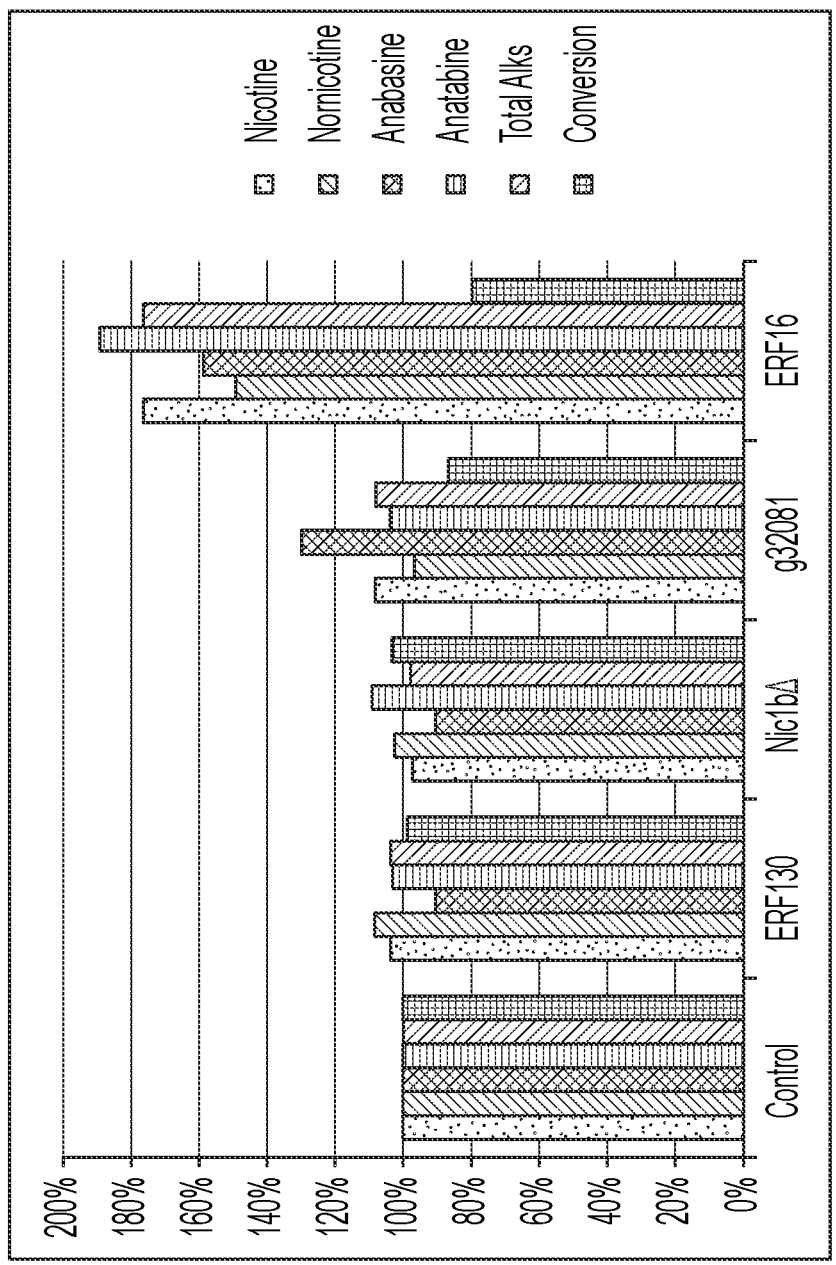
FIG. 3: The overexpression of ERF 16, but not ERF130, the LA_associated_region deleted in LA BU21 (i.e., SEQ ID No. 1, referenced as "Nic1bΔ" which contains no annotated gene, see Example 2), or g32081 (a beta-glucosidase 18-like gene) results in nicotine and total alkaloid increase in LA BU21.

Results from overexpressing selected genes or sequence segments from or around the Nic1b region are provided in Table 13 and FIG. 3. A 35S promoter is used to drive overexpression. Individual $T_0$ transformants in LA BU21 are potted on the same day, including a control construct and overexpression constructs for ERF130, the LA_associated_region deleted in LA BU21 (i.e., SEQ ID No. 1, referenced as "Nic1bΔ" which contains no annotated gene, see Example 2), g32081 (a beta-glucosidase 18-like gene), and ERF16. Plant are topped 12 weeks after potting. Alkaloid levels are determined by measuring a pooled leaf lamina sample collected from the $3^{rd}$, $4^{th}$, $5^{th}$, and $6^{th}$ leaves from the top of the plant, and 2 weeks after topping. Four or five independent $T_0$ plants are tested for each construct with their average levels of total alkaloid or individual alkaloids are determined. As shown in FIG. 3, this set of alkaloid data indicates that the overexpression of ERF16 promotes nicotine production (a 76% increase relative to control). Other minor alkaloids (including nornicotine, anabasine, and anatabine) also appear increased in ERF16 overexpression plants, which all contribute to the total alkaloid increase of 76% relative to control. No obvious shift in nicotine or alkaloid levels is observed from overexpressing ERF130, the Nic1bΔ sequence, or g32081.

Example 10: Multiple Transcription Factors from Chromosome 7 Differentially Express Between Normal-Alkaloid and Reduced-Alkaloid Tobacco Lines Listed in Table 6, several additional transcription factors are identified from chromosome 7 to exhibit differential expression levels between BU21 and LA BU21. These additional genes are further studied as outlined in Examples 4 to 7. For example, both overexpression and suppression approaches are taken to investigate the function of these genes and develop tobacco varieties with desirable nicotine levels. Two sets of transgenic plants are generated, one being an overexpression approach using the full length coding sequence and the other being a suppression approach using an artificial microRNA or RNAi sequence. Further, mutational approaches (either random mutagenesis or targeted editing) are also taken to produce mutant alleles of these genes.

Example 11: Various ERF Genes from the Nic1b Region Are Involved in Nicotine Biosynthesis Artificial microRNA ("amiRNA") constructs are designed using a MIR6147 backbone to suppress various ERF genes from or near the Nic1b Region (collectively referred to as "Nic1b_ERFs") as outlined in Example 4. Some artificial microRNAs are designed to suppress individual Nic1b_ERFs specifically. Other microRNAs are designed to target multiple Nic1b_ERFs simultaneously. Some exemplary mature artificial microRNA sequences are provided in Table 2.

To plants transformed with a Nic1b_ERF-specific amiRNA construct are potted on the same day as their corresponding control plants having an amiRNA-GUS construct. Root tissue for gene expression studies is collected from plants while being repotted into bigger pots. Alkaloid levels are determined by measuring a pooled leaf lamina sample collected from the $3^{rd}$, $4^{th}$, $5^{th}$, and $6^{th}$ leaves from the top of the plant, and 2 weeks after topping. Briefly, approximately 0.5 g of tobacco is extracted using liquid/liquid extraction into an organic solvent containing an internal standard and analyzed by gas chromatography (GC) with flame ionization detection (FID). Results can be reported as weight percent (Wt %) on either an as is or dry weight basis. Reporting data on a dry weight basis requires an oven volatiles (OV) determination. Unless specified otherwise, total or individual alkaloid levels or nicotine levels shown herein are on a dry weight basis (e.g., percent total alkaloid or percent nicotine). Preliminary gene expression screening is performed using the multiplex qPCR method with actin as the control on QuantStudio 5 or QS12K (ThermoFisher Scientific). Select subset of plants are also screened on a custom OpenArray with 18 genes in triplicate including the actin control gene on the QuantStudio QS 12K instrument.

Table 7 summarizes alkaloid data from one set of independent T0 transformants suppressing selected individual Nic1b_ERFs via artificial microRNA. With some exceptions (e.g., 18GH2083), suppressing individual Nic1b_ERFs via artificial microRNA reduces nicotine in the HI BU21 background (i.e., nic2 single mutant), but not in the wild-type background (e.g., t-NL Madole (PhPh) SRC) ((Tables 7 to 9). This may suggest redundancy among Nic1b_ERFs and also indicates that the nic2 single mutant provides a more sensitized background for evaluating each individual Nic1b_ERF's role in nicotine regulation. In HI BU21 plants, suppressing individual Nic1b_ERFs reduces nicotine levels to approximately 50% to 90% of control plants (Table 7 and FIG. 4). The observed nicotine reduction in amiRNA plants is consistent with reduced gene expression for multiple nicotine biosynthetic genes (Table 10).

$T_1$ plants are produced and further analyzed for kanamycin resistance segregation ratios ,alkaloid levels, and nicotine biosynthetic gene expression. Crosses are made to bring multiple amiRNAs into a single plant to suppress multiple Nic1b_ERFs simultaneously.

Example 12: Modulating Nicotine Levels By Manipulating ERF Genes Associated with Nic1b and/or Nic2 Loci To achieve desirable nicotine levels in tobacco, two groups of ERF genes are manipulated via overexpression or down-regulation and through either transgenic or mutagenic approaches. Each group of ERFs is clustered around the Nic1b or Nic2 region. The first group of ERFs include ERF101, ERF110, ERFnew, ERF199, ERF19, ERF130, ERF16, ERF29, ERF210, and ERF91L2, which are found here to cluster around the Nic1b Region (individually Nic1b_ERF and collectively Nic1b_ERFs). See Table 11 and Kajikawa et al., *Plant physiol.* 2017, 174:999-1011. Core members of this first ERF group include ERFnew, ERF199, ERF19, ERF29, ERF210, and ERF91L2. This first group can also include JRE5L2. The second group of ERFs include ERF189, ERF115, ERF221, ERF104, ERF179, ERF17, and ERF168 (individually Nic2_ERF and collectively Nic2_ERFs) which appear to be deleted in HI BU21 (i.e., a nic2 single mutant). See Shoji et al., *Plant Cell*, (10):3390-409 (2010). Core members of the second group include ERF189 and ERF115. This second group can also be expanded to a larger group including ERF163, ERF91L1, ERF104ΔC, ERF221, ERF115, ERF168, ERF17, ERF179, ERF17L1, ERF189, ERF17L2ΔC, JRE5L1, ERF104L1ΔC, and ERF168L1ΔC. See Table 12 and Kajikawa et al., *Plant physiol.* 2017, 174:999-1011.

Transgenic approaches include RNA interference-based gene suppression (e.g., antisense, co-suppression, hairpin or inverted repeat-based RNAi, artificial microRNA, artificial trans-acting small interfering (ta-si) RNA) and dominant negative suppressors (e.g., ERF-associated amphiphilic repression (EAR) motif). Transgene-based or cisgene-based suppression can be directed to a single ERF gene specifically, or a subset of ERF genes simultaneously. Dominant negative suppressors can be made cisgenically, for example, by knocking in an EAR motif coding sequence in frame with an endogenous ERF coding sequence.

Mutagenic approaches include random mutagenesis either chemically (e.g., EMS-based TILLING) or physically (e.g., irradiation) and genome editing. Any genome editing techniques described here can be used and include, e.g., TALENs, meganuclease, zinc finger nuclease, and CRISPR(Cas9 system, Cpf1 system, or Csm1 system.

Transgenic or mutagenic approaches are used to generate mutant alleles of the first and second groups of ERFs, focusing on the core members. Both loss-of-function (i.e., null) alleles and weak mutant alleles are produced. Various combinations of Nic2_ERF mutant alleles are produced to suppress the level or activity of Nic2_ERFs and potentially to the level or activity resembling the nic2 mutant allele found in HI BU21 or LA FC53. Various combinations of Nic1b_ERF mutant alleles are produced to suppress the level or activity of Nic1b_ERFs and potentially to the level or activity resembling the nic1 mutant allele found in LI BU21 or LA FC53. A further combination of mutant alleles in various Nic2_ERF and Nic1b_ERF genes are generated or introgressed into a single tobacco plant to produce a low-alkaloid tobacco line with nicotine and total alkaloid levels similar to those found in LA BU21, LA FC53, or LN KY171.

Example 13: Modulating Nicotine Levels By Manipulating Nic1b_ERF Genes Via Overexpression or Dominant EAR Repressor Fusions in Hairy Roots As mentioned in Example 12, various Nic1b_ERF sequences are fused with a dominant EAR repressor domain and overexpressed in tobacco hairy roots. Hairy roots are not induced with methyl jasmonate. Single roots are tested for transgene expression levels which are categorized into groups (+, ++, +++). At least one liquid culture/construct is inoculated with roots, which show similar expression (5 roots per culture). Downstream gene expression (quantitative RT-PCR of PMT, QPT and spermidine synthase (control gene)) and alkaloid levels are determined. Results are summarized in Table 14.

Figure 5A:
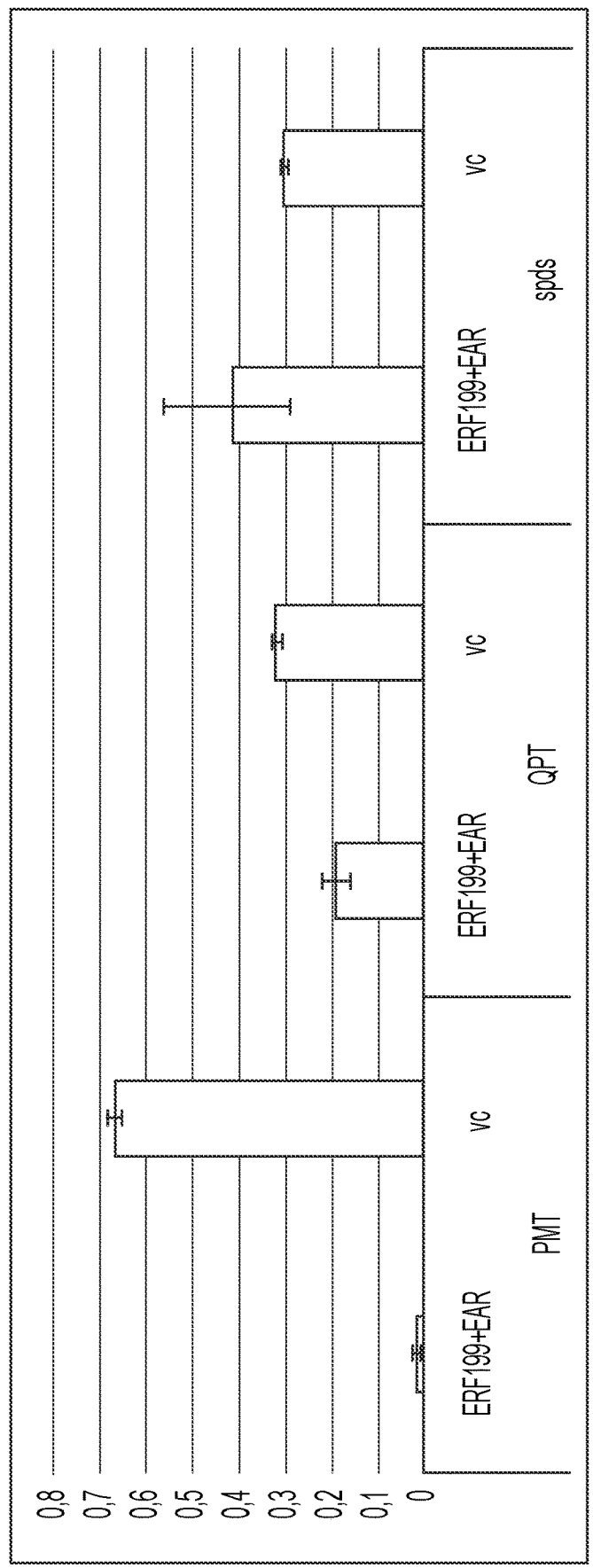
FIG. 5A: Quantitative RT-PCR data showing the effect on PMT and QPT gene expression from an ERF199-EAR dominant repressor. SPDS gene is used as a control. A vector control sample is shown as vc.
Figure 5B:
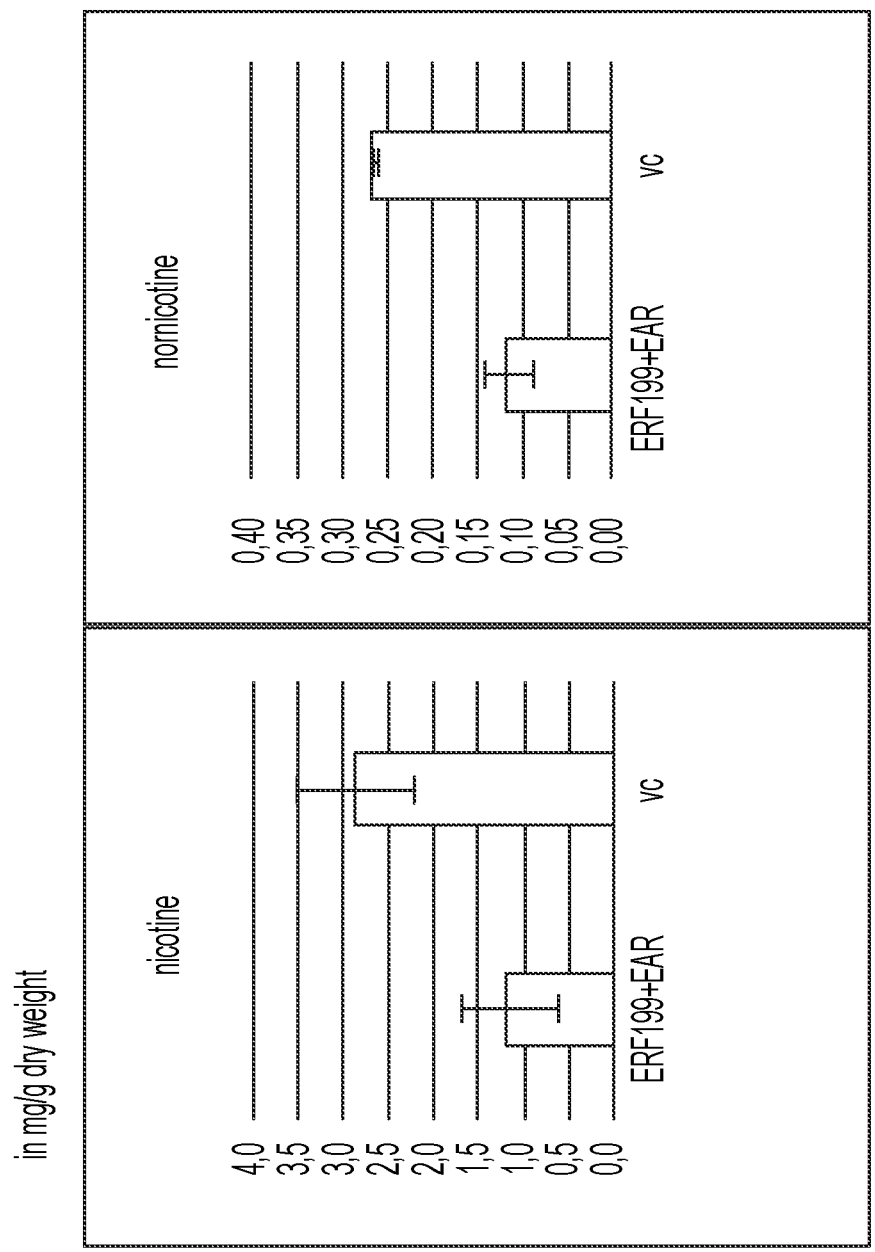
FIG. 5B: alkaloid content changes due to the expression of an ERF199-EAR dominant repressor.
Figure 5B:
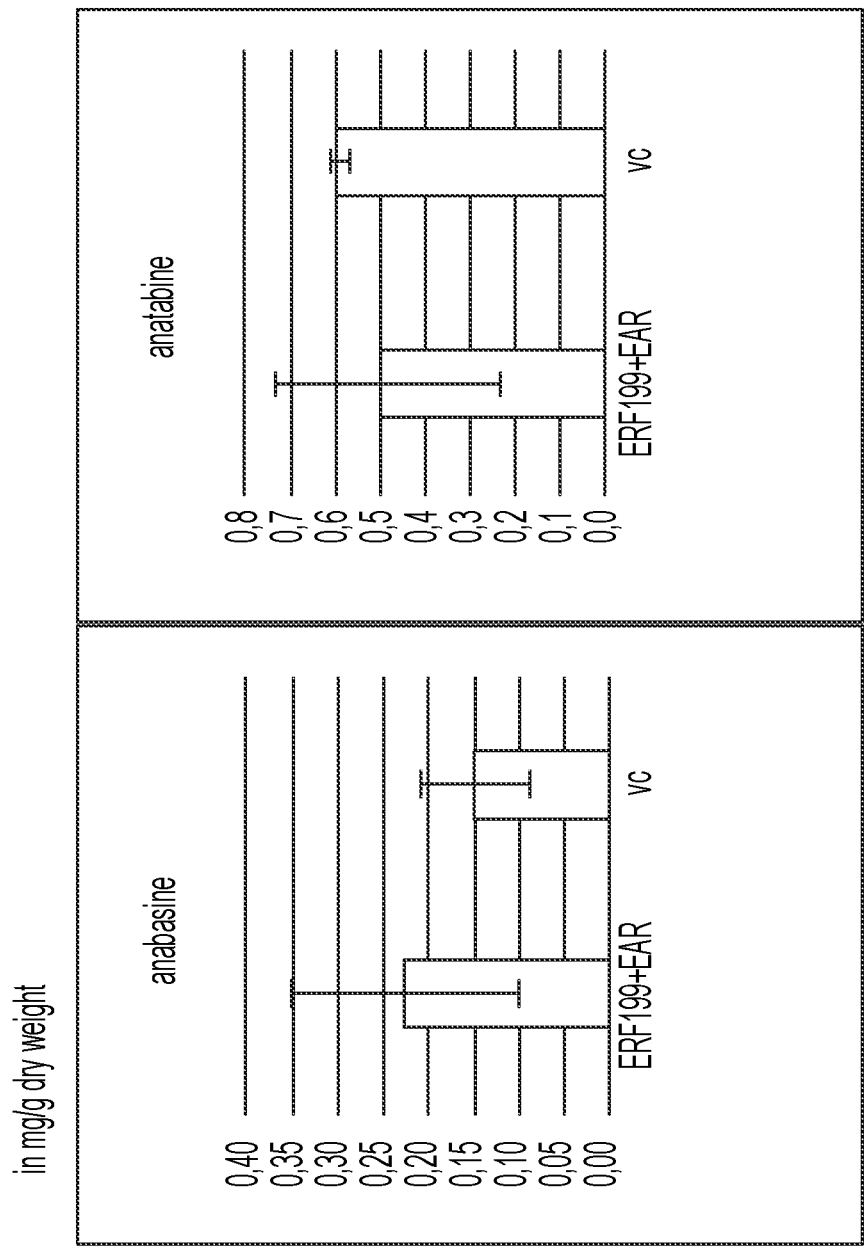

The expression of an ERF199-EAR dominant suppressor (overexpression level: ++/+++) results in reduced expression of PMT and QPT genes (FIG. 5A), and a reduction of nicotine and nornicotine (but not anabasine and anatabine) (FIG. 5B). Three biological replicates of ERF199-EAR together with vector control (vc, one pool of three biological replicates) are tested. These dominant suppression data suggest that ERF199 induces PMT expression and thereby nicotine and nornicotine production. Further, ERF199 does not appear to strongly affect QPT expression and therefore anabasine and anatabine production is only slightly changed in ERF199-EAR suppressor lines.

Figure 6A:
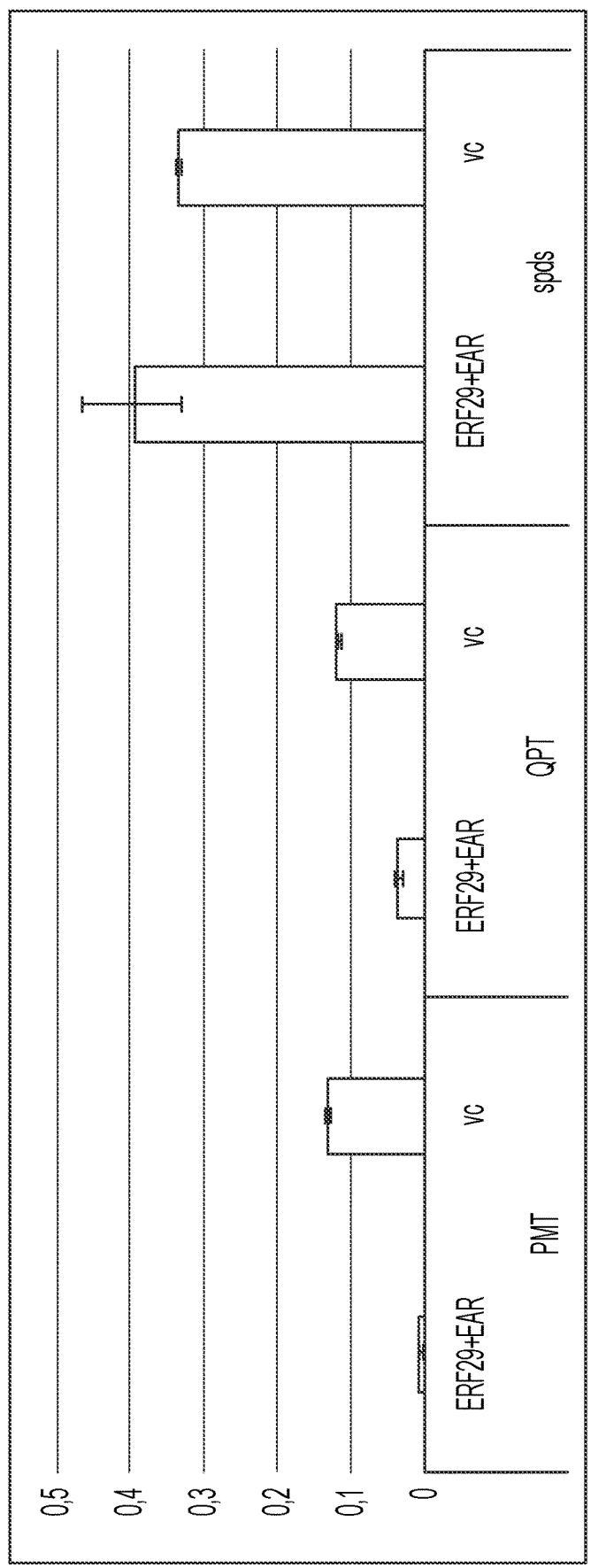
FIG. 6A: Quantitative RT-PCR data showing the effect on PMT and QPT gene expression from an ERF29-EAR dominant repressor. SPDS gene is used as a control. A vector control sample is shown as vc.
Figure 6B:
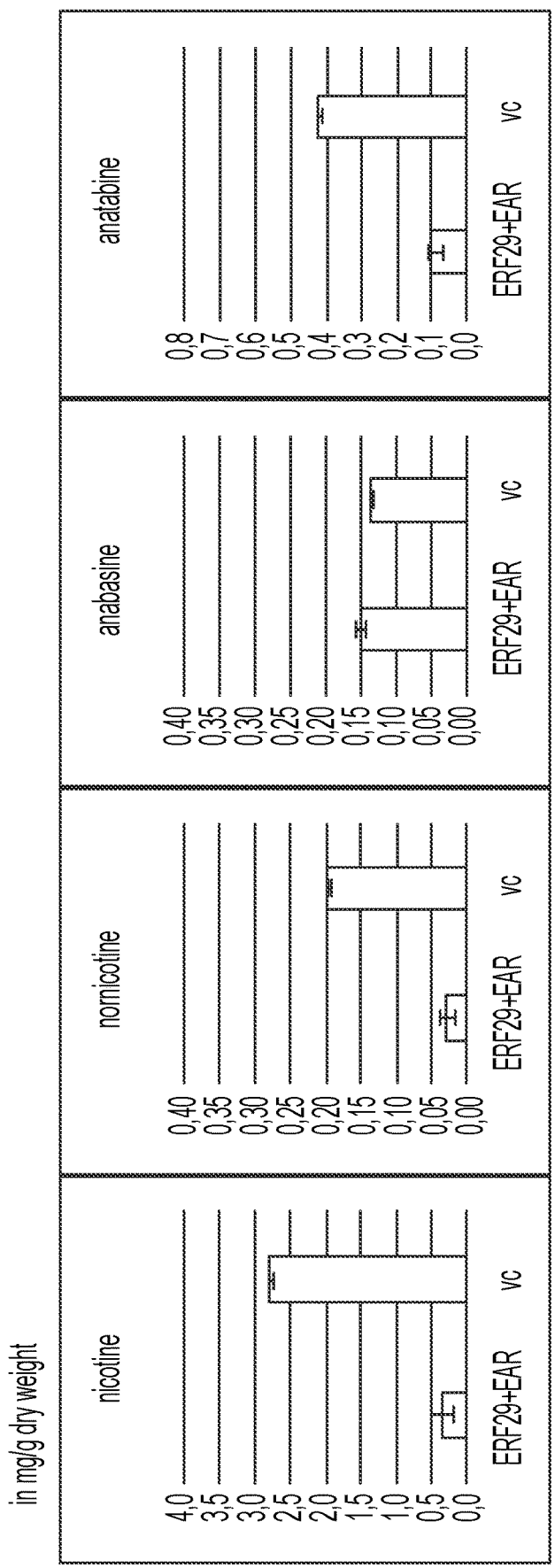
FIG. 6B: alkaloid content changes due to the expression of an ERF29-EAR dominant repressor.

The expression of an ERF29-EAR dominant suppressor (overexpression level: (+)/+) results in reduced expression of PMT and QPT genes (FIG. 6A), and a reduction of nicotine, nornicotine, and anatabine (but not anabasine) (FIG. 6B). Three biological replicates of ERF29-EAR together with a vector control sample (vc, one pool of two biological replicates) are tested. These dominant suppression data suggest that ERF29 induces PMT expression and thereby nicotine and nornicotine production. Further, ERF29 also appears to affect QPT expression and therefore anatabine production.

Figure 4:
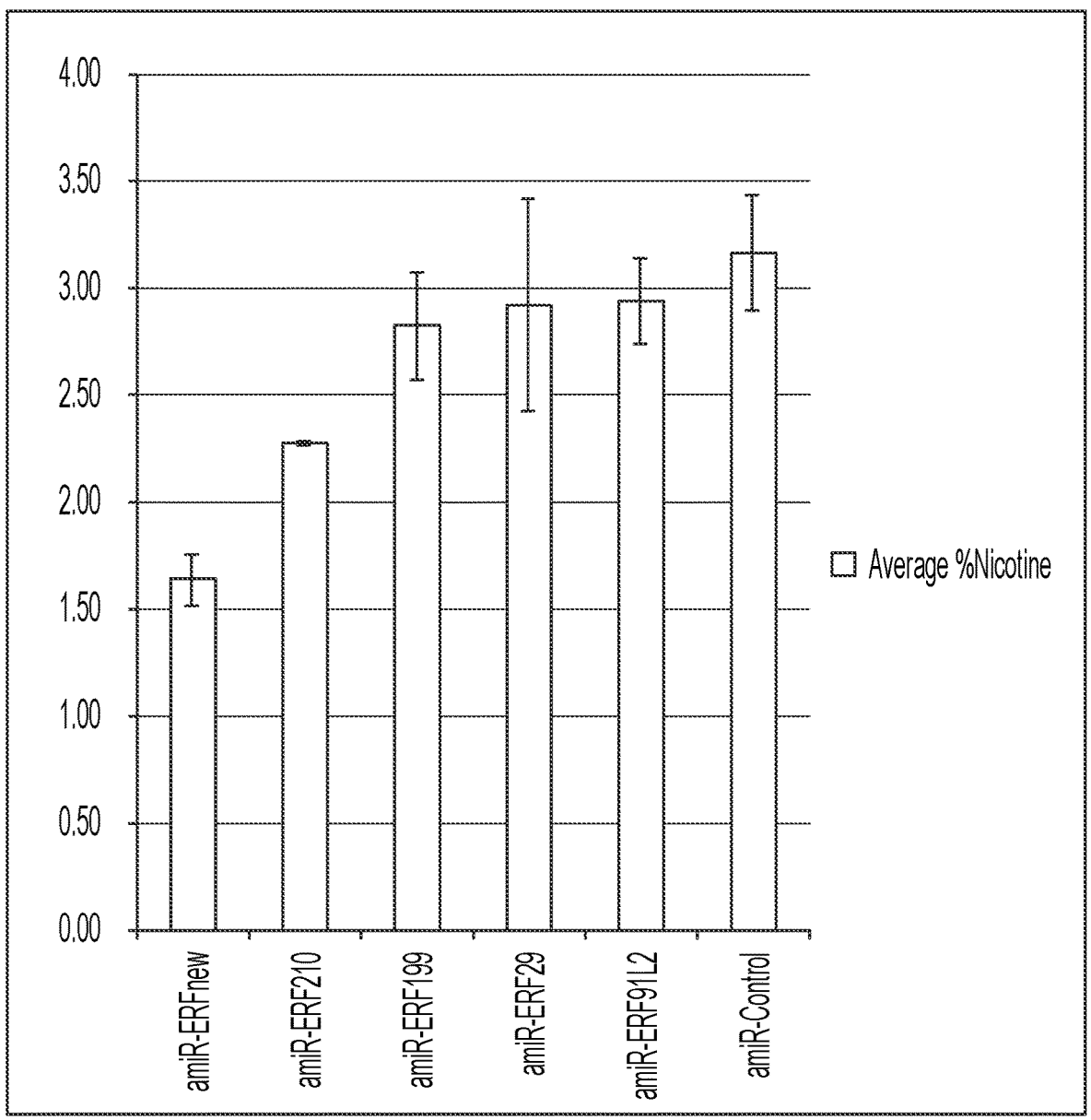
FIG. 4: Suppressing individual Nic1b_ERFs (ERFnew, ERF210, ERF 199, ERF29, and ERF91L2) via artificial microRNA reduces nicotine levels to approximately 50% to 90% of control plants. The average nicotine level and standard errors are based on data from Table 7.
Figure 7A:
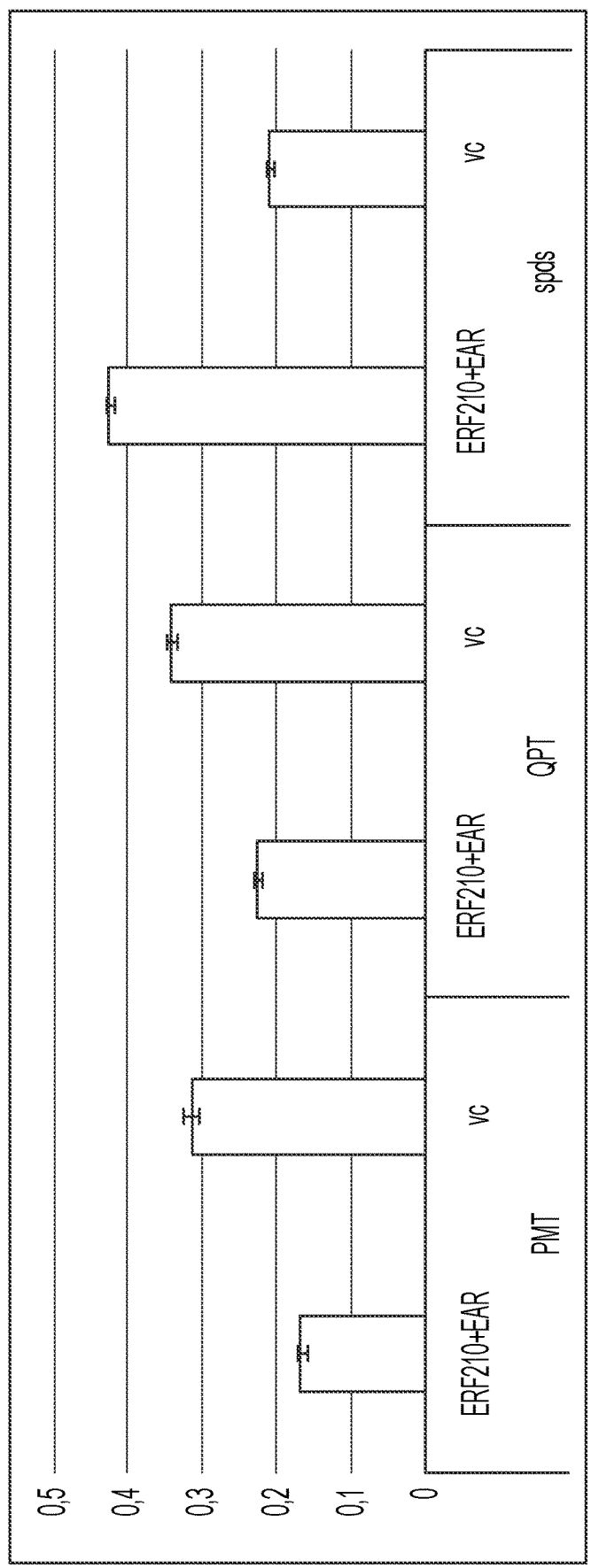
FIG. 7A: Quantitative RT-PCR data showing the effect on PMT and QPT gene expression from an ERF210-EAR dominant repressor. SPDS gene is used as a control. A vector control sample is shown as vc.
Figure 7B:
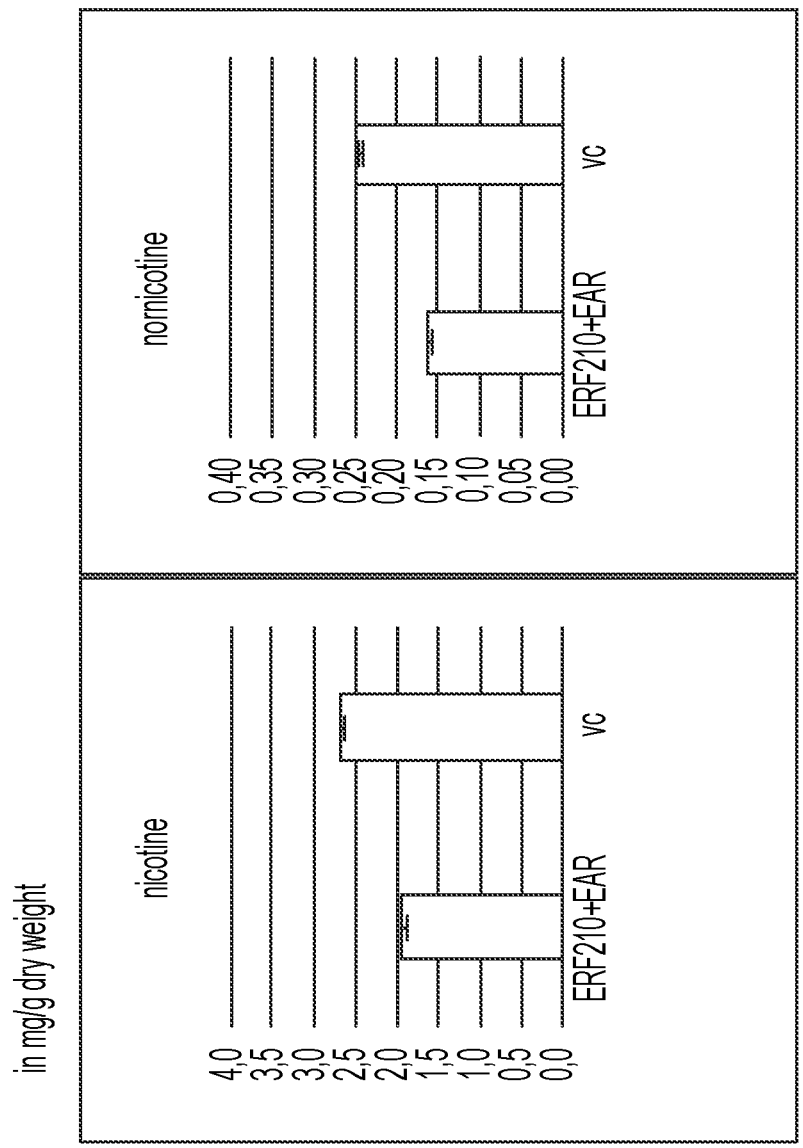
FIG. 7B: alkaloid content changes due to the expression of an ERF210-EAR dominant repressor.
Figure 7B:
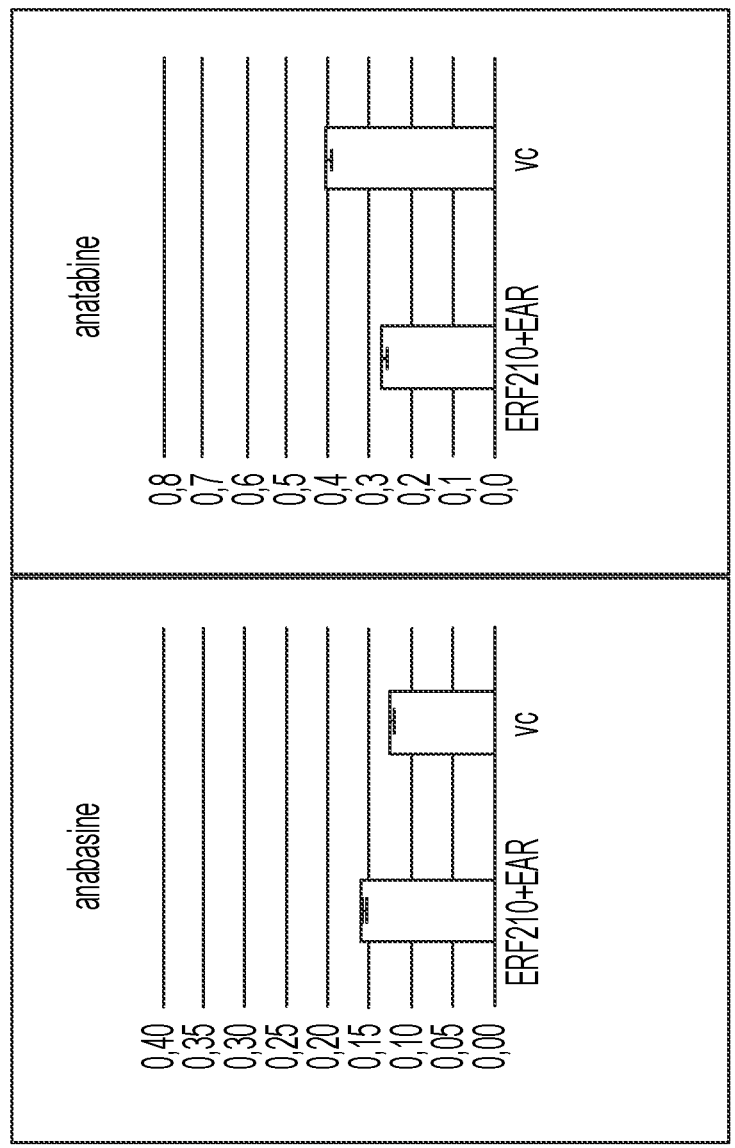

The expression of an ERF210-EAR dominant suppressor (overexpression level: +++) results in modestly reduced expression of PMT and QPT genes (FIG. 7A), and a slight reduction of nicotine, nornicotine, and anatabine (but not anabasine) (FIG. 7B), which results are consistent with the artificial microRNA-based suppression data in FIG. 4. One biological replicate of ERF210-EAR together with a vector control sample (vc, one pool of one biological replicate) are tested. These dominant suppression data suggest that ERF210 slightly affects PMT and QPT expression and thereby has a slight impact over nicotine and nornicotine production.

Figure 8A:
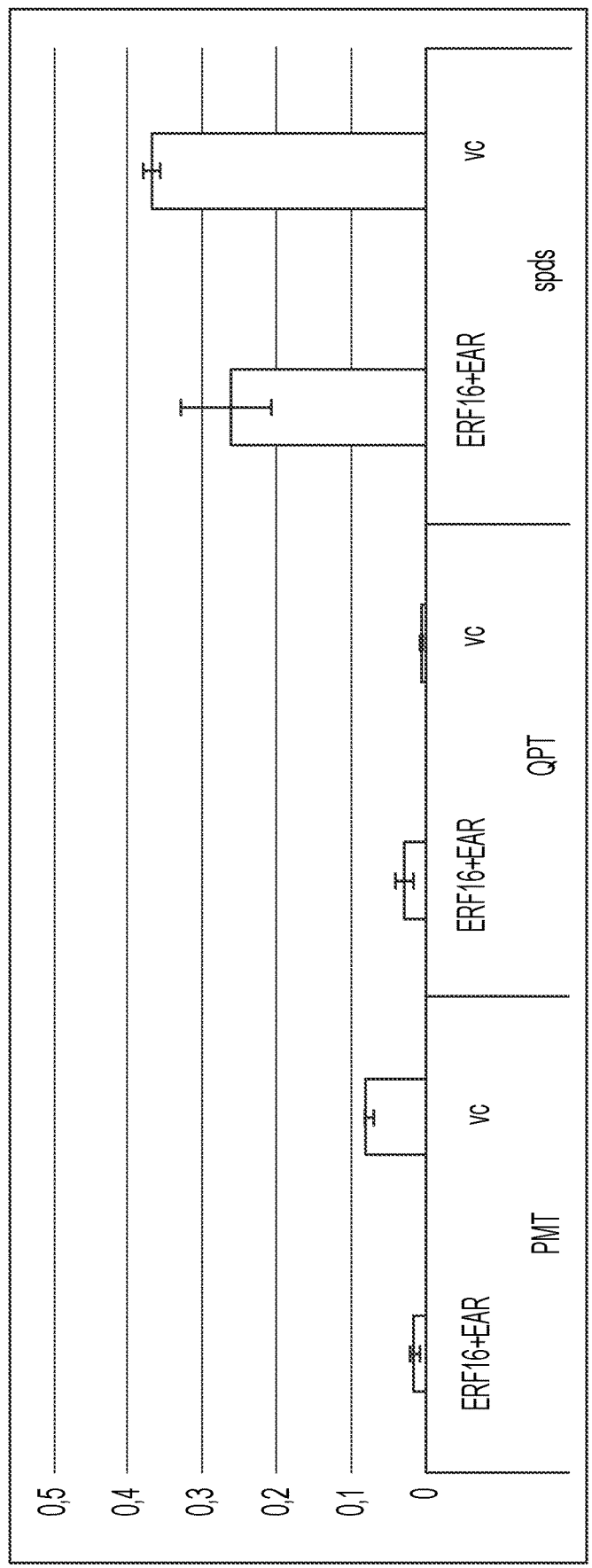
FIG. 8A: Quantitative RT-PCR data showing the effect on PMT and QPT gene expression from an ERF16-EAR dominant repressor. SPDS gene is used as a control. A vector control sample is shown as vc.
Figure 8B:
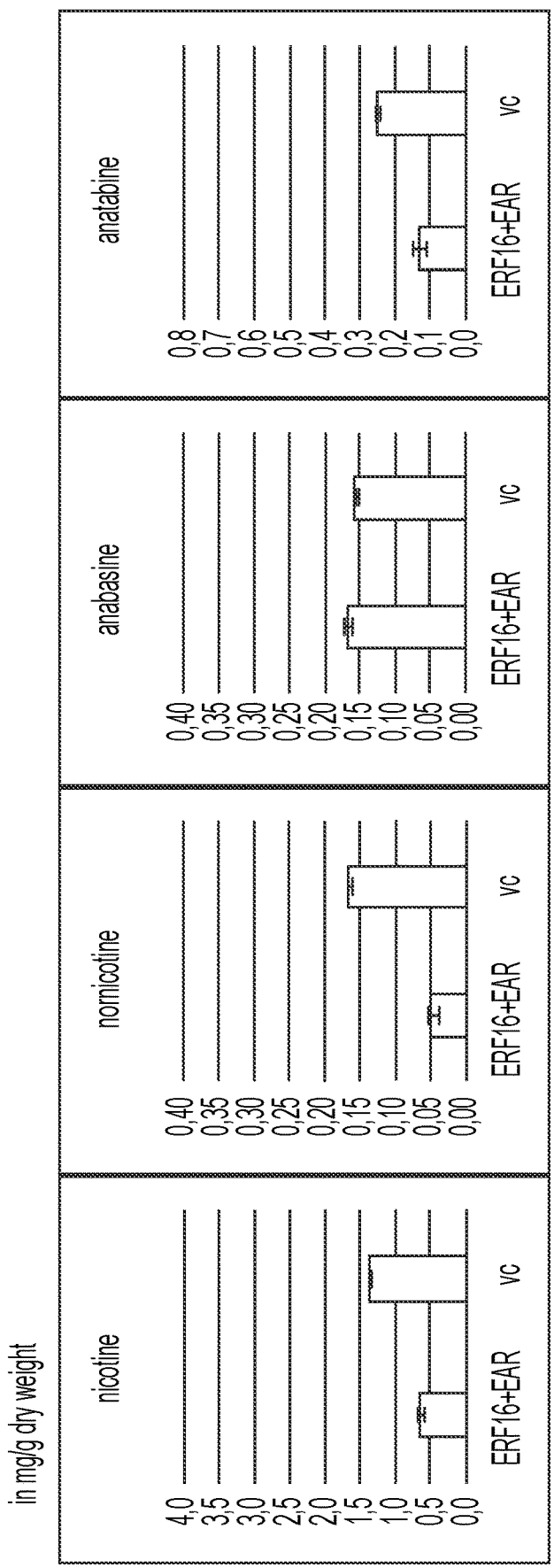
FIG. 8B: alkaloid content changes due to the expression of an ERF16-EAR dominant repressor.

The expression of an ERF16-EAR dominant suppressor (overexpression level: (+)/+) results in reduced PMT expression (FIG. 8A), and a reduction of nicotine, nornicotine and anatabine (but not anabasine) (FIG. 8B). Two biological replicates of ERF16-EAR together with vector control (vc, one pool of one biological replicate) are tested. These dominant suppression data suggest that ERF16 induces PMT expression and thereby nicotine and nornicotine production, which observation is consistent with the transgenic data shown in FIG. 3. Further, ERF16 does not appear to strongly affect QPT expression and therefore anabasine production is not changed in ERF16-EAR suppressor lines.

Figure 9A:
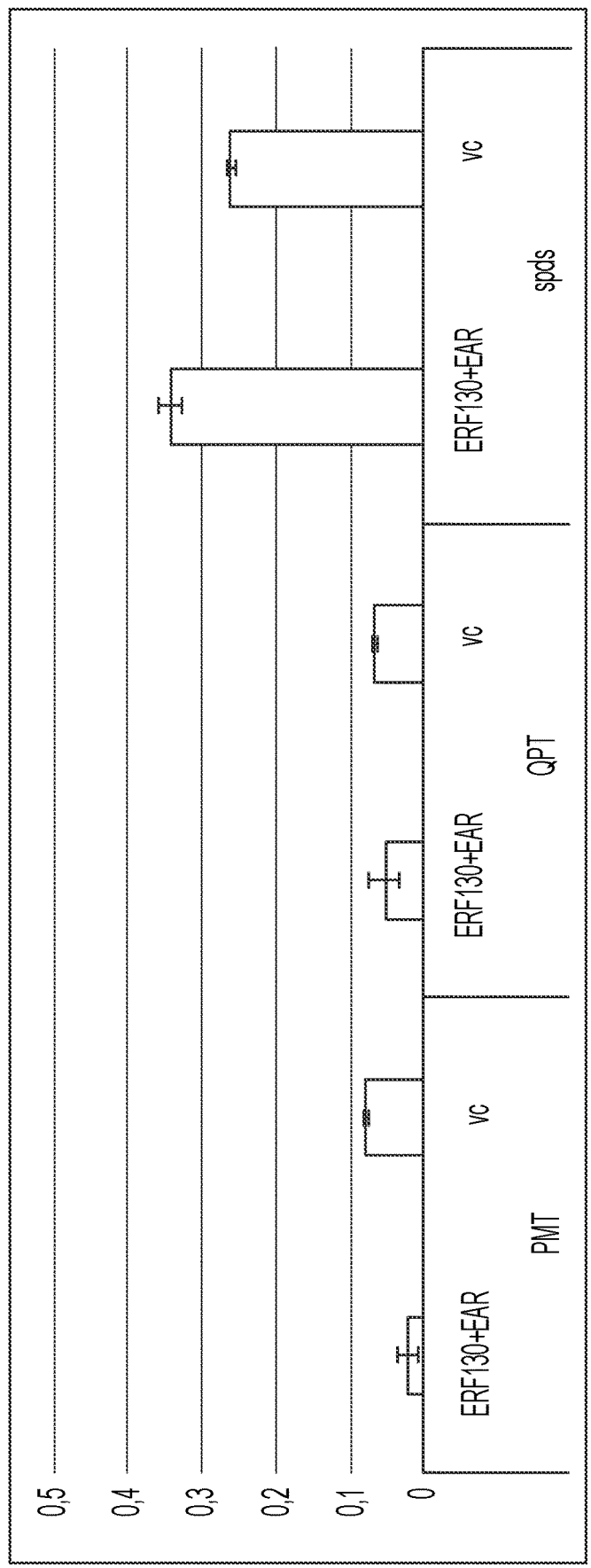
FIG. 9A: Quantitative RT-PCR data showing the effect on PMT and QPT gene expression from an ERF130-EAR dominant repressor. SPDS gene is used as a control. A vector control sample is shown as vc.
Figure 9B:
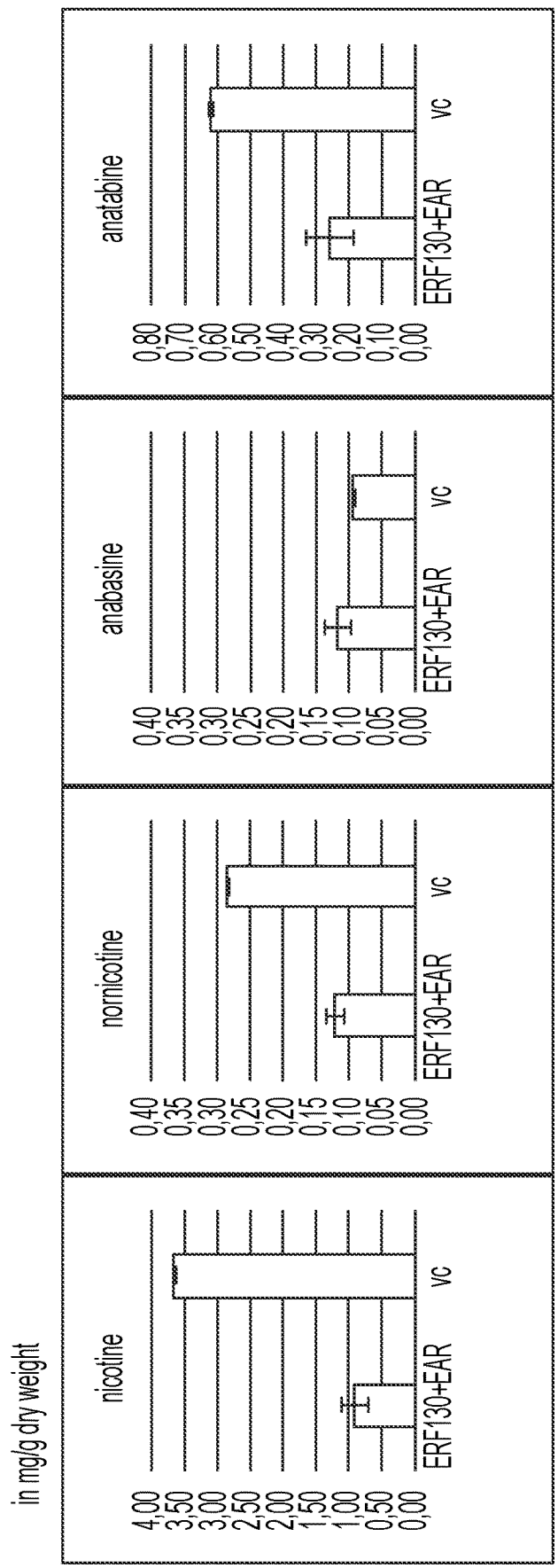
FIG. 9B: alkaloid content changes due to the expression of an ERF130-EAR dominant repressor.

The expression of an ERF130-EAR dominant suppressor (overexpression level: ++) results in reduced PMT expression (FIG. 9A), and a reduction of nicotine, nornicotine and anatabine (but not anabasine) (FIG. 9B). Three biological replicates of ERF130-EAR together with vector control (vc, one pool of two biological replicates) are tested. These dominant suppression data suggest that ERF130 induces PMT expression and thereby nicotine and nornicotine production. Further, ERF130 appear to only slightly affect QPT expression and therefore anabasine production is also slightly changed in ERF130-EAR suppressor lines.

Figure 10A:
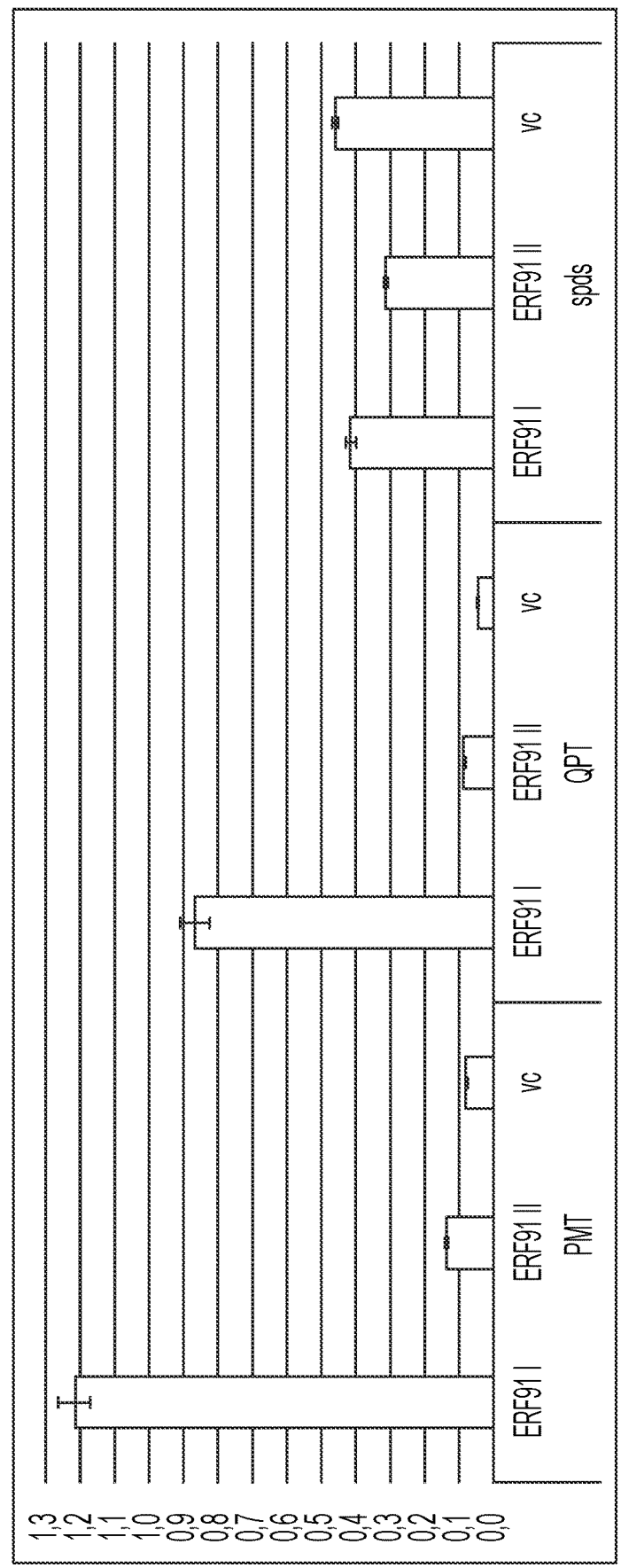
FIG. 10A: Quantitative RT-PCR data showing the effect on PMT and QPT gene expression from either ERF91 overexpression ("ERF91 I") or an ERF91-EAR dominant repressor ("ERF91 II"). SPDS gene is used as a control. A vector control sample is shown as vc.
Figure 10B:
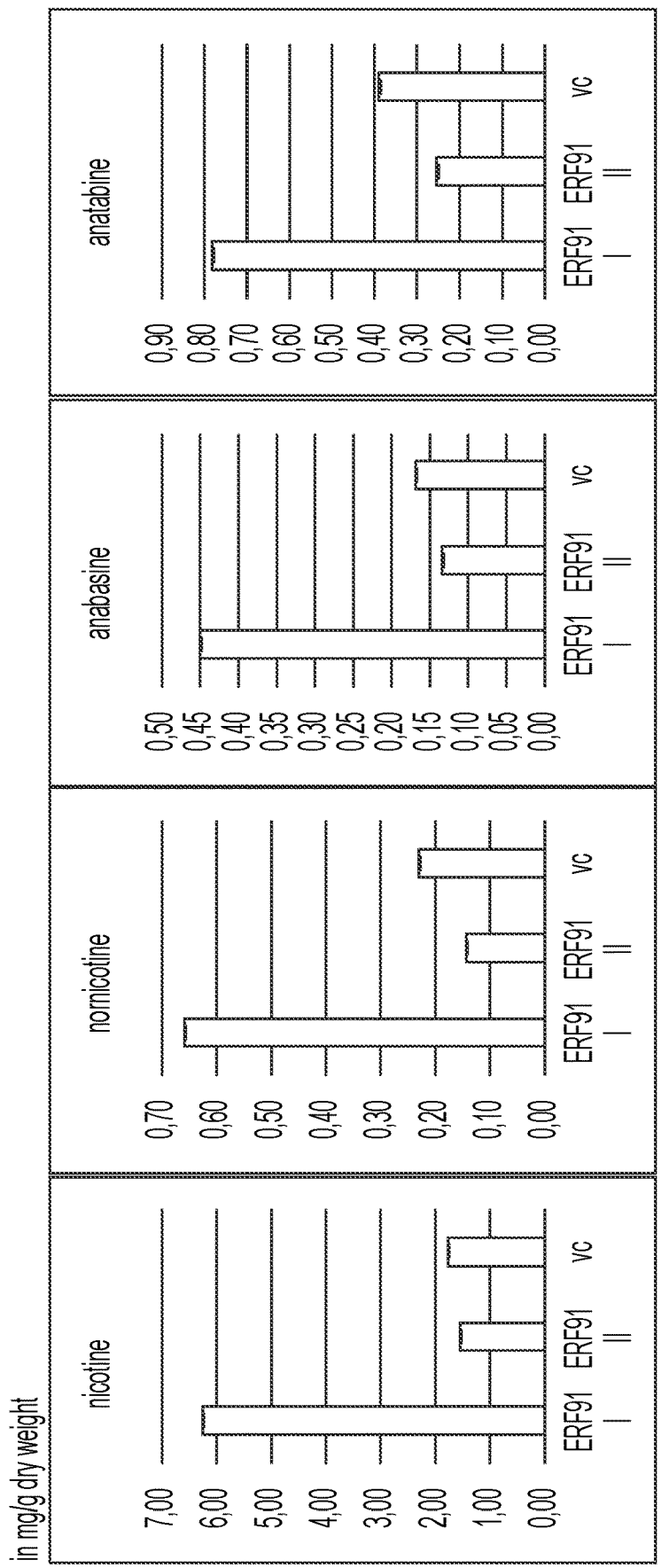
FIG. 10B: alkaloid content changes due to either ERF91 overexpression ("ERF91 I") or an ERF91-EAR dominant repressor ("ERF91 II").

Both ERF91 overexpression and the expression of an ERF91-EAR dominant suppressor are tested. ERF91 overexpression results enhanced expression of PMT and QPT and therefore nicotine, nornicotine and anatabine levels are increased (FIGS. 10A and 10B, listed as "ERF91 I"). The expression of an ERF91-EAR dominant suppressor (overexpression level: ++) does not appear to result in reduced PMT expression (FIG. 10A, listed as "ERF91 II"), and therefore lacks noticeable reduction of nicotine, nornicotine and anatabine (FIG. 10B, listed as "ERF91 II").

Figure 11A:
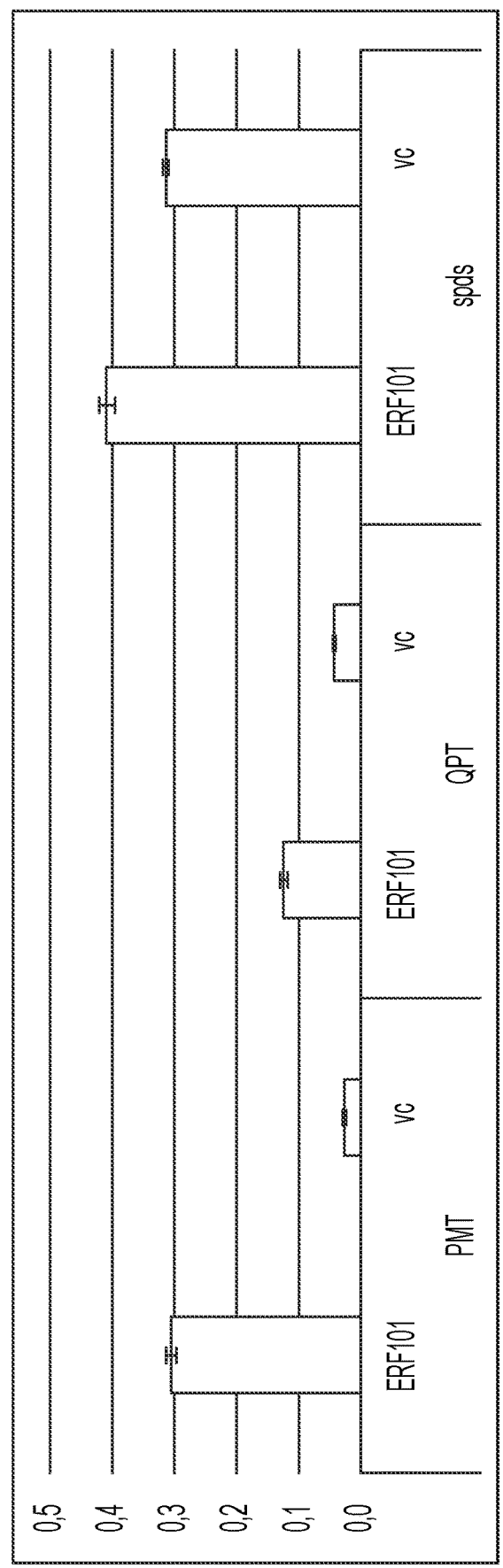
FIG. 11A: Quantitative RT-PCR data showing the effect on PMT and QPT gene expression from ERF101 overexpression. SPDS gene is used as a control. A vector control sample is shown as vc.
Figure 11B:
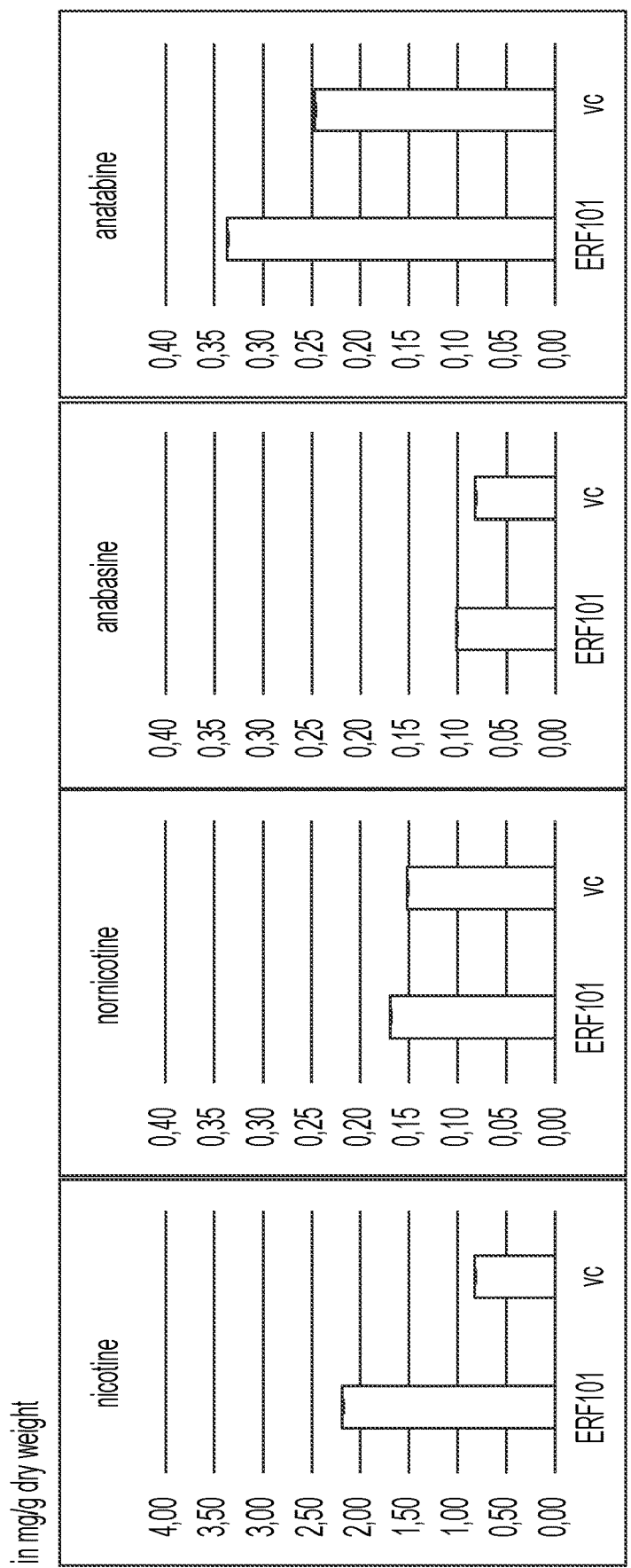
FIG. 11B: alkaloid content changes due to ERF101 overexpression.
Figure 12A:
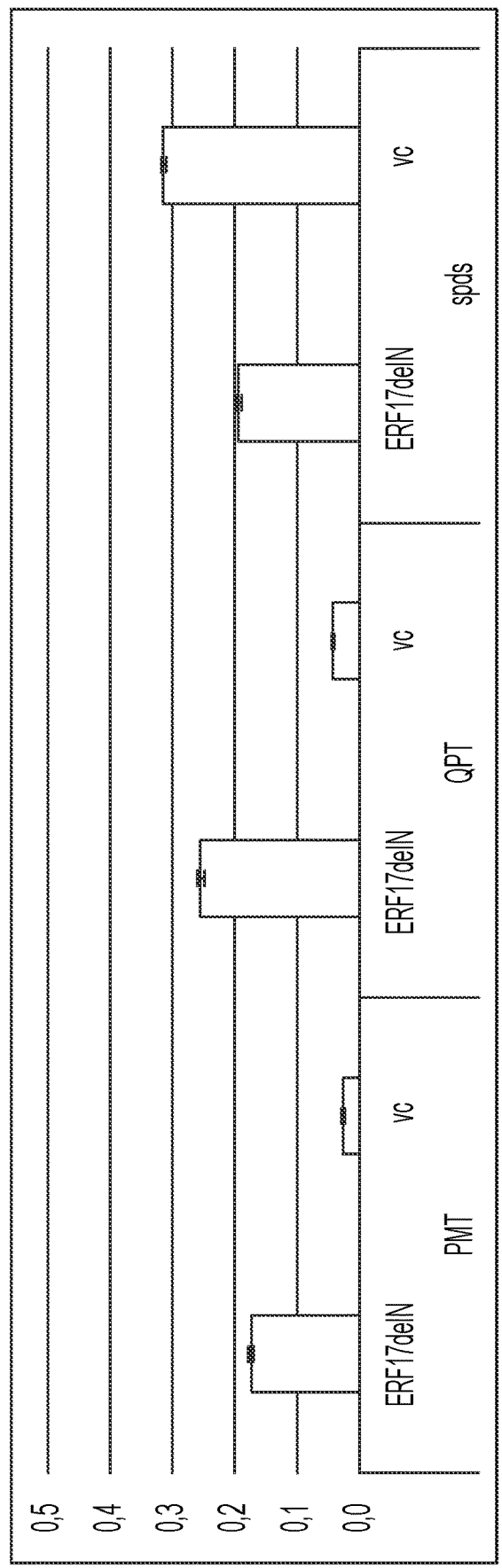
FIG. 12A: Quantitative RT-PCR data showing the effect on PMT and QPT gene expression from ERFnew overexpression (labeled as ERF17delN). SPDS gene is used as a control. A vector control sample is shown as vc.
Figure 12B:
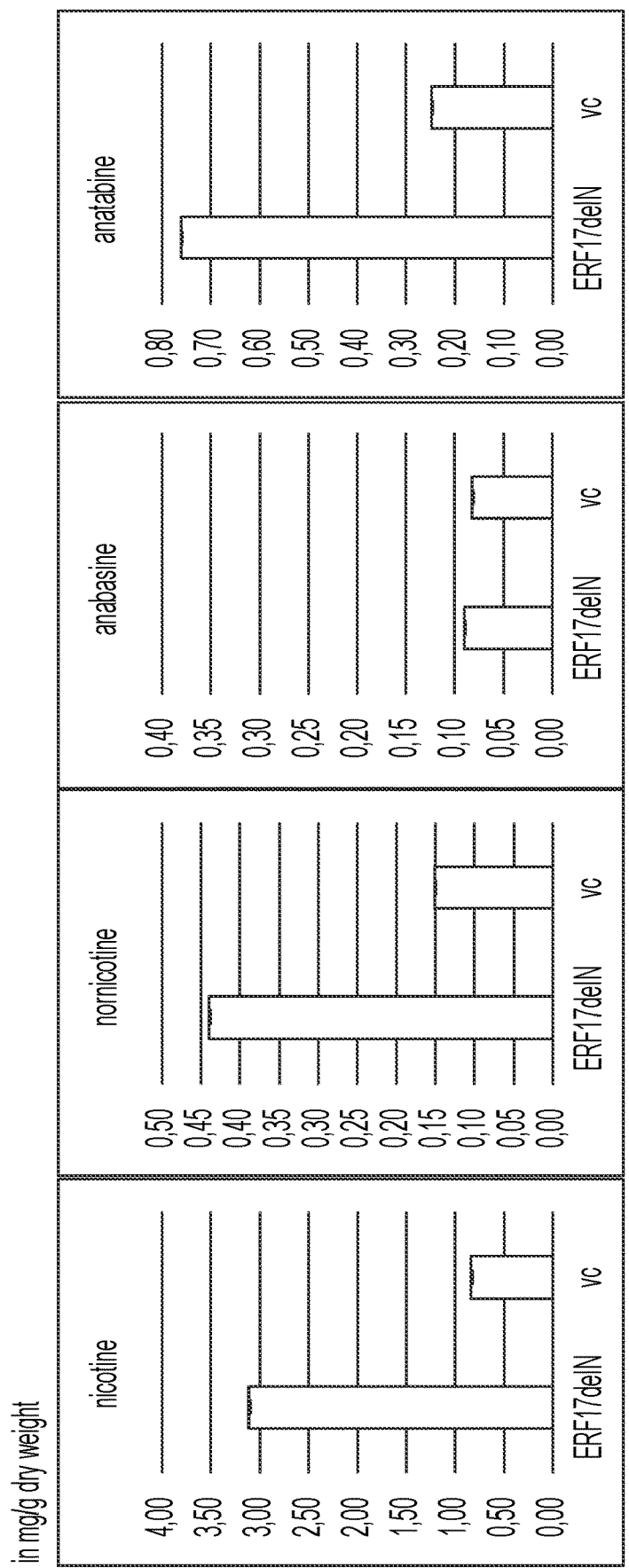
FIG. 12B: alkaloid content changes due to ERFnew overexpression (labeled as ERF17delN).
Figure 13:
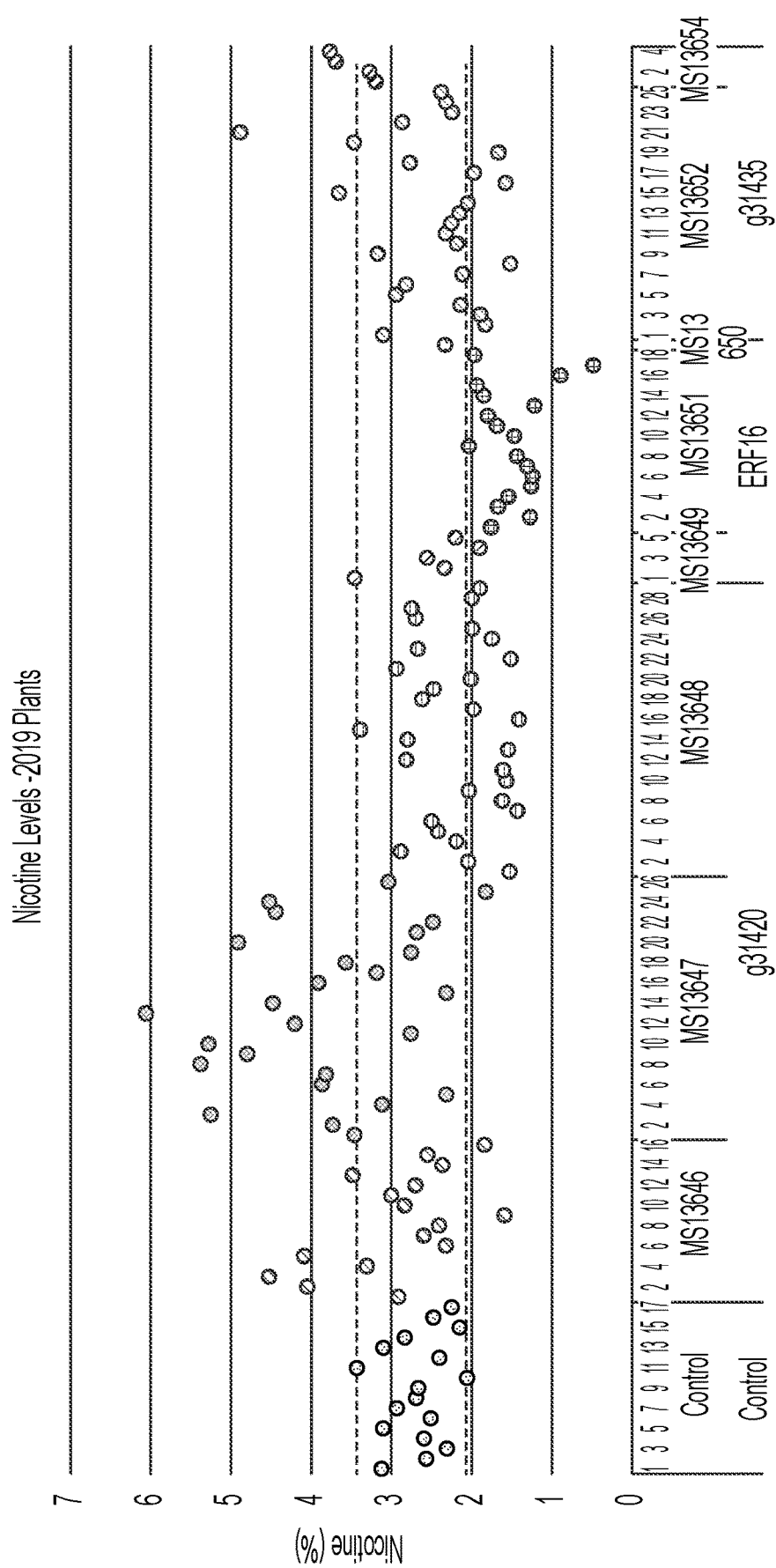
FIG. 13: Nicotine levels from greenhouse collected samples of NIC1b-ERF mutant plants compared to control wild-type TN90. Plants were grown in the 2018 field season and sampled in 2019. MS13646, MS13647, and MS13648 are exemplary mutations in g31420 (NCG1). MS13649, MS13651, and MS13650 are exemplary mutations in ERF16. MS13652 and MS13654 are exemplary mutations in g31435 (NCG15). Dashed lines represent the top and bottom of the wild-type TN90 range. Nicotine level is shown as a percentage of dry weight.
Figure 14:
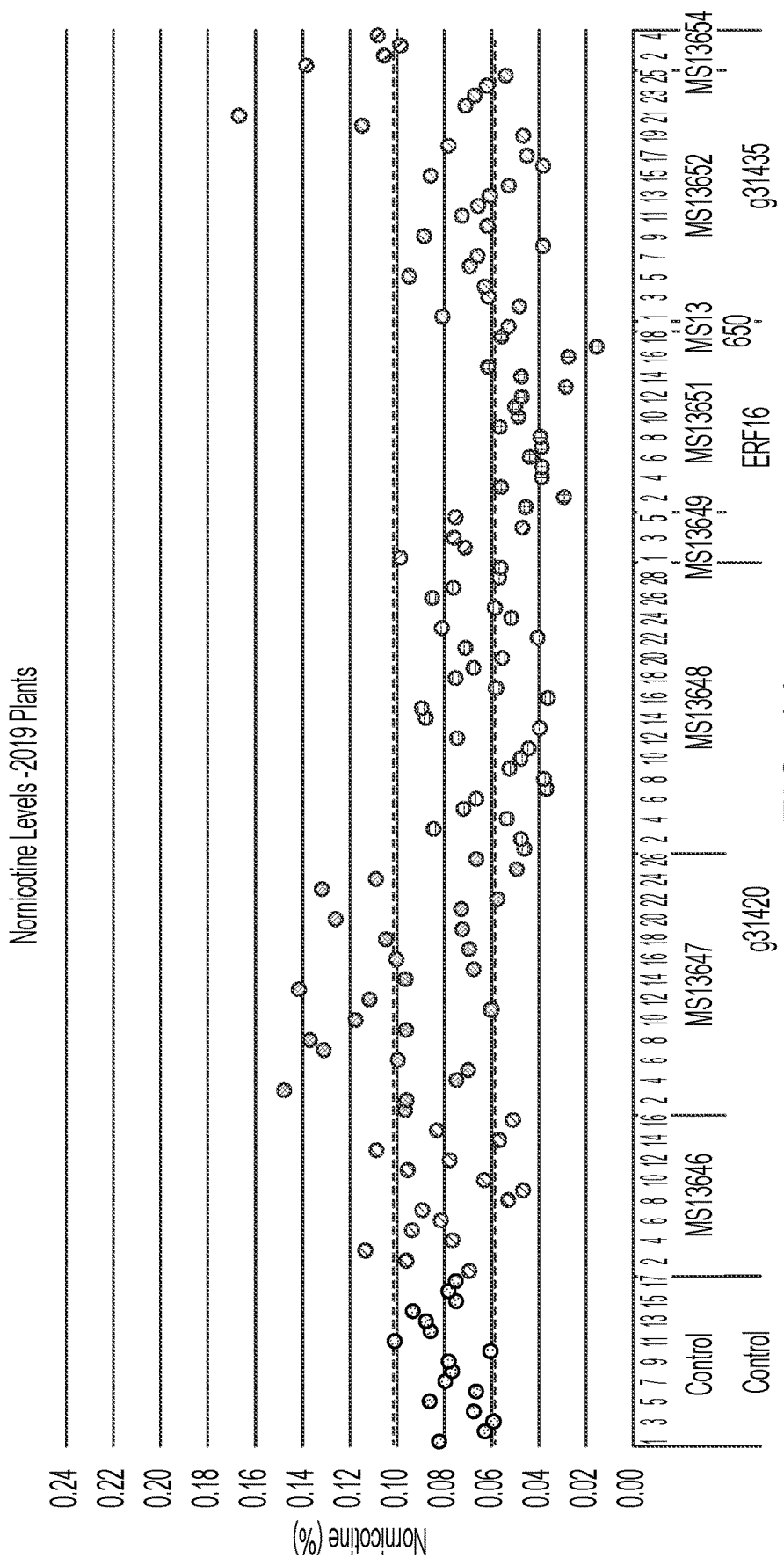
FIG. 14: Nornicotine levels from greenhouse collected samples of NIC1b-ERF mutant plants compared to control TN90. Plants were grown in the 2018 field season and sampled in 2019. MS13646, MS13647, and MS13648 are exemplary mutations in g31420 (NCG1). MS13649, MS13651, and MS13650 are exemplary mutations in ERF16. MS13652 and MS13654 are exemplary mutations in g31435 (NCG15). Dashed lines represent the top and bottom of the wild-type TN90 range. Nornicotine level is shown as a percentage of dry weight.
Figure 15:
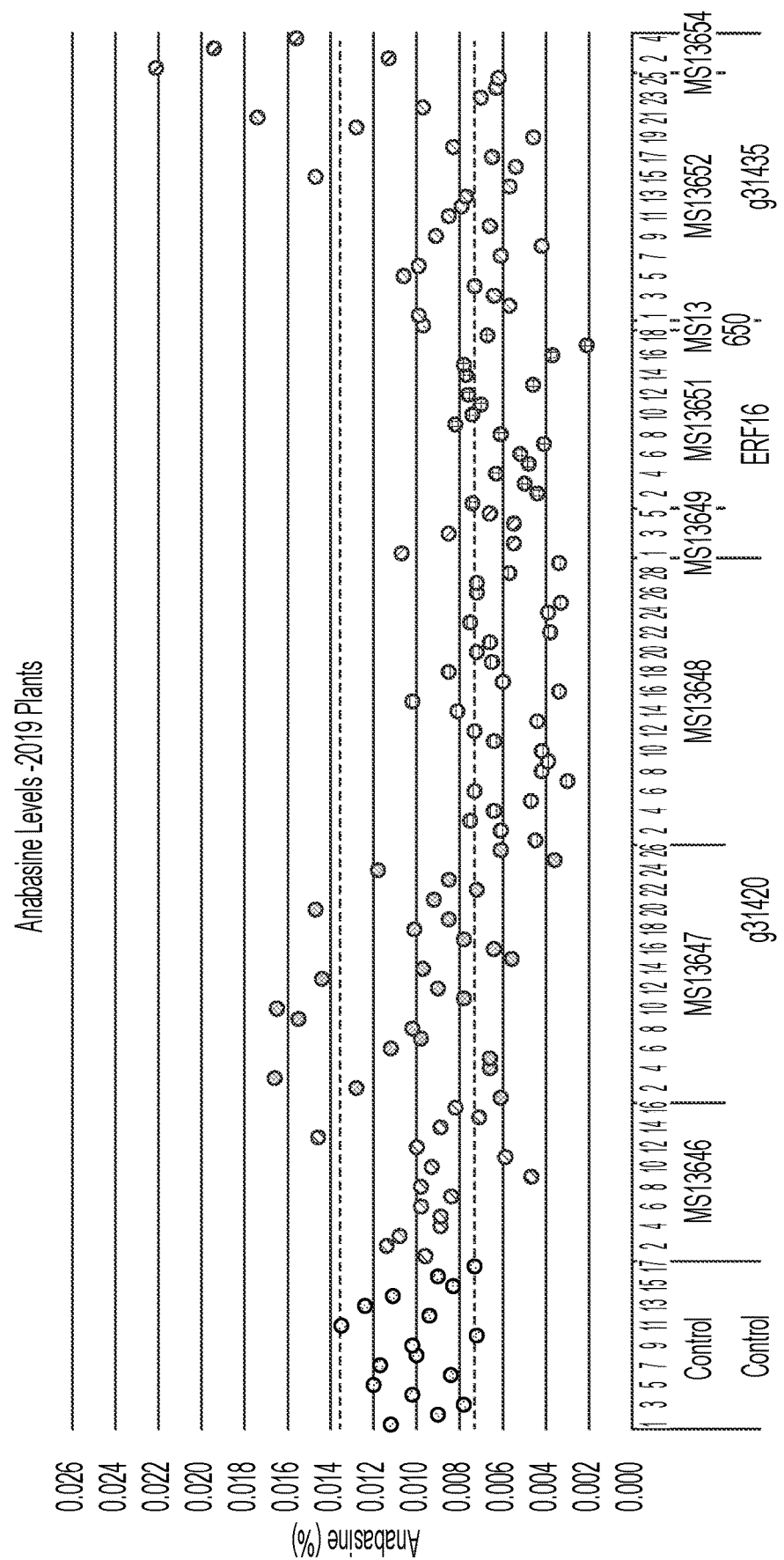
FIG. 15: Anabasine levels from greenhouse collected samples of NIC1b-ERF mutant plants compared to control TN90. Plants were grown in the 2018 field season and sampled in 2019. MS13646, MS13647, and MS13648 are exemplary mutations in g31420 (NCG1). MS13649, MS13651, and MS13650 are exemplary mutations in ERF16. MS13652 and MS13654 are exemplary mutations in g31435 (NCG15). Dashed lines represent the top and bottom of the wild-type TN90 range. Anabasine level is shown as a percentage of dry weight.
Figure 16:
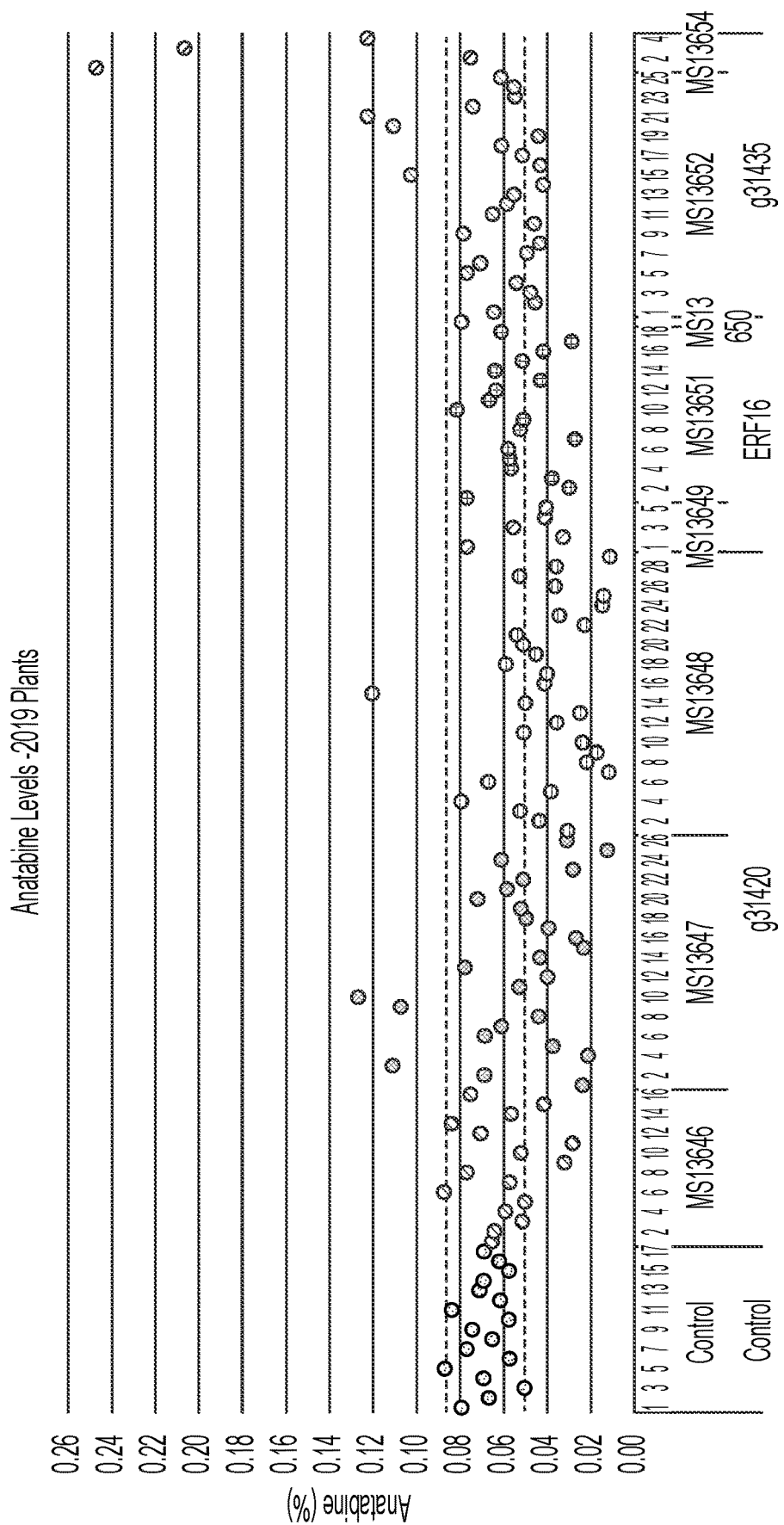
FIG. 16: Anatabine levels from greenhouse collected samples of NIC1b-ERF mutant plants compared to control TN90. Plants were grown in the 2018 field season and sampled in 2019. MS13646, MS13647, and MS13648 are exemplary mutations in g31420 (NCG1). MS13649, MS13651, and MS13650 are exemplary mutations in ERF16. MS13652 and MS13654 are exemplary mutations in g31435 (NCG15). Dashed lines represent the top and bottom of the wild-type TN90 range. Anatabine level is shown as a percentage of dry weight.
Figure 17:
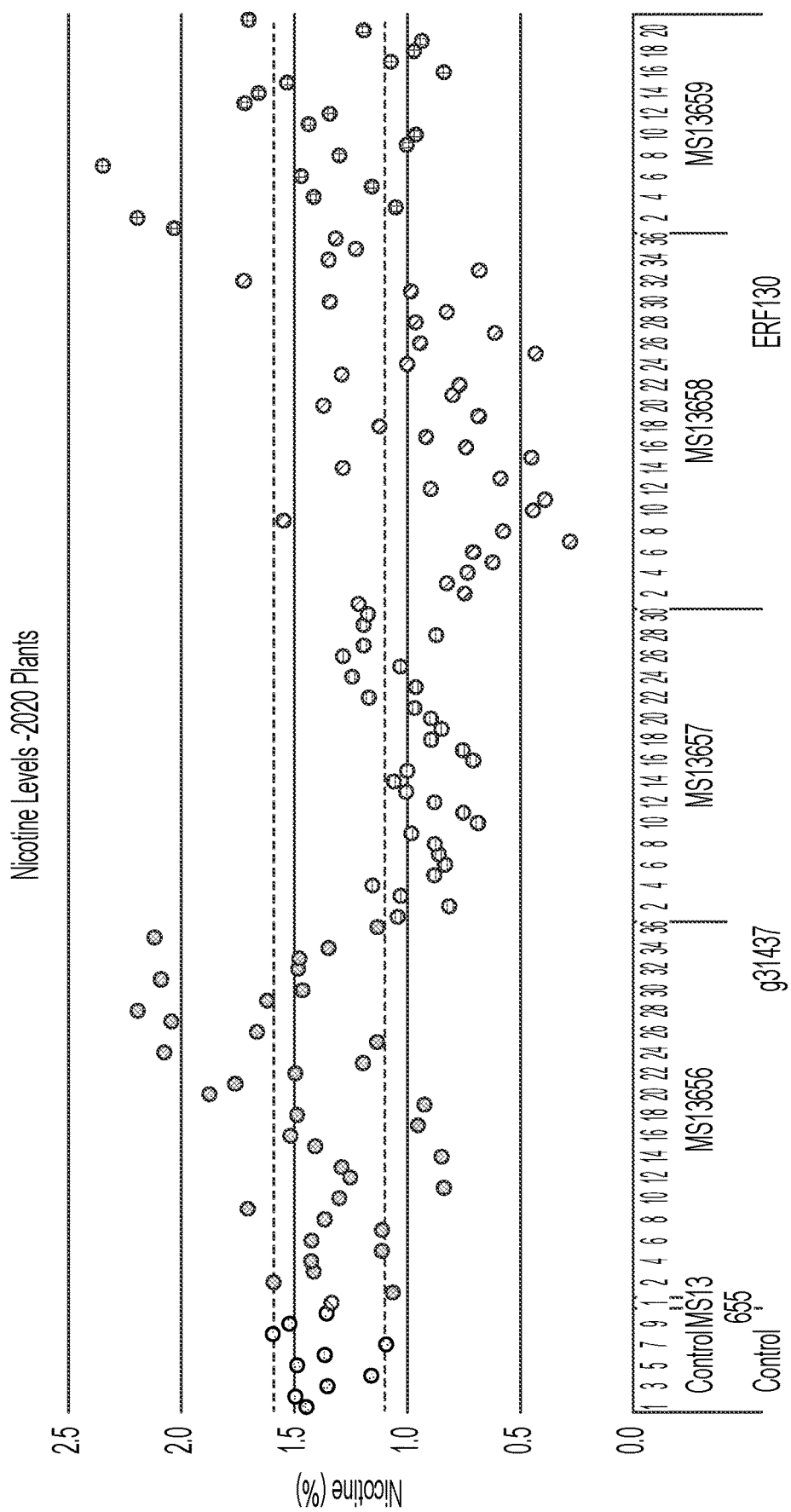
FIG. 17: Nicotine levels from greenhouse collected samples of NIC1b-ERF mutant plants compared to control TN90. Plants were grown in the 2019 field season and sampled in 2020. MS13655, MS13656, and MS13657 are exemplary mutations in g31437 (NCG17). MS13658 and MS13659 are exemplary mutations in ERF130. Dashed lines represent the top and bottom of the wild-type TN90 range. Nicotine level is shown as a percentage of dry weight. Dashed lines represent the top and bottom of the wild-type TN90 range. Nicotine level is shown as a percentage of dry weight.
Figure 18:
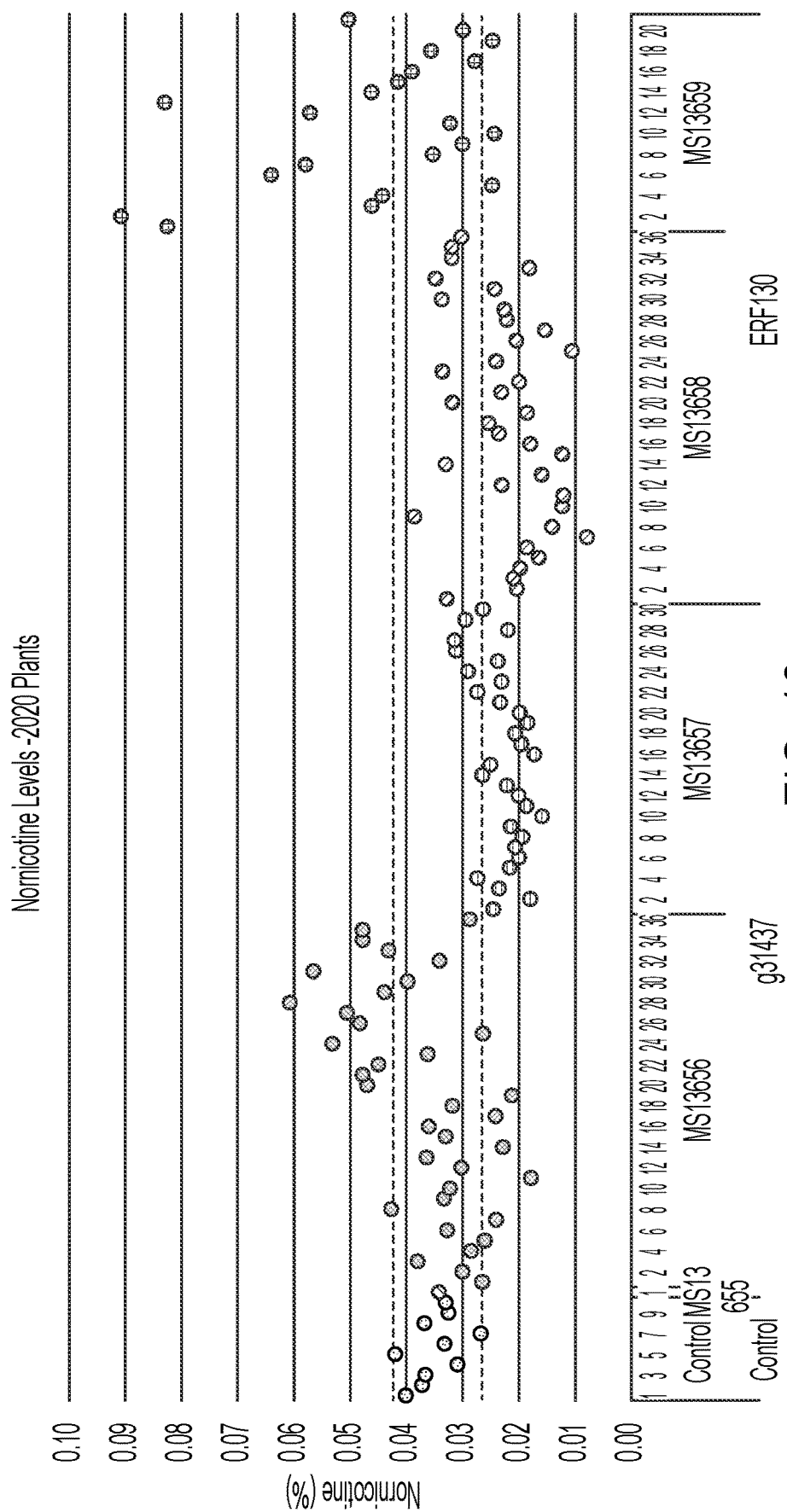
FIG. 18: Nornicotine levels from greenhouse collected samples of NIC1b-ERF mutant plants compared to control TN90. Plants were grown in the 2019 field season and sampled in 2020. MS13655, MS13656, and MS13657 are exemplary mutations in g31437 (NCG17). MS13658 and MS13659 are exemplary mutations in ERF130. Dashed lines represent the top and bottom of the wild-type TN90 range. Nicotine level is shown as a percentage of dry weight. Dashed lines represent the top and bottom of the wild-type TN90 range. Nornicotine level is shown as a percentage of dry weight.
Figure 19:
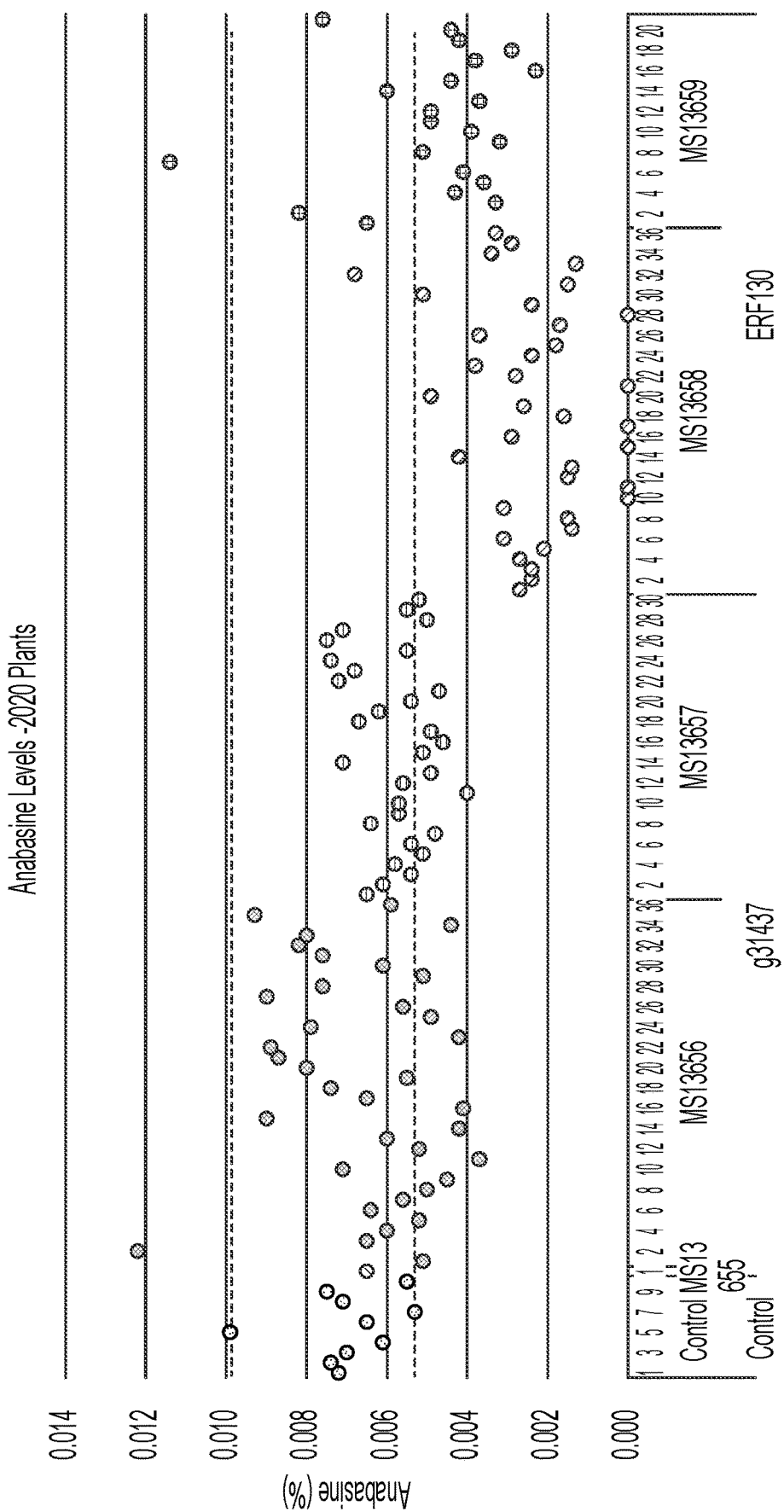
FIG. 19: Anabasine levels from greenhouse collected samples of NIC1b-ERF mutant plants compared to control TN90. Plants were grown in the 2019 field season and sampled in 2020. MS13655, MS13656, and MS13657 are exemplary mutations in g31437 (NCG17). MS13658 and MS13659 are exemplary mutations in ERF130. Dashed lines represent the top and bottom of the wild-type TN90 range. Nicotine level is shown as a percentage of dry weight. Dashed lines represent the top and bottom of the wild-type TN90 range. Anabasine level is shown as a percentage of dry weight.
Figure 20:
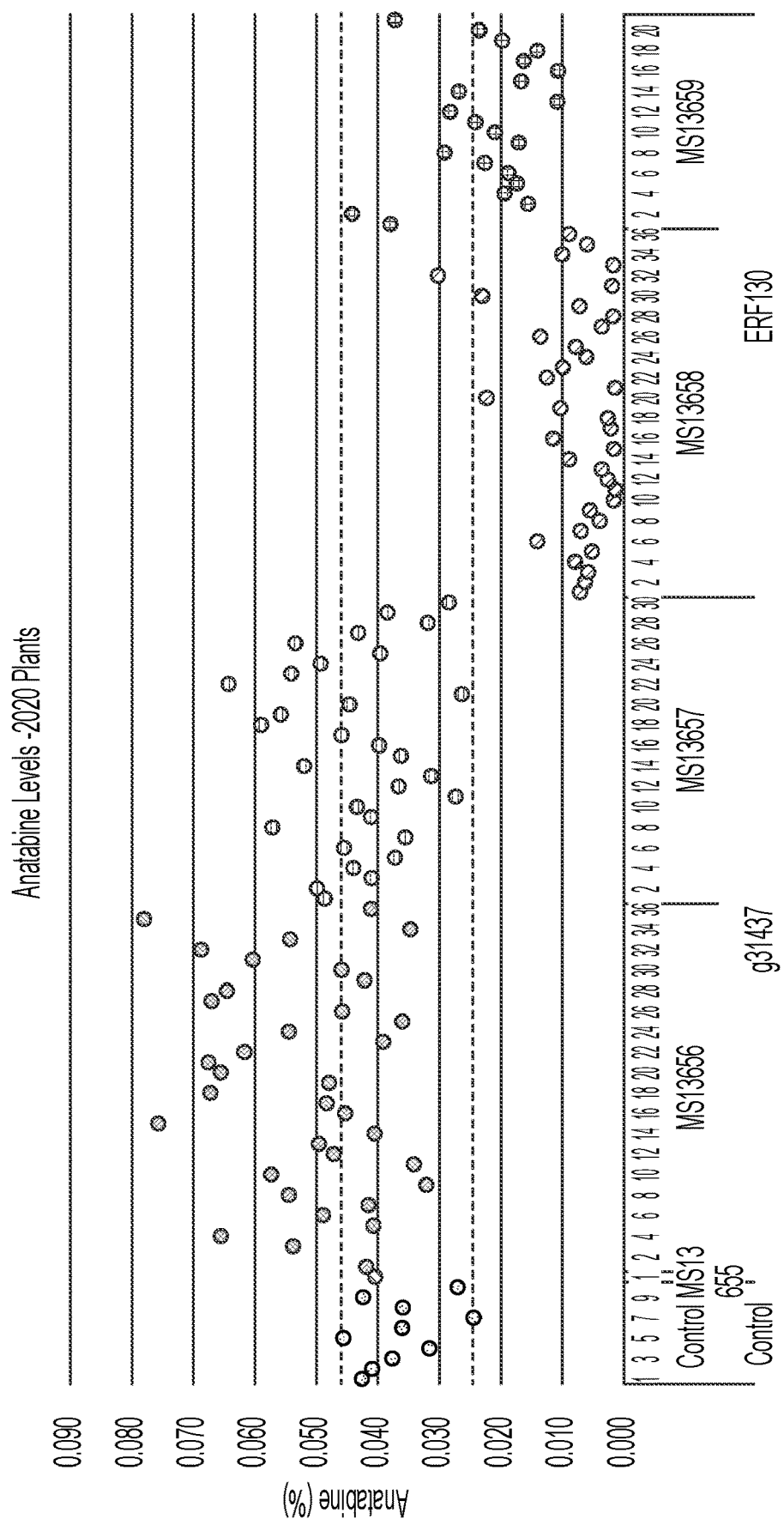
FIG. 20: Anatabine levels from greenhouse collected samples of NIC1b-ERF mutant plants compared to control TN90. Plants were grown in the 2019 field season and sampled in 2020. MS13655, MS13656, and MS13657 are exemplary mutations in g31437 (NCG17). MS13658 and MS13659 are exemplary mutations in ERF130. Dashed lines represent the top and bottom of the wild-type TN90 range. Nicotine level is shown as a percentage of dry weight. Dashed lines represent the top and bottom of the wild-type TN90 range. Anatabine level is shown as a percentage of dry weight.

The overexpression of both ERF101 and ERFnew are also tested separately. ERF101 overexpression results enhanced expression of PMT and QPT and therefore nicotine and anatabine levels are increased (FIGS. 11A and 11B). ERFnew overexpression also results enhanced expression of PMT and QPT and therefore nicotine, nornicotine, and anatabine levels are increased (FIGS. 12A and 12B, ERFnew is labeled as ERF17delN), which observation supports a role for ERFnew in nicotine production and is consistent with the artificial microRNA-based suppression data observed in FIG. 4.

Example 14: Generation and Evaluation of EMS Generated NIC1b-ERF Mutant Plants

A previously created EMS population of tobacco seeds in a TN90 burley background is screened for mutations in genes within the NIC1b region. The EMS population was created using standard techniques. Candidate plants are identified by using sanger sequencing to identify point mutations in genes of interest in the $M_2$ generation by analyzing pooled DNA from 8 plants per sample. Exemplary mutations are summarized in Table 22.

Plant morphology and alkaloid levels are analyzed in the $M_2$ generation in candidate plants using methods described above. Alkaloid levels are analyzed in candidate plants by sampling leaves from plants two-weeks post topping and measuring the amounts of nicotine, nornicotine, anabasine, and anatabine as a percent of dry weight. Measurements representing the 2018 and 2019 growing season (sampled in 2019 and 2020, respectively) are shown in FIGS. 13 to 20. Sampling statistics for exemplary mutations in NCG1 and ERF16 are shown in Table 23 demonstrating statistically significant reductions in alkaloid levels compared to wild-type TN90 grown at the same time. Sampling statistics for two exemplary mutations in NCG15 are shown in Table 24 demonstrating that the mutation of the MS13657 line produces a significant reduction in alkaloid levels compared to wild-type TN90 grown at the same time. Seeds for candidate plants demonstrating desired alkaloid levels and wild-type morphology are selected for further breeding.

TABLE 5

Additional genes from the Nic1b Region or its vicinity on chromosome 7. The start and stop genomic positions are provided based on a reference TN90 genome. Sequence identification numbers (SEQ ID Nos.) are provided for the genomic coding DNA sequences (including intron(s) if applicable), cDNA sequences, and protein or other encoded RNA sequences for each of the genes.

| Gene Name | Chr | Start | Stop | Gene Description | gDNA | cDNA | Protein or RNA Product |
|---|---|---|---|---|---|---|---|
| Nt_Nic1_ncRNA1 | Chr7 | 8227 8764 | 8228 1886 | *Nicotiana tabacum* uncharacterized LOC107772192, ncRNA | 152 | 157 | 162 to 179 |
| ERF101 (g31383) | Chr7 | 7926 8220 | 7926 8714 | *Nicotiana tabacum* ethylene-responsive transcription factor | 202 | 204 | 206 |
| ERF110 (PB19937) | Chr7 | 8071 9601 | 8071 8555 | *Nicotiana tabacum* ethylene-responsive transcription factor | 203 | 205 | 207 |
| ERF16 | Chr7 | 8173 6466 | 8173 7137 | *Nicotiana tabacum* ethylene-responsive transcription factor 2-like | 153 | 158 | 180 |
| ERF130 | Chr7 | 8173 0582 | 8173 1212 | *Nicotiana tabacum* ethylene-responsive transcription factor 2-like, (LOC107802085) | 154 | 159 | 181 |

TABLE 5-continued

Additional genes from the Nic1b Region or its vicinity on chromosome 7. The start and stop genomic positions are provided based on a reference TN90 genome. Sequence identification numbers (SEQ ID Nos.) are provided for the genomic coding DNA sequences (including intron(s) if applicable), cDNA sequences, and protein or other encoded RNA sequences for each of the genes.

| Gene Name | Chr | Start | Stop | Gene Description | gDNA | cDNA | Protein or RNA Product |
|---|---|---|---|---|---|---|---|
| g32081 | Chr7 | 1155 7571 | 1156 1989 | *Nicotiana tabacum* beta-glucosidase 18-like (LOC107766388), transcript variant X1, mRNA | 155 | 160 | 182 |
| g32082 | Chr7 | 1156 2016 | 1156 4044 | *Nicotiana tabacum* beta-glucosidase 18-like (LOC107766388), transcript variant X2, mRNA | 156 | 161 | 183 |

TABLE 6

Transcription factors from chromosome 7 exhibiting differential expression between normal-alkaloid and reduced-alkaloid tobacco lines. The start and stop genomic positions are provided based on a reference TN90 genome. Sequence identification numbers (SEQ ID Nos.) are provided for the genomic coding DNA sequences (including intron(s) if applicable), cDNA sequences, and protein or other encoded RNA sequences for each of the genes.

| Gene Name | Chr | Start | Stop | Gene Description | gDNA | cDNA | Protein/ Encoded Product |
|---|---|---|---|---|---|---|---|
| g33110 | Chr7 | 158878946 | 158879671 | A0A1J6KC41_NICAT, Ethylene-responsive transcription factor 1b | 184 | 187 | 190 |
| g33196 | Chr7 | 162789270 | 162791192 | G7LHR2_MEDTR, Basic helix loop helix (BHLH) family transcription factor | 185 | 188 | 191 |
| g31395 | Chr7 | 79994750 | 79997309 | Myb family transcription factor | 186 | 189 | 192 |

TABLE 7

A set of $T_0$ transformants demonstrates that suppressing individual Nic1b_ERFs via artificial microRNA reduces nicotine in the HI BU21 background (i.e., t-HI Burley 21, a nic2 single mutant). A MIR6147 backbone is used for artificial microRNA ("a1MIR6147"). The column "% ConV" represents percent conversion from nicotine to nornicotine. The average nicotine level from multiple $T_0$ GUS control transformants is used to determine the relative nicotine levels in each of the individual Nic1b_ERF amiRNA $T_0$ transformants. Plants are topped 16 weeks after initial potting with leaf samples collected 2 weeks later for alkaloid analysis.

| $T_0$ Plant ID | Variety | Gene/ Construct | Nicocotine | Nornitine | Anabasine | Anatabine | Total Alks | % ConV | % Nicotine Relative to Control | Average % Nicotine | Average % Nicotine Relative to Control |
|---|---|---|---|---|---|---|---|---|---|---|---|
| 18GH 1968 | t-HI Burley 21 | ag-aMIR6147_g31420 | 1.567 | 0.032 | 0.006 | 0.036 | 1.641 | 2.0% | 50% | | |
| 18GH 1972 | t-HI Burley 21 | ag-aMIR6147 g31420 | 1.583 | 0.029 | 0.007 | 0.041 | 1.661 | 1.8% | 50% | 1.64 | 52% |
| 18GH 1973 | t-HI Burley 21 | ag-aMIR6147 g31420 | 1.780 | 0.036 | 0.008 | 0.036 | 1.860 | 2.0% | 56% | | |
| 18GH 1993 | t-HI Burley 21 | ag-aMIR6147 g31436 | 2.281 | 0.053 | 0.010 | 0.044 | 2.386 | 2.3% | 72% | | |
| 18GH 1997 | t-HI Burley 21 | ag-aMIR6147_g31436 | 2.279 | 0.049 | 0.010 | 0.045 | 2.383 | 2.1% | 72% | 2.27 | 72% |

TABLE 7-continued

A set of T₀ transformants demonstrates that suppressing individual Nic1b_ERFs via artificial microRNA reduces nicotine in the HI BU21 background (i.e., t-HI Burley 21, a nic2 single mutant). A MIR6147 backbone is used for artificial microRNA ("a1MIR6147"). The column "% ConV" represents percent conversion from nicotine to nornicotine. The average nicotine level from multiple T₀ GUS control transformants is used to determine the relative nicotine levels in each of the individual Nic1b_ERF amiRNA T₀ transformants. Plants are topped 16 weeks after initial potting with leaf samples collected 2 weeks later for alkaloid analysis.

| T₀ Plant ID | Variety | Gene/ Construct | Nicocotine | Nornitine | Anabasine | Anatabine | Total Alks | % Conv | % Nicotine Relative to Control | Average % Nicotine | Average % Nicotine Relative to Control |
|---|---|---|---|---|---|---|---|---|---|---|---|
| 18GH 1998 | t-HI Burley 21 | ag-aMIR6147_g31436 | 2.265 | 0.051 | 0.009 | 0.045 | 2.370 | 2.2% | 72% | | |
| 18GH 1981 | t-HI Burley 21 | ag-aMIR6147_g31430 | 3.237 | 0.085 | 0.014 | 0.063 | 3.400 | 2.60% | 102% | | |
| 18GH 1984 | t-HI Burley 21 | ag-aMIR6147_g31430 | 2.561 | 0.057 | 0.009 | 0.030 | 2.656 | 2.20% | 81% | | |
| 18GH 1985 | t-HI Burley 21 | ag-aMIR6147_g31430 | 2.800 | 0.069 | 0.013 | 0.055 | 2.937 | 2.40% | 89% | 2.83 | 89% |
| 18GH 1986 | t-HI Burley 21 | ag-aMIR6147_g31430 | 2.813 | 0.070 | 0.013 | 0.055 | 2.951 | 2.40% | 89% | | |
| 18GH 1987 | t-HI Burley 21 | ag-aMIR6147_g31430 | 2.722 | 0.064 | 0.012 | 0.050 | 2.848 | 2.30% | 86% | | |
| 18GH 1989 | t-HI Burley 21 | ag-aMIR6147_g31435 | 2.643 | 0.065 | 0.013 | 0.057 | 2.777 | 2.40% | 84% | | |
| 18GH 1990 | t-HI Burley 21 | ag-aMIR6147_g31435 | 3.494 | 0.090 | 0.016 | 0.058 | 3.658 | 2.50% | 110% | 2.92 | 92% |
| 18GH 1992 | t-HI Burley 21 | ag-aMIR6147_g31435 | 2.628 | 0.055 | 0.012 | 0.049 | 2.744 | 2.00% | 83% | | |
| 18GH 2001 | t-HI Burley 21 | ag-aMIR6147_g31437 | 3.280 | 0.089 | 0.015 | 0.074 | 3.458 | 2.60% | 104% | 2.94 | 93% |
| 18GH 2002 | t-HI Burley 21 | ag-aMIR6147_g31437 | 2.958 | 0.071 | 0.011 | 0.052 | 3.092 | 2.40% | 93% | | |
| 18GH 2003 | t-HI Burley 21 | ag-aMIR6147_g31437 | 2.836 | 0.247 | 0.014 | 0.077 | 3.173 | 8.00% | 90% | | |
| 18GH 2006 | t-HI Burley 21 | ag-aMIR6147_g31437 | 2.770 | 0.058 | 0.013 | 0.064 | 2.904 | 2.00% | 88% | | |
| 18GH 2007 | t-HI Burley 21 | ag-aMIR6147_g31437 | 3.046 | 0.079 | 0.015 | 0.064 | 3.204 | 2.50% | 96% | | |
| 18GH 2008 | t-HI Burley 21 | ag-aMIR6147_g31437 | 2.752 | 0.058 | 0.012 | 0.062 | 2.884 | 2.10% | 87% | | |
| 18GH 2014 | t-HI Burley 21 | ag-GUS-amiR6147 | 3.524 | 0.101 | 0.013 | 0.043 | 3.682 | 2.8% | | | |
| 18GH 2015 | t-HI Burley 21 | ag-GUS-amiR6147 | 2.998 | 0.075 | 0.013 | 0.053 | 3.138 | 2.4% | 100% | 3.16 | 100% |
| 18GH 2016 | t-HI Burley 21 | ag-GUS-amiR6147 | 2.924 | 0.091 | 0.013 | 0.056 | 3.084 | 3.0% | | | |
| 18GH 2017 | t-HI Burley 21 | ag-GUS-amiR6147 | 3.208 | 0.084 | 0.013 | 0.054 | 3.358 | 2.5% | | | |

TABLE 8

A second set of T₀ plants transformed with artificial microRNAs targeting individual Nic1b_ERFs in the HI BU21 background (i.e., t-HI Burley 21, a nic2 single mutant). This set of T₀ plants are topped 15 weeks after initial potting with leaf samples collected 2 weeks later for alkaloid analysis. Compared to the plants in TABLE 7, these plants are topped one week earlier which may result in a lack of consistency in the control plants (nicotine level ranges 1.52% and 2.78%) and thus the amiRNA plants fail to show consistent nicotine reduction. The same set of amiRNA constructs as in TABLE 7 are used. The column "% Conv" represents percent conversion from nicotine to nornicotine. The average nicotine level from multiple T₀ GUS control transformants is used to determine the relative nicotine levels in each of the individual Nic1b_ ERF amiRNA T₀ transformants.

| T₀ Plant ID | Variety | Gene/ Construct | Nicotine | Nornicotine | Anabasine | Anatabine | Total Alks | % Conv | Average % Nicotine in Control | % Nicotine Relative to Control |
|---|---|---|---|---|---|---|---|---|---|---|
| 18GH 2052 | t-HI Burley 21 | ag-aMIR6147_g31420 | 2.143 | 0.047 | 0.010 | 0.051 | 2.251 | 2.15% | | 108% |
| 18GH 2058 | t-HI Burley 21 | ag-aMIR6147_g31420 | 3.870 | 0.098 | 0.015 | 0.056 | 4.038 | 2.46% | | 196% |
| 18GH 2059 | t-HI Burley 21 | ag-aMIR6147_g31420 | 1.428 | 0.028 | 0.006 | 0.037 | 1.499 | 1.94% | | 72% |
| 18GH 2062 | t-HI Burley 21 | ag-aMIR6147_g31430 | 2.300 | 0.051 | 0.010 | 0.049 | 2.410 | 2.18% | | 116% |
| 18GH 2063 | t-HI Burley 21 | ag-aMIR6147_g31430 | 2.398 | 0.051 | 0.011 | 0.054 | 2.514 | 2.08% | | 121% |
| 18GH 2064 | t-HI Burley 21 | ag-aMIR6147_g31430 | 2.019 | 0.045 | 0.009 | 0.045 | 2.118 | 2.19% | | 102% |
| 18GH 2065 | t-HI Burley 21 | ag-aMIR6147_g31430 | 1.978 | 0.044 | 0.009 | 0.045 | 2.077 | 2.19% | | 100% |
| 18GH 2066 | t-HI Burley 21 | ag-aMIR6147_g31430 | 1.570 | 0.033 | 0.007 | 0.042 | 1.652 | 2.06% | | 79% |
| 18GH 2067 | t-HI Burley 21 | ag-aMIR6147_g31430 | 2.211 | 0.065 | 0.010 | 0.052 | 2.337 | 2.85% | | 112% |
| 18GH 2069 | t-HI Burley 21 | ag-aMIR6147_g31435 | 2.875 | 0.065 | 0.012 | 0.056 | 3.009 | 2.22% | | 146% |
| 18GH 2070 | t-HI Burley 21 | ag-aMIR6147_g31435 | 2.764 | 0 060 | 0.012 | 0.057 | 2.892 | 2.12% | | 140% |
| 18GH 2071 | t-HI Burley 21 | ag-aMIR6147_g31435 | 2.698 | 0.061 | 0.012 | 0.062 | 2.832 | 2.23% | | 137% |
| 18GH 2072 | t-HI Burley 21 | ag-aMIR6147_g31435 | 1.968 | 0.043 | 0.009 | 0.044 | 2.064 | 2.15% | | 100% |
| 18GH 2074 | t-HI Burley 21 | ag-aMIR6147_g31435 | 2.890 | 0.058 | 0.011 | 0.058 | 3.017 | 1.97% | | 146% |
| 18GH 2075 | t-HI Burley 21 | ag-aMIR6147_g31435 | 3.381 | 0.070 | 0.010 | 0.039 | 3.499 | 2.02% | | 171% |
| 18GH 2078 | t-HI Burley 21 | ag-aMIR6147_g31436 | 2.450 | 0.050 | 0.011 | 0.053 | 2.564 | 2.01% | | 124% |
| 18GH 2082 | t-HI Burley 21 | ag-aMIR6147 g31437 | 1.986 | 0.046 | 0.009 | 0.045 | 2.086 | 2.25% | | 101% |
| 18GH 2084 | t-HI Burley 21 | ag-GUS-amiR6147 | 1.539 | 0.036 | 0.008 | 0.034 | 1.616 | 2.28% | 1.975 | 100% |
| 18GH 2085 | t-HI Burley 21 | ag-GUS-amiR6147 | 2.060 | 0.050 | 0.009 | 0.046 | 2.165 | 2.38% | | |
| 18GH 2086 | t-HI Burley 21 | ag-GUS-amiR6147 | 1.520 | 0.035 | 0.007 | 0.033 | 1.594 | 2.23% | | |
| 18GH 2087 | t-HI Burley 21 | ag-GUS-amiR6147 | 2.782 | 0.064 | 0.011 | 0.040 | 2.896 | 2.23% | | |

TABLE 8-continued

A second set of $T_0$ plants transformed with artificial microRNAs targeting individual Nic1b_ERFs in the HI BU21 background (i.e., t-HI Burley 21, a nic2 single mutant). This set of $T_0$ plants are topped 15 weeks after initial potting with leaf samples collected 2 weeks later for alkaloid analysis. Compared to the plants in TABLE 7, these plants are topped one week earlier which may result in a lack of consistency in the control plants (nicotine level ranges 1.52% and 2.78%) and thus the amiRNA plants fail to show consistent nicotine reduction. The same set of amiRNA constructs as in TABLE 7 are used. The column "% Conv" represents percent conversion from nicotine to nornicotine. The average nicotine level from multiple $T_0$ GUS control transformants is used to determine the relative nicotine levels in each of the individual Nic1b_ ERF amiRNA $T_0$ transformants.

| $T_0$ Plant ID | Variety | Gene/ Construct | Nicotine | Nornicotine | Anabasine | Anatabine | Total Alks | % Conv | Average % Nicotine in Control | % Nicotine Relative to Control |
|---|---|---|---|---|---|---|---|---|---|---|
| 18GH 2083 | t-NL Madole (PhPh) SRC | ag-aMIR6147_g31437 | 1.386 | 0.005 | 0.006 | 0.023 | 1.420 | 0.37% | | 69% |
| 18GH 2088 | t-NL Madole (PhPh) SRC | ag-GUS-amiR6147 | 2.003 | 0.006 | 0.007 | 0.033 | 2.049 | 0.30% | | 100% |

TABLE 9

A set of $T_0$ plants transformed with artificial microRNAs targeting individual Nic1b_ERFs in the t-NL Madole (PhPh) SRCbackground (i.e., Narrow Leaf Madole with black shank resistance and mutations in three nicotine demethylase genes for reduced nornicotine). This set of $T_0$ plants are topped 18 weeks after initial potting with leaf samples collected 2 weeks later for alkaloid analysis. Compared to the plants in TABLE 7, these plants are topped two weeks later. No consistent nicotine reduction is seen in this set of plants, which indicates that the nic2 single mutant provides a more sensitized background for evaluating each individual Nic1b ERF's role in nicotine regulation compared to the wild-type background (e.g., t-NL Madole (PhPh) SRC). The same set of amiRNA constructs as in TABLE 7 are used. The column "% Cony" represents percent conversion from nicotine to nornicotine. The average nicotine level from multiple $T_0$ GUS control transformants is used to determine the relative nicotine levels in each of the individual Nic1_ERF amiRNA $T_0$ transformants.

| $T_0$ Plant ID | Variety | Gene/ Construct | Nicotine | Nornicotine | Anabasine | Anatabine | Total Alks | % Conv | Average % Nicotine in Control | % Nicotine Relative to Control |
|---|---|---|---|---|---|---|---|---|---|---|
| 18GH 1819 | t-NL Madole (PhPh) SRC | ag-aMIR6147_g31420 | 2.975 | 0.016 | 0.010 | 0.043 | 3.044 | 0.52% | | 129% |
| 18GH 1821 | t-NL Madole (PhPh) SRC | ag-aMIR6147_g31420 | 2.480 | 0.009 | 0.009 | 0.048 | 2.546 | 0.36% | | 108% |
| 18GH 1822 | t-NL Madole (PhPh) SRC | ag-aMIR6147_g31420 | 2.294 | 0.012 | 0.009 | 0.049 | 2.365 | 0.51% | | 100% |
| 18GH 1825 | t-NL Madole (PhPh) SRC | ag-aMIR6147_g31420 | 2.258 | 0.009 | 0.008 | 0.044 | 2.318 | 0.38% | | 98% |
| 18GH 1830 | t-NL Madole (PhPh) SRC | ag-aMIR6147_g31430 | 2.487 | 0.013 | 0.010 | 0.054 | 2.564 | 0.52% | | 108% |
| 18GH 1834 | t-NL Madole (PhPh) SRC | ag-aMIR6147_g31430 | 2.482 | 0.009 | 0.010 | 0.052 | 2.554 | 0.37% | | 108% |
| 18GH 1835 | t-NL Madole (PhPh)SRC | ag-aMIR6147_g31430 | 1.944 | 0.007 | 0.007 | 0.038 | 1.996 | 0.34% | | 84% |
| 18GH 1836 | t-NL Madole (PhPh) SRC | ag-aMIR6147_g31430 | 2.111 | 0.009 | 0.008 | 0.040 | 2.168 | 0.42% | | 92% |
| 18GH 1837 | t-NL Madole (PhPh) SRC | ag-aMIR6147_g31430 | 2.093 | 0.010 | 0.008 | 0.034 | 2.145 | 0.48% | | 91% |
| 18GH 1838 | t-NL Madole (PhPh) SRC | ag-aMIR6147_g31435 | 2.701 | 0.012 | 0.010 | 0.050 | 2.772 | 0.43% | | 117% |
| 18GH 1839 | t-NL Madole (PhPh) SRC | ag-aMIR6147_g31435 | 2.035 | 0.010 | 0.007 | 0.033 | 2.086 | 0.50% | | 88% |

TABLE 9-continued

A set of T₀ plants transformed with artificial microRNAs targeting individual Nic1b_ERFs in the t-NL Madole (PhPh) SRCbackground (i.e., Narrow Leaf Madole with black shank resistance and mutations in three nicotine demethylase genes for reduced nornicotine). This set of T₀ plants are topped 18 weeks after initial potting with leaf samples collected 2 weeks later for alkaloid analysis. Compared to the plants in TABLE 7, these plants are topped two weeks later. No consistent nicotine reduction is seen in this set of plants, which indicates that the nic2 single mutant provides a more sensitized background for evaluating each individual Nic1b ERF's role in nicotine regulation compared to the wild-type background (e.g., t-NL Madole (PhPh) SRC). The same set of amiRNA constructs as in TABLE 7 are used. The column "% Conv" represents percent conversion from nicotine to nornicotine. The average nicotine level from multiple T₀ GUS control transformants is used to determine the relative nicotine levels in each of the individual Nic1_ERF amiRNA T₀ transformants.

| T₀ Plant ID | Gene/ Variety | Construct | Nicotine | Nornicotine | Anabasine | Anatabine | Total Alks | % Conv | Average % Nicotine in Control | % Nicotine Relative to Control |
|---|---|---|---|---|---|---|---|---|---|---|
| 18GH 1840 | t-NL Madole (PhPh) SRC | ag-aMIR6147_g31435 | 2.166 | 0.008 | 0.007 | 0.032 | 2.213 | 0.35% | | 94% |
| 18GH 1841 | t-NL Madole (PhPh) SRC | ag-aMIR6147_g31435 | 3.534 | 0.013 | 0.010 | 0.049 | 3.606 | 0.37% | | 153% |
| 18GH 1842 | t-NL Madole (PhPh) SRC | ag-aMIR6147_g31435 | 2.271 | 0.010 | 0.008 | 0.038 | 2.326 | 0.43% | | 99% |
| 18GH 1843 | t-NL Madole (PhPh) SRC | ag-aMIR6147_g31435 | 2.891 | 0.013 | 0.011 | 0.051 | 2.966 | 0.43% | | 126% |
| 18GH 1844 | t-NL Madole (PhPh) SRC | ag-aMIR6147_g31435 | 2.249 | 0.010 | 0.008 | 0.036 | 2.302 | 0.44% | | 98% |
| 18GH 1847 | t-NL Madole (PhPh) SRC | ag-aMIR6147_g31437 | 2.349 | 0.011 | 0.009 | 0.042 | 2.411 | 0.45% | | 102% |
| 18GH 1848 | t-NL Madole (PhPh) SRC | ag-aMIR6147_g31437 | 2.437 | 0.013 | 0.009 | 0.049 | 2.508 | 0.51% | | 106% |
| 18GH 1849 | t-NL Madole (PhPh) SRC | ag-aMIR6147_g31437 | 2.714 | 0.013 | 0.011 | 0.056 | 2.793 | 0.46% | | 118% |
| 18GH 1850 | t-NL Madole (PhPh) SRC | ag-aMIR6147_g31437 | 2.155 | 0.007 | 0.008 | 0.037 | 2.207 | 0.31% | | 94% |
| 18GH 1853 | t-NL Madole (PhPh) SRC | ag-aMIR6147_g31437 | 2.340 | 0.011 | 0.008 | 0.043 | 2.402 | 0.46% | | 102% |
| 18GH 1902 | t-NL Madole (PhPh) SRC | ag-GUS-amiR6147 | 2.493 | 0.009 | 0.008 | 0.046 | 2.556 | 0.35% | 2.304 | 100% |
| 18GH 1903 | t-NL Madole (PhPh) SRC | ag-GUS-amiR6147 | 2.132 | 0.013 | 0.008 | 0.041 | 2.194 | 0.60% | | |
| 18GH 1905 | t-NL Madole (PhPh) SRC | ag-GUS-amiR6147 | 2.286 | 0.012 | 0.009 | 0.042 | 2.348 | 0.50% | | |

TABLE 10

Gene expression in selected Nic1b_ERF artificial microRNA T0 transformants. "% Exp" refers to percent expression level relative to average expression level based on multiple control T₀ transformants. Nicotine reduction correlates with suppression of the intended Nic1b_ERF target and reduced expression of multiple nicotine biosynthetic genes (PMT1a, BBLa, A622, ODC, MATE2, QPT2_2). All transformants are in the t-HI Burley 21 background. ND means not determined.

| T₀ Plant ID | Gene/ Construct | % Nicotine Relative to Control | % Exp of g31420 | % Exp of g31436 | % Exp of PMT1a | % Exp of BBLa | % Exp of A622 | % Exp of ODC | % Exp of MATE2 | % Exp of QPT2_2 | % Exp of g31430 | Kanamycin Approx ratios |
|---|---|---|---|---|---|---|---|---|---|---|---|---|
| 18GH 1968 | ag-aMIR6147-g31420 | 50% | 1.23% | ND | 39.66% | 52.60% | 51.70% | 59.50% | 40.80% | 85.40% | 79.90% | 3:1 |

TABLE 10-continued

Gene expression in selected Nic1b_ERF artificial microRNA T0 transformants. "% Exp" refers to percent expression level relative to average expression level based on multiple control $T_0$ transformants. Nicotine reduction correlates with suppression of the intended Nic1b_ERF target and reduced expression of multiple nicotine biosynthetic genes (PMT1a, BBLa, A622, ODC, MATE2, QPT2_2). All transformants are in the t-HI Burley 21 background. ND means not determined.

| $T_0$ Plant ID | Gene/ Construct | % Nicotine Relative to Control | % Exp of g31420 | % Exp of g31436 | % Exp of PMT1a | % Exp of BBLa | % Exp of A622 | % Exp of ODC | % Exp of MATE2 | % Exp of QPT2_2 | % Exp of g31430 | Kana- mycin Approx ratios |
|---|---|---|---|---|---|---|---|---|---|---|---|---|
| 18GH 1972 | ag- aMIR6147- g31420 | 50% | 0.88% | ND | 31.68% | 72.40% | 60.10% | 88.00% | 51.00% | 87.90% | 114.50% | 15:1 |
| 18GH 1973 | ag- aMIR6147- g31420 | 56% | ND | ND | ND | ND | ND | ND | ND | ND | ND | ND |
| 18GH 1993 | ag- aMIR6147- g31436 | 72% | ND | 36.20% | 18.53% | 29.60% | 29.40% | 41.00% | 43.50% | 40.70% | 43.80% | 7:1 |
| 18GH 1997 | ag- aMIR6147- g31436 | 72% | ND | 47.98% | 14.58% | 44.30% | 32.60% | 68.10% | 51.70% | 42.90% | 58.40% | 8:1 |
| 18GH 1998 | ag- aMIR6147- g31436 | 72% | ND | 57.59% | 41.16% | 52.40% | 52.00% | 95.80% | 80.20% | 88.80% | 106.00% | 3:1 |
| 18GH 2014 | ag-GUS- amiR6147 | 100% | 100.00% | 100.00% | 100.00% | 100.00% | 100.00% | 100.00% | 100.00% | 100.00% | 100.00% | ND |

TABLE 11

Selected ERF genes at or near Nic1b Region. The genomic coordinates of each ERF gene are shown as Start and Stop on Chromosome 7. The ERF nomenclature is based on Rushton et at., TOBFAC: the database of tobacco transcription factors, BMC Bioinformatics 2008, 9:53. The DNA sequence of each of the Nic1b_ERF is obtained from a TobFac data set, and used to probe a tobacco genome database to identify both annotated gene models, transcripts, and chromosome coordinates. Sequence identification numbers (SEQ ID Nos.) are provided for the genomic coding DNA sequences (including intron(s) if applicable), cDNA sequences, and polypeptide sequences for each of the genes.

| Nic1b_ ERF Genes | NCG Names | Gene Models | Start on Chromosome 7 | Stop on Chromosome 7 | SEQ ID (gDNA) | SEQ ID (cDNA) | SEQ ID (polypeptide) |
|---|---|---|---|---|---|---|---|
| ERF101 | | g31383 | 79268220 | 79268714 | 202 | 204 | 206 |
| ERF110 | | PB19937 | 80719601 | 80718555 | 203 | 205 | 207 |
| ERFnew | NCG1 | g31420 | 80937073 | 80937738 | 3 | 38 | 73 |
| ERF199 | NCG11 | g31430 | 81460624 | 81461723 | 13 | 48 | 83 |
| ERF19 | NCG12 | g31431 | 81636848 | 81635930 | 14 | 49 | 84 |
| ERF130 | | ERFX | 81730359 | 81731329 | 154 | 159 | 181 |
| ERF16 | | ERFY | 81737110 | 81736524 | 153 | 158 | 180 |
| ERF29 | NCG15 | g31435 | 81752464 | 81753174 | 17 | 52 | 87 |
| ERF210 | NCG16 | g31436 | 81848001 | 81849291 | 18 | 53 | 88 |
| ERF91L2 | NCG17 | g31437 | 81862817 | 81861981 | 19 | 54 | 89 |

TABLE 12

Selected ERF genes at or near Nic2 region. The genomic coordinates of each ERF gene are shown as Start and Stop on Chromosome 19. The ERF nomenclature is based on Rushton et al., TOBFAC: the database of tobacco transcription factors, *BMC Bioinformatics* 2008, 9: 53; Shoji et al., *Plant Cell*, (10): 3390-409 (2010); and Kajikawa et al.,, *Plant physiol*. 2017, 174: 999-1011. The DNA sequence of each of the Nic2_ERF is obtained from a TobFac data set or from the NCBI database, and used to probe a tobacco genome database to identify both annotated gene models, transcripts, and chromosome coordinates. Sequence identification numbers (SEQ ID Nos.) are provided for the genomic coding DNA sequences (including intron(s) if applicable), cDNA sequences, and polypeptide sequences for each of the genes.

| Nic2_ERF Genes | Start on Chromosome 19 | Stop on Chromosome 19 | SEQ ID (gDNA) | SEQ IN (cDNA) | SEQ ID (poly-peptide) |
|---|---|---|---|---|---|
| ERF189 | 148554599 | 148553901 | 208 | 215 | 222 |
| ERF179 | 148680850 | 148679678 | 209 | 216 | 223 |
| ERF17  | 148753080 | 148753607 | 210 | 217 | 224 |
| ERF168 | 148760173 | 148758997 | 211 | 218 | 225 |
| ERF115 | 148902094 | 148903201 | 212 | 219 | 226 |
| ERF104 | 148990254 | 148989572 | 213 | 220 | 227 |
| ERF221 | 149009545 | 149008422 | 214 | 221 | 228 |

TABLE 13

The overexpression of ERF 16, but not ERF130, the LA_associated region deleted in LA BU21 (i.e., SEQ ID No. 1, referenced as "Nic1bΔ" which contains no annotated gene, see Example 2), or g32081 (a beta-glucosidase 18-like gene) results in nicotine and total alkaloid increase in LA BU21. The control construct is listed as ag-45EV.

| GH ID | Total Variety | Gene | Nicotine | Nornicotine | Anabasine | Anatabine | Alks | Conversion | Average Nicotine (%) | Nicotine level relative to control |
|---|---|---|---|---|---|---|---|---|---|---|
| 18GH23 79 | t-LA Burley 21 | ag-45EV | 0.1306 | 0.0026 | 0.0013 | 0.0059 | 0.1404 | 2.0% | 0.143 | 100% |
| 18GH23 80 | t-LA Burley 21 | ag-45EV | 0.1372 | 0.0019 | 0.0013 | 0.0094 | 0.1498 | 1.4% | | |
| 18GH23 81 | t-LA Burley 21 | ag-45EV | 0.1198 | 0.0034 | 0.0009 | 0.0064 | 0.1305 | 2.8% | | |
| 18GH24 33 | t-LA Burley 21 | ag-45EV | 0.187 | 0.0022 | 0.0009 | 0.0078 | 0.1979 | 1.2% | | |
| 18GH24 34 | t-LA Burley 21 | ag-45EV | 0.1397 | 0.0018 | 0.0008 | 0.0058 | 0.1481 | 1.3% | | |
| 18GH23 82 | t-LA Burley 21 | ag-ERF130 | 0.1351 | 0.0017 | 0.001 | 0.0065 | 0.1443 | 1.2% | 0.148 | 104% |
| 18GH23 83 | t-LA Burley 21 | ag-ERF130 | 0.1242 | 0.0027 | 0 | 0.0053 | 0.1322 | 2.1% | | |
| 18GH23 84 | t-LA Burley 21 | ag-ERF130 | 0.1923 | 0.0028 | 0.0016 | 0.0103 | 0.207 | 1.4% | | |
| 18GH23 85 | t-LA Burley 21 | ag-ERF130 | 0.1794 | 0.0043 | 0.0014 | 0.0091 | 0.1942 | 2.3% | | |
| 18GH23 86 | t-LA Burley 21 | ag-ERF130 | 0.11 | 0.0014 | 0.0007 | 0.0052 | 0.1173 | 1.3% | | |
| 18GH24 00 | t-LA Burley 21 | ag-Nic1bΔ | 0.1297 | 0.0047 | 0.001 | 0.0089 | 0.1443 | 3.5% | 0.139 | 97% |
| 18GH24 01 | t-LA Burley 21 | ag-Nic1bΔ | 0.1196 | 0.0018 | 0.0007 | 0.0059 | 0.128 | 1.5% | | |
| 18GH24 02 | t-LA Burley 21 | ag-Nic1bΔ | 0.129 | 0.0019 | 0.0009 | 0.007 | 0.1388 | 1.5% | | |

TABLE 13-continued

The overexpression of ERF 16, but not ERF130, the LA_associated region deleted in LA BU21 (i.e., SEQ ID No. 1, referenced as "Nic1bΔ" which contains no annotated gene, see Example 2), or g32081 (a beta-glucosidase 18-like gene) results in nicotine and total alkaloid increase in LA BU21. The control construct is listed as ag-45EV.

| GH ID | Total Variety | Gene | Alkaloids (%) | | | | | | Average Nicotine (%) | Nicotine level relative to control |
| --- | --- | --- | --- | --- | --- | --- | --- | --- | --- | --- |
| | | | Nicotine | Nornicotine | Anabasine | Anatabine | Alks | Conversion | | |
| 18GH24 03 | t-LA Burley 21 | ag-Nic1bΔ | 0.1771 | 0.0022 | 0.0012 | 0.0101 | 0.1906 | 1.2% | | |
| 18GH24 04 | t-LA Burley 21 | ag-Nic1bΔ | 0.1393 | 0.0016 | 0.0009 | 0.0066 | 0.1484 | 1.1% | | |
| 18GH24 29 | t-LA Burley 21 | ag-g32081 | 0.1981 | 0.0028 | 0.0016 | 0.0086 | 0.2111 | 1.4% | 0.155 | 108% |
| 18GH24 30 | t-LA Burley 21 | ag-g32081 | 0.1511 | 0.0024 | 0.0013 | 0.0079 | 0.1627 | 1.6% | | |
| 18GH24 31 | t-LA Burley 21 | ag-g32081 | 0.1586 | 0.0023 | 0.0013 | 0.0067 | 0.1689 | 1.4% | | |
| 18GH24 32 | t-LA Burley 21 | ag-g32081 | 0.1106 | 0.0017 | 0.0012 | 0.0061 | 0.1196 | 1.5% | | |
| 18GH24 44 | t-LA Burley 21 | ag-ERF16 | 0.4085 | 0.0066 | 0.0025 | 0.0256 | 0.4432 | 1.6% | 0.252 | 176% |
| 18GH24 45 | t-LA Burley 21 | ag-ERF16 | 0.1733 | 0.0026 | 0.0012 | 0.0081 | 0.1852 | 1.5% | | |
| 18GH24 46 | t-LA Burley 21 | ag-ERF16 | 0.2248 | 0.0029 | 0.0016 | 0.0103 | 0.2396 | 1.3% | | |
| 18GH24 47 | t-LA Burley 21 | ag-ERF16 | 0.1604 | 0.002 | 0.0013 | 0.0074 | 0.1711 | 1.2% | | |
| 18GH24 48 | t-LA Burley 21 | ag-ERF16 | 0.319 | 0.0045 | 0.0018 | 0.0182 | 0.3435 | 1.4% | | |
| 18GH24 49 | t-LA Burley 21 | ag-ERF16 | 0.2257 | 0.0027 | 0.0015 | 0.0105 | 0.2404 | 1.2% | | |

TABLE 14

Summary of hairy root expression of various Nic1b_ERF genes (with or without a dominant EAR repressor domain) and their effect on downstream gene expression (PMT and QPT) and alkaloid levels.

| Target | PMT Expression | QPT Expression | Nicotine | Nornicotine | Anabasine | Anatabine |
| --- | --- | --- | --- | --- | --- | --- |
| ERF199-EAR | Reduced | Unaffected | Reduced | Reduced | Unaffected | unaffected |
| ERF29-EAR | Reduced | Reduced | Reduced | Reduced | Unaffected | Reduced |
| ERF210-EAR | Slightly Reduced | Slightly Reduced | Slightly Reduced | Slightly Reduced | Unaffected | Slightly Reduced |
| ERF16-EAR | Reduced | Unaffected | Reduced | Reduced | Unaffected | Slightly reduced |
| ERF130-EAR | Slightly Reduced | Unaffected | Reduced | Reduced | Unaffected | reduced |
| ERF91L2 | Increased | Increased | Increased | Increased | Increased | increased |
| ERF101 | Increased | Increased | Increased | Unaffected | Unaffected | increased |
| ERFnew | Increased | Increased | Increased | Increased | Unaffected | increased |

TABLE 15

Flue-cured Tobacco Varieties

| | | |
|---|---|---|
| 400 (TC 225) | K 346 | Reams 134 |
| 401 (TC 226) | K 346 (TC 569) | Reams 158 |
| 401 Cherry Red (TC 227) | K 358 | Reams 713 |
| 401 Cherry Red Free (TC 228) | K 394 (TC 321) | Reams 744 |
| Cash (TC 250) | K 399 | Reams M1 |
| Cash (TI 278) | K 399 (TC 322) | RG 11 (TC 600) |
| CC 101 | K 730 | RG 13 (TC 601) |
| CC 1063 | Lonibow (TI 1573) | RG 17 (TC 627) |
| CC 13 | Lonibow (TI 1613) | RG 22 (TC 584) |
| CC 143 | McNair 10 (TC 330) | RG 8 (TC 585) |
| CC 200 | McNair 135 (TC 337) | RG 81 (TC 618) |
| CC 27 | McNair 30 (TC 334) | RG H51 |
| CC 301 | McNair 373 (TC 338) | RG4H 217 |
| CC 33 | McNair 944 (TC 339) | RGH 12 |
| CC 35 | MK94 (TI 1512) | RGH 4 |
| CC 37 | MS K 326 | RGH 51 |
| CC 400 | MS NC 71 | RGH 61 |
| CC 500 | MS NC 72 | SC 58 (TC 400) |
| CC 600 | NC 100 | SC 72 (TC 403) |
| CC 65 | NC 102 | Sp. G-168 |
| CC 67 | NC 1071 (TC 364) | SPEIGHT 168 |
| CC 700 | NC 1125-2 | Speight 168 (TC 633) |
| CC 800 | NC 12 (TC 346) | Speight 172 (TC 634) |
| CC 900 | NC 1226 | Speight 178 |
| Coker 139 (TC 259) | NC 196 | Speight 179 |
| Coker 139 yb1, yb2 | NC 2326 (TC 365) | Speight 190 |
| Coker 140 (TC 260) | NC 27 NF (TC 349) | Speight 196 |
| Coker 176 (TC 262) | NC 291 | SPEIGHT 220 |
| Coker 187 (TC 263) | NC 297 | SPEIGHT 225 |
| Coker 187-Hicks (TC 265) | NC 299 | SPEIGHT 227 |
| | NC 37 NF (TC 350) | SPEIGHT 236 |
| | NC 471 | Speight G-10 (TC 416) |
| Coker 209 (TC 267) | NC 55 | Speight G-102 |
| Coker 258 (TC 270) | NC 567 (TC 362) | Speight G-108 |
| Coker 298 (TC 272) | NC 60 (TC 352) | Speight G-111 |
| Coker 316 (TC 273) | NC 606 | Speight G-117 |
| Coker 319 (TC 274) | NC 6140 | Speight G-126 |
| Coker 347 (TC 275) | NC 71 | Speight G-15 (TC 418) |
| Coker 371-Gold (TC 276) | NC 72 | Speight G-23 |
| | NC 729 (TC 557) | Speight G-28 (TC 420) |
| Coker 411 (TC 277) | NC 810 (TC 659) | Speight G-33 |
| Coker 48 (TC 253) | NC 82 (TC 356) | Speight G-41 |
| Coker 51 (TC 254) | NC 8640 | Speight G-5 |
| Coker 86 (TC 256) | NC 89 (TC 359) | Speight G-52 |
| CU 263 (TC 619) | NC 92 | Speight G-58 |
| CU 561 | NC 925 | Speight G-70 |
| DH95-1562-1 | NC 95 (TC 360) | Speight G-70 (TC 426) |
| Dixie Bright 101 (TC 290) | NC 98 (TC 361) | Speight G-80 (TC 427) |
| | NC EX 24 | Speight NF3 (TC 629) |
| Dixie Bright 102 (TC 291) | NC PY 10 (TC 367) | STNCB |
| | NC TG 61 | VA 182 |
| Dixie Bright 244 (TC 292) | Oxford 1 (TC 369) | VA 45 (TC 559) |
| | Oxford 1-181 (TC 370) | Vesta 30 (TC 439) |
| Dixie Bright 27 (TC 288) | | Vesta 33 (TC 440) |
| | Oxford 2 (TC 371) | Vesta 5 (TC 438) |
| Dixie Bright 28 (TC 289) | Oxford 207 (TC 632) | Vesta 62 (TC 441) |
| | Oxford 26 (TC 373) | Virginia (TI 220) |
| GF 157 | Oxford 3 (TC 372) | Virginia (TI 273) |
| GF 318 | Oxford 414 NF | Virginia (TI 877) |
| GL 26H | PD 611 (TC 387) | Virginia 115 (TC 444) |
| GL 338 | PVH 03 | Virginia 21 (TC 443) |
| GL 350 | PVH 09 | Virginia Bright (TI 964) |
| GL 368 | PVH 1118 | |
| GL 395 | PVH 1452 | Virginia Bright Leaf (TC 446) |
| GL 600 | PVH 1600 | |
| GL 737 | PVH 2110 | Virginia Gold (TC 447) |
| GL 939 | PVH 2275 | White Stem Orinoco (TC 451) |
| GL 939 (TC 628) | R 83 (Line 256-1) (TI 1400) | |
| Hicks (TC 310) | | |
| Hicks Broadleaf (TC 311) | | |
| K 149 (TC 568) | | |
| K 317 | | |
| K 326 | | |
| K 326 (TC 319) | | |
| K 340 (TC 320) | | |

TABLE 16

Burley Tobacco Varieties

| | | |
|---|---|---|
| 4407 LC | HB 4108P | KY 54 (TC 71) |
| AA-37-1 | HB 4151P | KY 56 (TC 72) |
| Burley 21 (TC 7) | HB 4192P | KY 56 (TC 72) |
| Burley 49 (TC 10) | HB 4194P | KY 57 (TC 73) |
| Burley 64 (TC 11) | HB 4196 | KY 58 (TC 74) |
| Burley Mammoth | HB 4488 | KY 8654 (TC 77) |
| KY 16 (TC 12) | HB 4488P | KY 8959 |
| Clay 402 | HB04P | KY 9 (TC 54) |
| Clay 403 | HB 4488 LC | KY 907 LC |
| Clay 502 | HIB 21 | KY 908 (TC 630) |
| Clays 403 | HPB 21 | NBH 98 (Screened) |
| GR 10 (TC 19) | HY 403 | NC 1206 |
| GR 10 (TC 19) | Hybrid 403 LC | NC 129 |
| GR 10A (TC 20) | Hybrid 404 LC | NC 2000 LC |
| GR 13 (TC 21) | Hybrid 501 LC | NC 2002 LC |
| GR 14 (TC 22) | KDH-959 (TC 576) | NC 3 LC |
| GR 149 LC | KDH-960 (TC 577) | NC 5 LC |
| GR 153 | KT 200 LC | NC 6 LC |
| GR 17 (TC 23) | KT 204 LC | NC 7 LC |
| GR 17B (TC 24) | KT 206 LC | NC BH 129 LC |
| GR 18 (TC 25) | KT 209 LC | NC03-42-2 |
| GR 19 (TC 26) | KT 210 LC | Newton 98 |
| GR 2 (TC 15) | KT 212 LC | R 610 LC |
| GR 24 (TC 27) | KT 215 LC | R 630 LC |
| GR 36 (TC 28) | KY 1 (TC 52) | R 7-11 |
| GR 38 (TC 29) | KY 10 (TC 55) | R 7-12 LC |
| GR 38A (TC 30) | KY 12 (TC 56) | RG 17 |
| GR 40 (TC 31) | KY 14 (TC 57) | TKF 1801 LC |
| GR 42 (TC 32) | KY 14 × L8 LC | TKF 2002 LC |
| GR 42C (TC 33) | KY 15 (TC 58) | TKF 4024 LC |
| GR 43 (TC 34) | KY 16 (TC 59) | TKF 4028 LC |
| GR 44 (TC 35) | KY 17 (TC 60) | TKF 6400 LC |
| GR 45 (TC 36) | KY 19 (TC 61) | TKF 7002 LC |
| GR 46 (TC 37) | KY 21 (TC 62) | TKS 2002 LC |
| GR 48 (TC 38) | KY 22 (TC 63) | TN 86 (TC 82) |
| GR 5 (TC 16) | KY 24 (TC 64) | TN 90 LC |
| GR 53 (TC 39) | KY 26 (TC 65) | TN 97 Hybrid LC |
| GR 6 (TC 17) | KY 33 (TC 66) | TN 97 LC |
| GR 9 (TC 18) | KY 34 (TC 67) | VA 116 |
| GR139 NS | KY 35 (TC 68) | VA 119 |
| GR139 S | KY 41A (TC 69) | Virgin A Mutante (TI 1406) |
| HB 04P | KY 5 (TC 53) | |
| HB 04P LC | KY 52 (TC 70) | Virginia 509 (TC 84) |
| HB 3307P LC | | |

TABLE 17

Maryland Tobacco Varieties

Maryland 10 (TC 498)
Maryland 14 D2 (TC 499)
Maryland 201 (TC 503)
Maryland 21 (TC 500)
Maryland 341 (TC 504)
Maryland 40
Maryland 402
Maryland 59 (TC 501)
Maryland 601
Maryland 609 (TC 505)
Maryland 64 (TC 502)
Maryland 872 (TC 506)
Maryland Mammoth (TC 507)

TABLE 18

Dark Fire-Cured Tobacco Varieties

| | | |
|---|---|---|
| Black Mammoth (TC 461) | KY 171 (TC 475) | PD 7309 LC |
| | KY 171 LC | PD 7312 LC |
| Black Mammoth | KY 171 NS | PD 7318 LC |
| Small Stalk (TC 641) | KY 180 (TC 573) | PD 7319 LC |
| Certified Madole | KY 190 (TC 574) | Petico M PG04 |

TABLE 18-continued

Dark Fire-Cured Tobacco Varieties

| | | |
|---|---|---|
| (TC 463) | Little Crittenden | PY KY 160 (TC 612) |
| D-534-A-1 (TC 464) | Little Crittenden | PY KY 171 (TC 613) |
| DAC ULT 302 | (TC 476) | Shirey |
| DAC ULT 303 | Little Crittenden | TI 1372 |
| DAC ULT 306 | LC (certified) | TN D94 |
| DAC ULT 308 | Little Crittenden PhPh | TN D94 (TC 621) |
| DAC ULT 312 | Lizard Tail Turtle Foot | TN D950 |
| DF 300 (TC 465) | Madole (TC 478) | TN D950 (PhPh) |
| DF 485 (TC 466) | Madole (TC 479) | TN D950 |
| DF 516 (TC 467) | MS KY 171 | TN D950 (TC 622) |
| DF 911 (TC 468) | MS NL Madole LC | TR Madole (TC 486) |
| DT 508 | MS TN D950 LC | VA 309 |
| DT 518 (Screened) | Nance (TC 616) | VA 309 (TC 560) |
| DT 538 LC | Narrow Leaf Madole | VA 309 LC (certified) |
| DT 592 | LC (certified) | VA 310 (TC 487) |
| Improved Madole | Neal Smith Madole | VA 331 (TC 592) |
| (TC 471) | (TC 646) | VA 355 (TC 638) |
| Jernigan's Madole | Newtons VH Madole | VA 359 |
| (TC 472) | NL Madole | VA 359 (Screened) |
| KT 14LC | NL Madole (PhPh) | VA 359 (TC 639) |
| KT D17LC | NL Madole (TC 484) | VA 359 LC (certified) |
| KT D4 LC | NL Madole LC | VA 403 (TC 580) |
| KT D6 LC | NL Madole LC (PhPh) | VA 405 (TC 581) |
| KT D8 LC | NL Madole NS | VA 409 (TC 562) |
| KY 153 (TC 216) | One Sucker (TC 224) | VA 510 (TC 572) |
| KY 157 (TC 217) | OS 400 | |
| KY 160 | PD 302H | |
| KY 160 (TC 218) | PD 312H | |
| KY 163 (TC 219) | PD 318H | |
| KY 165 (TC 220) | PD 7302 LC | |
| KY 170 (TC 474) | PD 7305 | |
| KY 171 (PhPh) | | |

TABLE 19

Oriental Tobacco Varieties.

| | | |
|---|---|---|
| Bafra (TI 1641) | Edirne (TI 1671) | Samsun (TC 536) |
| Bahce (TI 1730) | Ege (TI 1642) | Samsun 959 (TI 1570) |
| Bahia (TI 1416) | Ege-64 (TI 1672) | Samsun Evkaf (TI 1723) |
| Bahia (TI 1455) | Izmir (Akhisar) | Samsun Holmes NN |
| Baiano (TI 128) | (TI 1729) | (TC 540) |
| Basma | Izmir (Gavurkoy) | Samsun Maden (TI 1647) |
| Basma (TI 1666) | (TI 1727) | Samsun NO 15 (TC 541) |
| Basma Drama | Izmir Ege 64 | Samsun-BLK SHK Tol |
| Basma Hybrid | Izmir-Incekara | (TC 542) |
| (PhPh) | (TI 1674) | Samsun-Canik (TI 1678) |
| Basma Zihna I | Izmir-Ozbas | Samsun-Maden (TI 1679) |
| Bitlis (TI 1667) | (TI 1675) | Saribaptar 407 - Izmir Region |
| Bitlis (TI 1725) | Jaka Dzebel | Smyrna (TC 543) |
| Bubalovac | (TI 1326) | Smyrna No. 23 (TC 545) |
| (TI 1282) | Kaba-Kulak | Smyrna No. 9 (TC 544) |
| Bursa (TI 1650) | Kagoshima | Smyrna-Blk Shk Tol (TC 546) |
| Bursa (TI 1668) | Maruba (TI 158) | Trabzon (TI 1649) |
| Canik (TI 1644) | Katerini | Trabzon (TI 1682) |
| Djebel 174 | Katerini S53 | Trapezund 161 (TI 1407) |
| (TI 1492) | Krumovgrad 58 | Turkish (TC 548) |
| Djebel 359 | MS Basma | Turkish Angshit (TI 90) |
| (TI 1943) | MS Katerini S53 | Turkish Samsum (TI 92) |
| Djebel 81 | Nevrokop 1146 | Turkish Tropizoid (TI 93) |
| Dubec 566 | Ozbas (TI 1645) | Turkish Varotic (TI 89) |
| (TI 1409) | Perustitza (TI 980) | Xanthi (TI 1662) |
| Dubec 7 | Prilep (TI 1291) | |
| (TI 1410) | Prilep (TI 1325) | |
| Dubek 566 | Prilep 12-2/1 | |
| (TI 1567) | Prilep 23 | |
| Duzce (TI 1670) | | |

TABLE 20

Cigar Tobacco Varieties

| | | |
|---|---|---|
| Bahai (TI 62) | Castillo Negro, Blanco, | Enshu (TI 1586) |
| Beinhart 1000 | Pina (TI 449) | Florida 301 |
| Beinhart 1000 | Caujaro (TI 893) | Florida 301 |
| (TI 1562) | Chocoa (TI 289) | (TC 195) |
| Beinhart 1000-1 | Chocoa (TI 313) | PA Broadleaf |
| (TI 1561) | Connecticut 15 | (TC 119) |
| Bergerac C | (TC 183) | Pennsylvania Broadleaf |
| Bergerac C | Connecticut Broadleaf | Pennsylvania Broadleaf |
| (TI 1529) | Connecticut Broadleaf | (TC 119) |
| Big Cuban | (TC 186) | Petite Havana SR1 |
| (TI 1565) | Connecticut Shade | Petite Havana SR1 |
| Castillo Negro, | (TC 188) | (TC 105) |
| Blanco, Pina | Criollo, Colorado | |
| (TI 448) | (TI 1093) | |
| Castillo Negro, | | |
| Blanco, Pina | | |
| (TI 448A) | | |

TABLE 21

Other Tobacco Varieties

Chocoa (TI 319)

Hoja Parada (TI 1089)

Hoja Parado (Galpoa) (TI 1068)

Perique (St. James Parrish)

Perique (TC 556)

Perique (TI 1374)

Sylvestris (TI 984)

TI 179

TABLE 22

EMS generated mutations identified in NIC1b-ERF genes

| Seed Id | Gene | Change (AA) From | Change (AA) To | Position (AA) | Seq pos | Change bp |
|---|---|---|---|---|---|---|
| MS13646 | g31420 | A | V | 108 | 323 bp | C > T |
| MS13647 | g31420 | G | R | 124 | 370 bp | G > A |
| MS13648 | g31420 | E | K | 92 | 274 bp | G > A |
| MS13649 | ERF16 | N | S | 2 | 5 bp | A > G |
| MS13650 | ERF16 | N | S | 2 | 5 bp | A > G |
| MS13651 | ERF16 | N | S | 2 | 5 bp | A > G |
| MS13652 | g31435 | R | H | 153 | 955 bp | G > A |
| MS13653 | g31435 | N | D | 2 | 1 bp | A > G |
| MS13654 | g31435 | N | D | 2 | 1 bp | A > G |
| MS13655 | g31437 | R | G | 128 | 382 bp | A > G |
| MS13656 | g31437 | D | N | 139 | 415 bp | G > A |
| MS13657 | g31437 | D | N | 123 | 367 bp | G > A |
| MS13658 | ERF130 | G | E | 97 | 290 bp | G > A |
| MS13659 | ERF130 | E, A | D, T | 109, 202 | 326,605 bp | G > T |
| MS13660 | ERF130 | A | T | 43 | 128 bp | G > A |

TABLE 23

Alkaloid sampling statistics for selected mutations in NIC1b-ERF genes NCG1 and ERF16

| Comparison | Difference | Std Err Dif | Lower CL | Upper CL | p-Value |
|---|---|---|---|---|---|
| Student's t-test- Nicotine | | | | | |
| Control vs MS13651 | 1.293789 | 0.269262 | 0.7524014 | 1.835176 | <.0001 |
| Control vs MS13648 | 0.610066 | 0.2598112 | 0.0876801 | 1.132451 | 0.023 |
| Students t-test-Nornicotine | | | | | |
| Control vs MS13651 | 0.0321028 | 0.0081465 | 0.015723 | 0.0484825 | 0.0003 |
| Control vs MS13648 | 0.0144888 | 0.0078606 | −0.001316 | 0.0302936 | 0.0715 |
| Students t-test-Anabasine | | | | | |
| Control vs MS13648 | 0.0047681 | 0.0009604 | 0.002837 | 0.006699 | <.0001 |
| Control vs MS13651 | 0.0046806 | 0.0009953 | 0.002679 | 0.0066817 | <.0001 |
| Students t-test-Anatabine | | | | | |
| Control vs MS13648 | 0.0318672 | 0.0107152 | 0.010323 | 0.0534116 | 0.0046 |
| Control vs MS13651 | 0.0198667 | 0.011105 | −0.002461 | 0.0421947 | 0.0799 |

TABLE 24

Alkaloid sampling statistics for two selected mutations in the NIC1b-ERF gene NCG17

| Comparison | Difference | Std Err Dif | Lower CL | Upper CL | p-Value |
|---|---|---|---|---|---|
| Student's t-test- Nicotine | | | | | |
| Control vs MS13657 | 0.41662 | 0.1258417 | 0.165573 | 0.6676674 | 0.0015 |
| MS13656 vs Control | 0.0656889 | 0.1240816 | −0.181847 | 0.313225 | 0.5982 |
| Student's t-test- Nornicotine | | | | | |
| Control vs MS13657 | 0.0137133 | 0.0036432 | 0.006445 | 0.0209814 | 0.0003 |
| MS13656 vs Control | 0.0001389 | 0.0035923 | −0.007028 | 0.0073053 | 0.9693 |
| Students t-test-Anabasine | | | | | |
| Control vs MS13657 | 0.0015733 | 0.0006779 | 0.000221 | 0.0029257 | 0.0233 |
| Control vs MS13656 | 0.0008333 | 0.0006684 | −0.0005 | 0.0021668 | 0.2167 |
| Students t-test-Anatabine | | | | | |
| MS13656 vs Control | 0.0129214 | 0.0048319 | 0.003279 | 0.0225634 | 0.0094 |
| MS13657 vs Control | 0.0043067 | 0.0048905 | −0.005452 | 0.0140655 | 0.3816 |

SEQUENCE LISTING (228 sequences)

SEQ ID NO: 1 - DNA, 3000 bp, Artificial Sequence
  source: /note="Description of Artificial Sequence: Synthetic polynucleotide"
gggtgggggtgggggtgcagaaaaatgaaaaaaatagaattttcaaattgcaaaaaaaaaaggtaaaaaaaataattctttttgtcggagggaggatggggatggtgtggagtggggtggaggagtagtagggtgggtggcaacagaaaaactgaaatttgaagaaaaaaaaatcttttttggagagagggggtggtgtagggaaggtgcagaaggagttttggaaaatgttttcccttctcttgataaggaaaatattttcctccgattggaggaaaatgagtttataaaaaaaatattttccaaaacattaaagccaactaaacatggcaaaactgaaaaacattattcaaaaaatattttccttagtaccaaacacaccctaagacatcttaattctatataaaatatcttttaaagctttctaataatggaagtcatagatgaggatcctaggtgagaaagaggaatatttggctcctccttatacctaaaattgtaaaattggattttaatttattattttttatataaatggtaaattgtatatactaatgtgattacgtgataacctctctacgaggggtaaataaatttataatgtatatataggtaaaaattccaacatgaaaatcatattcttactctaaccgagctcccagttccaacatctatataaacaagaaacttcaaatattatacagtcattcttaatattttcaattgaaaaaatcatgcattgtaacaaatattaatagagcttaaattttgtcttaacaattatttaaatattgaaaaaaaattctgacttgacaccagtattgacgtgtttgtactctcacaaaactaggaaatagtgagagacatacaatttggcccttgaaaaagtttaaaacatagagtaggtagcatgcttgcatgcatccatttaaaacttagattattttattccaaaaattttgacactatataaaataatcaaaaataggacaaaaaattgacgtacgagtctaagtaacttaactgctctaaaaatcattcaacttttattataattcttgtgttcaaaaagatgggacatacttaaaattagaatggagctaaaagctagttgtaattgtttatttcttcaattgtggctgtgagtgagctaagaaattaccaaaaggtgagtcacatagtaaactttcttcttcttgtctgttttaaaatattaccaaaagtagaataacacaaccattttctaaaaacaagagtaacacacagcaaagcaaagtgaattactaataacttaatagaaaatatattatttcagcgcatcgcttaaaaaagagtaatcctcatgtgaatccttaaattttttctaacacaacggtaacaagctctaacgcccaacaacaataaaaaaaaactcttatagacacattaaaaagacttaaatccccatgtcatctatcactaaaaaagaaaagacatgaatcagcacaaataaattatatcataatcagacaaaaacattatttattaaaatacctcattttctatattgtttccaacacgtggtggtcccttttcctcgtgaaacagcaattgtgggactgaataaatggatgggttgtgttttcaaatattttagcttttaaattagtattttaattttttttcttaaaattaatttttatcatgtcactaaattttaatgaaaagcacataatccgacaaaaatgaccatttaaatgaactataagttatgtgattattgagaaacaaaaaaattacatgactgtaatggttaattaccaaaaatgagtaaccatcaaggccatccgtcgtacgtcttataagttataagaccacaatcacaaatgaccttctttaagtaattcaacaaaatgcatttcactttattttttgcgccgaataaatatacaaaaggccgaatccgaattattccaagagatgttggaaaatattagtttgtccgcttaatgaagcaataatttggctttgtcaccactacaaacttgtagagaaaaagatatgttaatattttcaggataatacatatagagagagagtcgtacctttctataacagcctcgttagttccgaatatttttgtatgttatagcgaagtgttataatagagaacatatattataaaataacatgaaatttggttccgaaaaacttgatttttatagtgaagtattgttatatggggttgttgttatagagaggtatgactgtatgtatgacttatttgtataaaaaatgatctagaagataaatgtgggcgaaaataatttagtagtcaaataatacttaaaaaaaaccatagcacatacaagcaattgaagtattaaaatggtgaaagggttagttgaggtgcatgtctgatcgttggggacaacttaaagagtccgtttaaatatttcgtcgttttaatactacagggttatatttggccgtttcctaaattaaatggtttaaattttgaaacacttcaatgagtaaaaaacccttgtcagcttgtatgtgctgttgcattgctattacgtcttttctcccaccggactattttcttacgcattaaacaagcaaaattattttattgaagatcttttgaaatgacccggattagaataattcaaggaagttatttactaatcaattatagaactataaagtattatttcatttgtgttgtcttatgcgcatggttgttaggaagaattattatttttaaaaataatgaaaactcgaaaaagtttaatgattcatatgatttgggtcgtcgtagaaaaatattacaactactccatcagtaatatattttatcttatagcctattagtctctttcgtgtaataaaatcacatgtgatgtataaattagctagggtttaaaatataaaataaatatcatccgtacgttttaagatatgttttttttctatatgctaacatactatattcaaattaaatgtcttaataatact

SEQ ID NO: 2 - DNA, 1827767 bp, Nicotiana sp.
  modified_base (73101)..(74100): a, c, t, g or not present
  modified_base (710005)..(711004): a, c, t, g or not present
  modified_base (1059235)..(1060234): a, c, t, g or not present
  source: /note="See specification as filed for detailed description of substitutions and preferred embodiments"
ctgccctgatggctaaccctgatggcctatagacccactggaagaagcctgaatagccggtggacattatgaacactccgacatagcactaaaataagaatcaaaagaaccttgtggacctgaataaccgccggaggaaccctgaatagctagtgggcggtaagaactctccggcaccgcactgaaatatggtctcactggagcacctcggggaggtggtgatggtgctgaatacaggggtctactaggctggcccttcccgaagtgacctctacccctagctggggcacctctgaactctcccgagaaccgggccctcttgtcctactgaatctgctctctacccctctggcgatatccctaaatcttgcgagcaatctttaccactagctgatactcagtacccatctccacctctcggccatgctagctcgaataccggggtgcaaccccgcaacaaatcttcgcaccctctctacatcaatgggaagtatcatgagtgaatgacgagacaactcagaaaaacctcacctcataataggtcacggacatctgaccctgctcaaaatgctcaaactgatatcgtagctcttccctctcagatgagcgcttctgcggtttggcctggccagctctgggccatatctgtgaggctacgaccgcttctgtggtttcgcacctgcggtcaaccaaccgtaggtgcggttatgatagaagcagatgcttcagcatttctccaaattctcaacttcactcgagcctcgtccgtttgacgctctgggctcccgggccccgcccgaacataccgacaagtctgaaatcacgagacggaccaactcgaacctctggaacgcccgaaacaatgctaaatctaagagtcaccccttaaaaccaaatgaatcaaacttatgaacttcaagttcttaattttcgtctaacgagtcgaaacgccctaaaactactcggattgataccaaattttgcgggcaagtcttaaatgatatatcggacctatgccgggctccggaaccaacatacgagcctgatactcatggaaccaatcattaattagtttctttaaatctttaaaacttcatattaacaatttctgatataaattcattactccggctaatgacctcggaattcgattccgggcatacgcccaggtcccatattttcctacggaccctctcggactgtcaaatcacgaatctgggtccgtttgctcaaaatgttgaccaaagtcaaacttagccttttaagaaaattctaaggaatcaaatgggcatatttcactccaaactcttccaaatcccgaacctaccatccccgcaagtcgtaaattagttaaagcaagtgcggaaagttttatttaagggaacagggttctaaaaggcaaaacgaccagtcggatcgttacataaagtttgtaaaatatatatatttcatgcacataatataaaataattatttaaataaagctacttttattatatacattatatattcttgaaaattatgctcaattgtattattatatttctaccaacttttcaatgacacaaagttatatcaccggaaagcagggagactatctgtataggataaaatatgctatgttaagttgtgcatggaatatatataatataattgagcaaattattcaagaatatataatgtatattataaaagtacctttatttaaataattatttttatgttacgtgcatgaaatatatattttacaacctttattttctttcattttaaattgtgcaaataaatttttaaatttttgctattaatactaaaattattattacgaacaaattattctaattaatttttttactcgatatccgattttacaatgtcttcaacttatattaaagcaattaccaatatacagcaggcatcactttcaagcattgttgcgttgcagacccatactccttattcctcatataattcccttttcgaaagcagtccaaagtttataagaatttgaccggtgattagacatgtacaagttaatctcctaggagacagagctgaagccgacatatatatcccacattcatgcactacctactcacgaaaccataatactaatgtccaacaccctccatccctgaattcctaaacctatatatatacatcatcattttcctatccctttgccactacgtacaccacattcacaaaaagaactttaatataaaaaaaagatgcagggaatatcattagagtttgatcagcaaaattttcttgacaccatgcagcatctcttcaatgatcccgactttccccaaatcttttcagaactaaactcattcaataacaccatccaaacacctagaaacccaggttcagagaacaccatatttgcacaaaacatggttcaacgcaatcaagaaaaatatgcagatgatcatatcgtcccattgcaaaagacttcgtcagaaaatgataaggagccatcttcagatcaggtgcctttggaaaagaagaaatacaaaggagttaggagaaggccatggggaaaatatgctgcagaaataagggatcctgaaagaaaaggcgctagactttggctagggacatatgaaactcctgaggatgcagcattggcttatgacagaactgcatttaaactgcgcggttcaagagctgtactcaatttccctcacttgattgaatctaatgttactgaaattaacagagtgaggccaaggagacgttcacgttcaccggatattgagctttcatctgatcagcatgatggtccgatttcaaagaggagaaatgttgacctaattaacagcttagctacagccaacttggatagccaaattatcgtggagagatgtttaacgtctagtttttttgcctgaagaaaatctaacacttactacaacattatgcatcaacggctacaaataaaaaatcgtggctattacctagcaatagccataaaaattgaaatttcgtggttgttcacaatttggtgaaatttcttggctacaataagtaaattgacaaagctaattccttctttttgctataattggttagtatcgtaataataactacaaaaatagctacacatttactgctacattataaatttatagctaattgttagtttttgccatgtatttaaattattgtagcaataaaaaaaaatttaaccacaataaatcatgtcaaataaaatatcgaatatttttccttcaagttgtaaaaatcgtggcaataattggctcaatagatacgatgaatatcatggcaaaataatatagccacaaatttatatagctacaatatttattgaagctaattctaagttttgctatgcatttgaagtcactgtaataattgtaatcttcaagccatgatacatttgtttgcacataattctatagctaaaaaaatagtcttgtttcaattttcaaaaatcgtagcaactgttgggacatatatgctcaggattttaggcactaaggccacattcatccatgagccactttgtcagcttgaattttgtaacaatccgactggtagttttgagtatttgcacttcgctcggtgttttgagagctccagtatctccgcatgatgtattataacttgtgtaaatcgttggtattgattttcaagttatccggaatcgatttggaagaatgaacttcaagatttaagttttaagttggaagaactgaccaagtttgactttttagtatttgacatcgaaatggagttttgtcagttccgttaactcagttgagtgattttggacttaggagcgcgttcggattataatttagaggttcgtaatcgaattactcttgaaattgcgaaagttggatttttgagaagtttgagcggagaggactttttgatatctgggtcggattccaattttgaaagttggtgtaggtccgtaatggcaattattacttgtgtgcaagatttcaggtcaattggaggtgatttgataggtttcggcattggtcgtagaagttgaagtttcaaagttcattaattttgacttgaggtgtgattcatcatttcgatattgttatgcatgatttgaagcttcgagtaggtttgttttgtcatatagaacttgtatgaaaaatttggcgctattcggagttgatttgatatggtttggacgctcggttgtaattttagaagttcttgaagtttaagttaatcttcatgcgttttggcatccgattcgtgcttttggaggttattttgatgttttgattgcgcgagcgagttagtataatatttttagacttgtgtgcatattttgtttagagccccaagggctcggtgagtttcagattggtttcagaataatttttcataattcttgagtgctggttctagttttgtcgcatttgcgatgttttggtcgcaaatgcggccatcgcatttgttgatatccaattttttcctatgtatttttatacccaaaaaacttccaaaataacatatatgcgcatatataagcacaccaaaaggttttggcattttaatgatttttaaaccaatttatgacctattttacatcataaaatccaataactattcccaaagcttgccattttggagaataatttattttattctcatatttacgccaaaatatatccagcatgatttttacacattttttacaaattcgtttggtatttttaaagccaaattgcatataattgcaatactagcctctttaagatttaatagcattttataattacaaaattgatcccaatattttcaaattaatatttatatattattagttgactcagtgcctttaatttgcttttaaaatatttttactatttttataaaataataaaaggaaaaattggctatttcaattgtagcctcaattcatttcaattataacccaaattccatttcaatttcaacctgaaatcagcccaattttgaactcaattggaccagcccaattcattcaaacccatccccttgacccgtttaatccaatccttttaatccaggccgttaatcattttgatcaacggccacaaacgaccctttttttttaattctaccaacccccaaccctaacccttatttctcttagacaaccgcctctgaaacctcttctctctcaaaacgctctcaagcactcgaaaccctaatcgcctccctcgtcttctccgaccattatctcgccggagtccatggcttttcaggccatggacaacttgtgctcaccttccttcactcctaagccatgggtgttcaagatttcgaggtttgatctcaacggcgttcgttcagatcttcttagatctgtggttctatggcctctccggccttgctccgacgaattcgtgctttagaagcctagccatggccatctctgactcaagaccagacctcttctaagccttctcatttctagggtttcagagaaaccctaaagctattcgaggttccttcctcttttatttacttagatctgtgatgcatccgtgctatattcaacgttttaaagcttttccccaattttcttttcaaaattagttcgctttcaatttagggttttcgaaaaaatctcaaaataacttccgactcttcttcttcttcttttctttgtgtgactctgtctgtaccacgttcttatgagtttttctcttatgttcttatgtttgccatacgatacatgttcttctatttttgtgttctgttcttccctctactgggttctataagcatgctttacatgtctatctcgtatgttcctctactgtattttttactaagcttttgctccttgcctacctttactggactttgtttgaaccctaagcatgtttcatctactattttcctaaacccgtatcgctttttcttttctgaacttgtttgagtgacaagctttgcctaaatgtattccctgtgtttcaaacttgttgttatctctgtttgtttctcataagtctctgaaagagactactgagcctgttctatttgttgttttctcatctatgcatctgatttgagtcagaaaccctagtatttgggggttttttttggcaagcttgactttgtgtttggactagggttccattcagaaccctgactctctttcagactcattctgattctatgaacctaaccttcttgggtactctgatttcttgctagttttacaacaactctctcttgtctcacatgtctgtatgctttttatatgacaagttctcttctttcaaaaggcctttgtccagcttgtgattgattccgagttccatttttaaaagttttgattgtgtgttgttaagtttcttcaaatttaacccttctcacctttttctggttggattcattcacactaagattcgaatccttattttacgggctggttgattgattgtctttccttgtttgacctaaaccgtgtactactaaactgtttccttaaataggtttttgtgtatttgcccctgttatattgcctcagaaaagattgtttaaaacaaatcctttccttatttatttttgcccgtttgaatcaaatcccttaaccaaagggaaacagcttgtgattgatttcaaaacttttctcttacctttttttactcaccttctgcactataaaagggaatgctcttttgcactaaagaaagggttttacagatgctttcacagacttttctgcacaaaaacacaggcttttacacattcgaatactgagttctttcacaaaaaaaattatactctcttcttctactttgtgctttctgaaacaattttgagctctctctctaaaactctcaagtgttctgctgaacttaagtgtgctcctactgtgtttacttgccatgattgctctattattctgcttgttcttactttgcaactggtacgttattcttagttgaataatgcttcttcattatgtgtttacttcctagtctgttatgttcttctttactatatttctgcaaccctgttgtgcttttcttatgtgaactccctttcccttttcccctttgtatgtgagtatagttccggccatcacatcactttgatattgttgtctatgactctgaactgggttctttgaacctcataactcaatcaattcccactcccttctcccctttatgtgcttgagcctggacctgagtctggtggtgtcctaatcaccatccagacctaggtttgaccctcaagggtctgctcctaacttgtttgaccaaacaaatgtcaggggtatgccagtctgcacctgtggctgggtatgaccaccatttgttatggctccccaattccttttcactttgcacttactcctagatctaagttctgcccctctcttgcaagccatgctttgggacccttgagctcccactgaacttggatgcctgaggactggctattccgcactgcactattctaattctaaatggtatcctgagtgtaagcaatgctgggaatccttgagattccttggaactttgaaacactttggataaagagaaggctttggaaatccggaattggttaatcacatgttattggacattaagattgaattaggctgctcggatctagctgttagtttttactgtatttatttcctttcttttggtatgtaataatttgtataaagaatttggggaatgtagtaaaagggtgtgggaggggttatacattcttgcatcagtaaggatagaaaccatgctttaggattttaattttttttagaaatcctgcctataggattgttcaatatttctgattccacattacttagagaccatgcctatagggtcaacgctttattgtgctacaaatcacatagaaatcatgcttataggacttaacgtttatgtaatcaatgcatatagagatcatgcctataaggaatgcatatgcattaggcaaactgtagggttaattaacacaatcatcttttacaagttcaataacaggttttaaagtcaaaatagatatcatgcctataggatttgcatcaaactcgtctgattcgcttaaagtaataatgatatattaactggtccttaacgtcttaatacaacaacgatttcagaagtcttaattctttgacaaaaactctcttgactcaatatgcttttaagtccctcaaatcggcatctttttctgaaatagtttctttctaaacattctgcctaaacattttactcagaccctgaaatcatcttttaaaacagttgcaacttaccctttccttagatatttctatctctgaaactctttcacaaccatttatgtattttatttttactgcagtctatactttctttttaaaactcctctgcattagactactttttcctgaaaccagtaccttttaaatcactcgcttgaaataccttaatttctgaattggatccaagtttcctaatgtagacattctatctaaacatatgggttgaaccagtccgttcactgtttaagtttaatttaaagaccaaatcagtatatgccaagatatgctaaactaagtgtttgtttgattaaggggtttacttgagccttacctatttgttttgttcatccttatatttgttacttgttttgtgtgtcgcaattagaattttaacctttgaactccatatatgcctatatccctttccttcccctttaggattagaagtcctgataccccgggactgataggttgggacgggtactagaatgcaataagtaaacgagactgatcgcgtttaaataccttaacggggtgggaaaggtagaatatggatatgatgaccgatgcgctaatatcacgtgcgacccctcttctgaggagtgatcgctgggtattgcattgaagtgatccatattaattataaacttatgactcccctccctttattttctttcatctcttcttgtaaaactgttcaaatctctttttcatgaatttctgccctctctacttacttccgaaaattttcaagttggtcgcaatgttatgtgcgaatacttatttgagacttgactgtttacttgtaaagtcacaattataacatggccgagaaccacactagtggatcttgaggggtgcctaacaccttcccctcgagataatttctagcccttaccctaatctctagtctcttcatctcaaacccttcttaaagtgtcctaatgcactataatcattaggtggcgactcttcaacttctaaacccaattctcgaaaggggatagagttgtcctcccaatgtcgtatacccgatttctgaccccgcggttagagaaaaaggtggtgtcgacagcatgtcgactctgctgaggagtttctttaggcttttaccaatgcatgttgtttgtgactttattatctcattaattgctttatttagtgtcttttattctttcactacgaaactgacttggctcttcatgtcttttctttcctttatctgctttcctttactactttatttcattgtttttgtaattactgcaattattgtaattcatttatcttatgaacgtgaaaatacatgacaatttgtttcattcttgtaaactgcatcttcaacatcatattccactcatgccaaacaaacaccatagcaacgcttataatgagtggttgcgctattccaatattatcaccttttaaattcggcaaaggcgtatttgcggtaaaaccagtcgatcaacggtgcagtcgacggtttcgtgcctttccctcttgagttgtccgctcaagggtacctgtctaataccccaacagaaaccctactctgtctaactgtgcatgcatcatggtcaaacctagccgagtcaattatgttgtccacataatgactcattaagatagccttgtccaaagtccatcgggtttccctaaaacccaaatagacacctacatgttatgtgcatttatttggagaactaaatgctttttatgctaattattggtttaaatagtcgagtgtggcagggtaagggtctaacactctattttgcagaaaatgaggtacgaagtccccagatttggcatggtcaccaacattcatccaaggctgctgaattggtgggatgatcgtcactctagtgatcagacactcgtccgcaaatacttagggaatctgccttctcttctaaaaatccagcatgacaacaaaatcatataggcttcaactctattctgggatagtgacaggtctgtgttctgcttcgggaaccttgaaatgactcctttgctcgaagaaataggaggcttagatggtattccttgggagactccgggcttgcttatgccagataatcacaggggtaagggtttccttaagatgatgggactgaagaagaacccagacttgacctgtttgaaagactcctacatcccattcgactatctgtacgagaggtacgaccatagcaagtcataccacacctactcagatgaatttgccctctcctcactggggcatattcacagaagggtcttcgtattcatgttttgtttcctggggatgatagtgttccctatgaagaaggctaggattcacaccatattggccatggtaaccaagactctgatggaaggaatcggcggacaacctttcaacatagtgcccatgattgttgctgagatataccgggatctggataattgtcagcgaaaggccagtcatttttagggatgctatttattacttcagctctggctcatagagcacctccagaaaggagaataccgacaagagatcttatgcagagactgggatgatcatattgccttccaccagccaaggcgtatgaattatatgcctaacatgttcgctcagccagaggacgctggaggatgggtggagctatttgagaatctaaaagaagaccaggtacagtggatggtcgaatggttccctacggaagaattcattgttcgatcccgagacgcaccgtttctcatactcattggtctaagaggaacttatccctacgttcccttccgagccatgaggtaggctggaagaaagcaaataataccaagggtcaacaaaatgagtcactttagggccgatttccaggacgatgatagccctcacaaatgccaagctcaacacatgtggcattgcaagctcgttttggggaaagaatctattgagctagacaggtatcatgctggttaggtgctgcactattcgggttggttggaagataatcataatggtataggtcagcccgggttcattcacggacacagaatcatcgacgagaaagctgaagcatgggttaagtacaatcaactgcgcaagaggattcgagagtgtgaaagtgagcttcgggaaatacaagaagcccatcagaagttgatcgaggaatggaaggatatggctgtcagtgccaacaatcgactagggtagttggagcgaggtctagtggagctagaaggaaagttcctcaagaggattgaagattgtcgaaacgctgaagggaatgcaggcggacatttggcccaagcttatctgctgctaggactgcgtgagctggtgaatctgttcgagggggataccgaatctagggaaggcccgtctgggaccaagtagttagaagtcttttattttgcttctaatgatgtaataaggccaatggccactagtgacattttagtttccgttatttagcgtcgctttggattcgtcttatttcttatcaataaaatgaggcatttagcattataagttctccaagttaatttgtcgctaggcctacctcagacacaacgaggcacccaaattaggacgcgatttatattcttgcacaatttgtttaaatattgcaacattttcttctcataacctgcactaacttgttacctttttgcttttctttattttttatcccctttccaaaggttagttcgtgcattctggaaccatcatcatacagtacgagatccaagggctctccacctcctcctcctccgagtcctatccgaaacaagagcaaaggtagaatgggagattcaagcgccagaaaggaaattgaaagaattgagattcctcagggtaccccagttgctaaggaaactgctgcccaacttgagcagaaactgttgaagttccaagaagaactggatcaagttcggaacttggcaaatttatcattcgctctcaccgctcctgatgtcaacttcccaaatgctcaaaatcccgcacctccacagaacaccctacaaccacatatacaacccacccatgctcaacattgcaacacatgccacactccactacccattcctgaaccactaaacaccacaaacgaccacccccacaacactcccatctacatagataccataccccactacactcaaccaatcttaagtgcacctaagtctgatgacaaggactctcttatcagaaacttggcagcagaactcaagaaattgaccagccgagtccagggcatggaaggaaacaaagacatagaggggctgaattatgaggacctctgcattcagccagatgttgaacttccggagggatataaacctcccaagttcgaaatgttcgatggcacgggagatcccagagtccatttgaggacatattgtgataaactggtcggagtcggaaggaatgagaaaatccgtatgaaactcttcatgaaaagcctgaagggggatgctttatcctggtacatcagtcaggaccccaagaaatggacgagctgggtaggtatggcatcggatttcatggataggttccaattcaatacagagaatgcaccggatgtattctacatccagaatctgaagaagaagcctactgagacattccgcgagcatgctacccgttggagatcagaggctgttaaggtcaggccggccttagaagaggaacatatgaacagatttttcgtccgggctcaagacccacaatattatgagaggttgatgctgatcgagggccaaaaattctcgtatatcatcaagctgggagaaagaattgaagaaggcattaagaatgttatggttactaatcttgaagcattgcaggcgaccaacaaggctttacagtctggtggcacgtccaagaagaaggatgtaaatgccgtgatggttgcacagggagccaaatcaccactaaaataccacacctacccgtcacctccacttacatatcagcctatcccgaattaccaagcacccgcaccctcttaccaaaatccaccacccgtttaccaatcatctccacctcccgcatatcaatccacttcacctagatactctcaacctacacctgtttagcaagcttataatgcccaaccccctcactaccaatcacctcccactcgccaaaatttccctatacccagaccaaattttgaccgcagacctcccagacaatatacaaccatcgctgagccaattgactagctgtatgagaaacttaaagctgctggttacatctcccctatccctgccataactccagaaaatccttcccagtggatcaaccctaataagacctgtgcgtaccattccggcatgcaaggtcacaccattgacgaatgccgctcgttgaaggacaagattcaaactctgatagacaataaggttatcatagcaaagaaacctgctcctaatgtccgcaacaaccctctgcctgatcacagaggtggggacattcacatgatcgagatcgaagataattgggaccccaagggatcgataggactgattgctgcggatgatgagccaaagaaaccaacagtcaaacttaacccaattgttgtgcagaaccagccctccagggacgatgaagtaaacatgtctatacctctcgaatttgaagcaccttcttctacgaaggtggccgggccaattgaggttgggtttggagttccaaaggaacctataccctttgaagttgctgtgttacccccgagggcacccattcccatagcaatgtcagacgtaacatcgttccactagaatgccataccatgggattacacagctgaagcaaggaggaaaggaaagaccaagacgggagaagcaattgatgcgcagggtatgaccagaacaggtagggtttacactccatagcacctagctgagtccagtaagcaagcctcgggacggactactgaaactggtcccgataatctttggaggaaaatacaagctaaggagtattcgatcgtggaacagttgaacaaaacaccagcacagatctccatcctagctctcctacagagctctgacacatacaaaaatgccttgatgaagatattaagcgaagcttatgtgcccagcaacataactgggggcgaaatggcaaatatggtaggacaaatactggaaagccacaaaatcaccttccacgaagatgaactatcgccgaaaggactgagtcacaacatggtcctacacatcaccgtgcaatgtgaggattacttcatcactagagtcttgatcgatgaaggctccagcctcaacatctgtccattgataactctcagaacattgggaaatagcatacacgagatcaaagatggggccatcaacgtcaaagacttcgatgggtcccaaaggtatactatcggggaaatcagcctatgcttgaaaatggggccaacctggttcgacattgactttcaagtgatagatgtcccagcatcctacaattttctgctaggacgaccatggatctatgccgctggagctgtagcatagaccctgcatcaggcagtgaagttcgaatggaatcaccaagaggtgatcattcatggcgatggtagcaaccccatatatagtcgccagaccatcccgatgattggaggcagaaggagaatagtcggagaaacataccaccacattgaaagagtcaacgttgtagacaaagataaatggtgggataacaagattgaaagtatcctgaattggtgtggatacgaacctggaaagggactcggcaaaaaactctagggaatcgccaaacccatcaagctgaagaaacatggcactacatttggtttggggtatgagtacacttgggaggagttcaatcactggttgccaccatggcgcggtccctactacccactggagcacccgatacctcacctggatctgactttccagccgatagatactatatatgggttggaggaagatgaagcattgacagccatgaagaatctgttcctggaggatgatgatatagattgcggtgttattttcgaggaggaaggcccttctatacaagttgtgaaccgaggagagagcctcaacaattggtcaatcagaaccaccagggcccggaaagcttcggggtagcaaggctaaacaaaagcaccatgcatcatattttactttttactagctgattttatttccgcattgtctttaattctgaaaagagctctgatactcaaaacaattatgaatctaattgaagcatttcagtttattatatatctcgatcttaatatttttctatcattcattttattttacacaacattactattacttgccttgatgatgaaccaacgattgtgacttgtaacgagacaacgcaacaaatggatacagactcagaagaggatgatataccagaagaggtcgttagaggagttgagaattttgaaaatagtcctaattctaacttggatgaaactgaggtcgttaatctgggagatgcagagaatgtcaaagaaatgcgcatcagtgttcaccggtcaccatcagaaaagaaagagtacaaggagttcctaaaggaatatgaagacatattcgcctggtcatatgatgatatgactggtctcagcacatccattatagctcacaaactgccaacagatccaacatgcccgccggtaaagcagaagctcaggaaattcaaacccgacatgagtttgaaaatcaaagaagaggttaccaagcaagtcaaagccaaggttctcagggtagtagagtattcaacatggttagccaacatcgtgccagtgccaaaaaaggatgggaaagttagagtttgtgttgactaccgggatcttaatcaggccagccccaaagacgacttccccttgcctaacatacacatttgtatcgacaactgcgccaagcatgagttgcagtcttttgttgattgtttcgctgggtatcatcagatatggatggatgaggaagatgcagagaaaacagctttcatcacgccgtggggaatgtactgttacaaaatgatgccattcggtttgaagaacgctggcgccacctacatgagagacatgactaccatctttcatgacatgaaacacaaggagatcgaggtatatgtggatgacatcatcataaaatccaagaaagccagggatcaaatggcagatctaagaaagttcttcaacagactgagaaggtacaatctgaaactaaatcctgccaagtgtgcattcggggttcctgctggaaaattattgggtttcattgtgagtcgtcaaggaatagaattggatccatcaaagttcaaaactatccaagaattaccgccgccaaagaacaagaaggacgtgatgagtttcctgggaaaactcatctatatcagccggttcatagctcaatccacggttatttgtgtacctatcttccaaatgttgaagaaggacgctgctaccaaatggactgatgattgtcagaaagcttttgacagaatcaaggaatacctatcaacgctgccggtcttggttcctccttagccaggaagacccctattgctttaccttatggtatcagatagagcattcggttgtgttttaggacaacatgataaaacagggagaaaggagcaagccatttactatcttagtaagaagtttacaccgtacgaggcccggtattctcttttagaacgcacttgttgtgctcggacttgggtcgcgcaaaagttgaggcattagttttgtgcttacactacttatctcacatccagaatggaccctctgaagtatatcttccagaagcccatgcccactggcaagctcgccaagtggcagatcctgctaagtgaattcgataatgtttacgtgacctagaaagcaatcaatgggcaagccttggcggaccatctcgccgagaatcccgtagatggagaatacgagcccctaaaaacgtattttcccgatgaagaggtatctttcataggagaagatattgcagaatcctatgatggttggaggttgtttttcggcggagctacaaatttcaaaggagttggcataggagcagtcttagtatcaaaaaccggccaacactacccggtatccgccaagctcaggttcccttgcaccaataatatggccgaatatgaagcttgcatcttggggctcaaaatagctattgacataaacgttcatgaattgctagtgatcggggattcagacttgctcatacatcaggttcgaggagagtgggcgaccaagaactctaagatacttccctacttgcatcatatacaggggttgaggaaaaggttcacaaagacagaatttcagcacgtccccagagtccagaacgagttagctgatgcattagctactttatcgtccatgatccagcatccagataaaaatttcattgatcccatcccagtaaagattcatgatcagccagcttattgtgcccacgttgaggaagaagcagatggaaaaccatggttccatgatatcaaggagtacttggcaataggggaatatccaggacttaccaacactacttagaagcgtacacttcgtagtctatccagcaacttctttcacagtggaggaatcctgtataggaggactcccgatttgggtctactaaggtgtgtcgaaacaaaagaagcatccaggctattggacgaggtgcatgcagggacctgcgggccacacatgaatggttgtcttagaaaaaacgatactccgagcagggtatttctggatgactatggaaacagagtgtatccactatgttcgcaaatgccatcgctgtcagatacatgcagatatgataaaggcgcctccaaaggagcttactgtgacaagctcaccatggccattcgccgcttagggaatggatgttatcggacctatcaagcctgccgcataaatgggcacaggttcatcctagtggcaatcgattattttaccaaatgggtcgaagcagcatcatacacggcggtcactaagaaggttgtggcgggtttcgtccgtgaccgcattgtttgtcagttcggggttccggaatcaatcatcactgataatggatccaatctcaacagcgacttgatgaaaccaatgagtgaaactttcaagatcaaacacaagaactccacagcctacaggcctcagatgaatggagctgtggaagcagccaacaagaatatcaagaagatactaaggaagatggtcgaaagtcacaaacaatggcatgagaagttatcatttgccttattgggataccgcactacagtctgcacatcgactggagcaactccctacatgctggtttatggtatataggcggtcatccccgccgaggtagaaatcccctccttaaggatcatacaagaagtagaattggatgatgcagaatgggtaaaaggtcactacgagtagttagcccttatagatgggaaaaggatgaatgcggtttgccacggtcagttgtatcagaacagaatgtccagagccttcaacaaaagggttaagccaaggaagtttacaccggggcaactggtgttgaggaaaatcttcccacatatagatgaagccaaaaggaaattctctcctaattggcagagtccgtacatggttcaccgagttctaactggaggagcccttattcttgcggagatggatggagaagtctggccgaagccaatcaattcagatgcagtgaaacgatattatgtgtaaccacttatgattcccttaatgatgtaatttgaactacgcgacctgattcctgtttaagaggggatacgtaggcagccctatgggttcgatcataatttaataaaaattccatttttcccccgctattggagctggggcagaattttgaggagggccctcaaaattccgaagttaattttagttcatgcatcgccagaagcgccagcccagcaaaccggggcagaattttgaggagaaccctcaaaattccaaatatgtttttagtcatttagcacagccgtcagaaacgtctgctcagcaaactggggcagaattttgaggaggaccctcaaaattccggagaaaagaggttgcaatgtcctgaaccacggcgcagtcgttgattcatctaaagaaaactattttcgattatatacgttatatttgctaaatcatggataattattatctgaattgctgttgtttagcgacgctaccccaatgacacacaacgtcaagagcccggggaagacgaactaacctttcccctcacagaactcatgattttctttggatgcaggcactcgacttgcaatatcgtcaggtatatttatgtacgcatactttcccaagaatgcaacttctcagaatcatcacttgcccgcaattgctatccgtacctaatctccccagcagtcatattgtcgtaatcggctatcaactaagagatcttactactgatcatccttttacattcttgcactgcataagactacttttctaccttccaaggttaagctctacctccatctgcattttgcataaggctacttttctgccttccgaggttaagctctacctccacctgtatttttcataaggctacttttctgccttccgagactaagctctgtctccattcgcatttcctgcatttcataaggctacctctctgcctttcgagactaagctctatctccatccgcatttcctgcatttttgcataaggctacctttctgcctttcgaaggttaagctctacctccatccgcatatctttgcattgcataaggctacttatctgcctttcgagactaagctctgtctccatccgcatttcctgcattttgcttaaggctacctttctgcctttcgaggttaagctctacctccatccgcatatctttgcattgcataaggctacttatctgccttttgagactaatcattgtatccatctgcatttttgcataaggctacctatctgccttccgaggttaaactctacctccatcctgcataaggctacttatctgcctttcgagactaagcattgtctccatctatattttgcataaggctacctatctgcctttcgaggttaagctctacctccatcatgcataaggctacttatctgcctttcgagactaagctctgtctccatcctgcatggctgaaatatcgccactttattttgaatggctgcaatatcaccatctgcatttaaattttcgctctggctgaaagatcgccactctttgcattcatttggctgaaagattaccaccttttcatgggctgaatgatcgccaacttattcaaaggcgtcatagttcggaggcaccatctgcatagcccgagaacaccatttcatgcccgcgattttttttatgctcctcatggcccaggacatcatagtctgaggacgtcatcctaaccgtccaaagacaacattcatggtccaatgggaacttgcatcatgtttaaattatgcataatacacgctacattgctcacttgcaggtacaccggctagcaaacaaccatctcagtaggagcgatcccgctccggttctccgcagtctgtccgactccaaatctaatcatcacgttcgttcttttcgaatccccattcgacacactccgtcaatggtttctgaactacatatgacctgattccgataaaaccagggatatgtaggaggctccaaatccagatctcggtcaaaacgcttttcaatcgccgatccggtcaaaattagccatcttgtctttacccgacaactctttcatcctcctcgggtaaagaggggcagctgttgatatccaatttttccctatgtatttttgtgcccaaaacacttccaaaataacatatatgtgcatatataagcgcaccaaaaggttttggcgttttaatgatttttaaaccaatttatggcctatttttacaccataaaatccaataattattcccaaagctttccattttggagaataatttattgtattctcatacttacgccaaaatatatccatcatgatttttgcacattttttacaaattcgtttggtatttttaaagccaaattgcatataattgcaatactagcctttaagatttaatagcattttataattacaaaattgatctcactatttttaaattaatatttatatattattagttgatttagtacctttaatttgcttttataacagttttactatttttataaaataataaaaggaaaaattggctatttcaattgtagcctcaattcatttcaattataacccaaattccatttcaatttcagcctgaaatcagcccaatttcgaactcaattggaccaacccaatttattcaaacccagccccttgacccattttatccaacccgcccggaaatccttttaatccaggccgttgagcattttgatcaacgaccttttcctttttaattctaccacccccaaccctgaccctcatttctcttagacagccacctctgaaacctcttctctctcaaaacgctctcaagcactcgaaaccctaatcgccaccctcgtcttctctgaccattatctcgccggagtccatggcttttcaggccatggacgacctgtgctcaccttccttcactcctaagccatgggtgttcgacatttcgaggtttcacctcaatgacgttcattcagatcttctcagatctgtggttctatggcctttccggccttgctccgacgtattcgagctttagaatcctagccatggccatctctgactcaagaccagacctcttccaagccttctcatatctagggtttcagagaaaccctaaagctattcgaggttccttcctcttttatttacttagatctgtgatgcatccgtgctatattcaacgttttaaagcttttccccaattttcttttcaaaatttgttcgctttcaatttagggttttcgaaaaaatctcaaaataacttctgactcttcttcttcttcttttctttgtgtgaatctgtctgtaccacgttcttatgagtttttctcttgagtttttatgttttccatacgatgcatgttcttctatttttgtgttctgttcttccctctactgggttctataagcatgctttacatgtctatctcgtatgttcctctactgtatgttttactgagatttttctccttgcttacctttactggactttgtttgaaccctaagcatgttttatctactattttcctaaacccgtatcgctttttcttttctgaatttgtttgagtgacaagctttgcctaaatgtattccctgtgtttcaaacttgttgttctctctgtttgtttctcataagtctctgaaagagactactgagcttgttctatttgttgttttctcatctatgcatttgattcgagtcagaaaccctagtatttggggttttttggcaagcttgactttgtgtttggactagggttccattcagaaccctgactctctttcagactcattctgagtctgtgaacctaaccttcttgggtactctaatttcttgctagttttacatcaactctctcttgtctcacatgtctgtatgctttttatatgacaaattctattctttcaaaaggcctttggccagcttgtgattgattctgagttccttttttaaaatgtttgattgtgtgttgttgattttctttaaattaaacccttctcacctttttctggttggattcattcacactaagattcgaatcctgattttacgggcaggttgattgattgtctttccttgtttgacctaaaccgtgtactactaaactgtttccttaaataggtttatgtgtctttgcccctattatactgcctcagaaaatattgtttaaaacaattcctttccttatttatttttcctatttgaatcaaatcccttaaccaaagggaaataacttgtgattgatttcaaaactattctcttaccttttgatttactcaccttctgcaagagtaaaagggactgctcttttgcactaaagaaagggttttacagatgctttcacagacttttctgcacaaaacacaggcttttacacattcgaatactgagttctttcacaaaaaaaaaattctactctcttcttctactttgtgctttctgaaacaattttgagctctctctctaaactctcaagtgttctgctgaacttaagtctgctcctgctgtgtttacttgccgtgattgctctattgttcttcttgttcttgctttgcaactggtacgttattcttagttgaataatgcttcttcattatgtgtttacttcctagtctgttatgttcttttttactatatttctgcaaccctgttgtgcttttcttatgtgaactccctttcccttttcccctttgtatgtgagtatagttccggccataacaacactttgatattgctgtctatgactctgaactgggttctttgaacctcctaaatcaaacaattcccactcccttctcccctttatgtgcttgagcctggacctgagtctagtggtgtcctaatcaccatccagacctaggtttgagcctcaagggtctgctcctaacttgtttgatcaaacaaatggtcaggggtgtgccagtctgcacctgtggctgggtatgcccaccatttgttatggctccccaattccttttcactttgcacttactcctagctctaagttctgcccctctcttgcaagccatgctttgggacccttgagctcccactgaacttggatgcctgaggcctagctattccgtactgcactattctaattataaatggtatcctgagtgtaagcaatgccgagaatccttgagattccttggaactttgaaacactttggataaagagaaggctttggaaatccgaaattggttaatcacatgttattggacattaagattgaattaggctgctcggatctagctgttagtttttaatgtatttattttctttcttttggtctgtaataatttgtataaagaatttggggaatatagtaaaagggtgtgggaggggttttacattcttgcatcagtaagggtagaaaccatgctttaggattttaatgtttttttagaaatcctgcctataggattgttcaatgtttctgattccacatcacttagagaccatgcctatagggtcaatgcttcattgtgctacaaatcacatagaaatcatgcatataggacttaacgtttatgtaatcaatgcatatagagatcatgcctataaggaatgcatatgcatcaggcaaactgtagggttaattaacacaatcatcttttacaagttcaataacaggttttaaaagtcaaaatagatatcatgcctataggatttgcatcaaactcatctgattcgcttaaagtaataatgatctattaactggtccttaacgtcttaatacaacaacgatttcataagtcttaattctttgacaaaaactctcttgactcagtatgcttttaagtccctcaaatcgacatctttttctgaaacagtttctttctaaacgttctgcctaaatgttttactcagaccctgaaattgtcttttaaaatagttgcaacttaccctttccttagatatttctatctctgaaactctttcacaaccatttctgtgttttatttttattgcagtctatactttcttttcaaaactcctctacattagactactttttcctgaaaccagtaccttttaaatcactcgcttgcaataccttaatttctgacaattggatccaagtttcctaatgcagactttctatctaaacaaatgggttgaaccagttcgttcgctgtttaagtttaatttaaagaccaaatcagtatgtgccaagacatgctaaactaagtgtttgtttgattaaggggtttacttgagccttacctatttgttttgttcatccttatatttgttacttgttttgtatgtcgcaattagaattttaacctttgaactccatatatgcctatatccctttccttcccctttaggattagaagtcctgataccccaggactgataggttaggacgagtactagcatgcaataagtaaatgagactgatcgcgtttaaataccttaacgaggtgggaagggtagaatatggatatgatgaccgatgcgctaatatcacgtgcgacccctcttctgaggagtgatcgctaagtattgcattgaattgatccatattaattataaacttaggactcccctccctttattttctttcatctcttcttgtaaaactgttcaaatctctttttcatgaatttctgccctctctacttacctccaaaaattttcaacttggtcgcaatgttatgtgagaatccttatttgagccttgactatttacttgtaaagtcacaattgtaacatggccgggaaccacactagtggatcttgaggggtgcctaacaccttcccctcgggataatttctagcccttaccctaatctctggtctcttcatctcaaacccttcttaaagtgtcctaatgcactataatcattaggtggctactcttcaacctctaaactcaattctcgaaaggggatagagttgtcctcccaatgtcgtatacccaatttctgaccccgcggttagagaaaaagagggtgtcgacagcatttgcgaaggcaacctcacaaatgcgaagctggactgcatgagaagcattcgcatttgcgaagaatttttcacttttgcaaaggaccagtgctcgcatttgcgaccagtttggtcgcatttgcgaaggcagcagagattccaaatcttcgcatttgcgataagttgttcatatttgtgaacctcatggtgcaaatgcgacatctgcagcctgttaagtgttgagaattccgagacttagcttcattttcatatattttgaaccctagcttcgatgagaggcaattttgtgaagggattttcatatcaaatcattgggtaagtgcctctaaataatttccaactatatttcatgattttacataaaatataacatcaaattcgtgagaaatctaggggaaaatttgggaattttgtcaaagttttaaacaataaaaatttggaatttgagagtcgaatagaactcggatttgaaaataaaacatatatttggactcgtgaggccatgggtagtcaagatctacccttggacctgagttttgaccaggcgggcccgaggtttgactttttagaaattgaataaaaatcacagctttattaatcaaaattattttctcttgcattgtgtgatgtattcaaatcgtcgttggctagattgagttgagcggaggtgaatttatagaggaaaatgctaaattaagtgttgagttagccgaattgaggtaagtgttttgtctaacttatttgagggaattgtttctcctatttgtcattgtttgcttcaagcggggatgatacatatatgaggtgacgagcatatatgtatatgccaggattaatcaagctcgggaggtggattatgttacacttgtggttgtagaccttcctgcttcatgccttacttgactcttagatactaagaacatagtattaaatgttagaaatcaagagttatcttattataacttgatcaaatttgatggaaaatctcagcatacattgacttgtctaattcagtcacctatatgtgtaatcattactacattactatggccgatattcttgagatactagactctatacaattaagttgtggatcatttgtgagatttgtggaagtatatgattattgaggattgttgaatcattgttgactcggaaagttgtgattgagatttgtttgatatacccgttaaaatactctccttgatgttatttatgcttcctgcctgtttgtctttgaaatccatatgccttgtacggaagagtgtaaagcacgaagggtgatgtcataacactgtttatacattatcatgtgaggaagagtgtaaagtacaaagggtgataccgtgccacgttattgagattaaaagcccaaagggtgatgccgtgccacattattgagagtaaaagtacgaagggtgatgtccttccacaatattgggagtaaaggcacgaagggtgatgccatgccgtttcatttatattgttatactttatgttttcttgaggtcatggcacgataagtgtttccgtgcaggcgaggatgaggggcatgcattatgtttgatatcactctacgtgtatacattcatgtttttaccttgaactgttattgttataattatagatctgatgtaacttgttactattgttctgtcattgagctctatctcaattgttgttgtgttgctcatatcttctacttgcttaaattgcaaataccatgcctatttcctgcttttataattatactcatgtcgtatctattttgttgcactttagtataaaccttccaccatgctagtcattcacacccttacttgttaacttgtaaagatcatgtgtctccttcttaattgttatatttgcacttaggcctccattatgcttgttaattggagataatattccttattttccaattattgttattactcacatgcttccgcctagacttttgttgttgctcacatgtatatccttgtccattattgctacttgcatatttcctactttgtaattcttgttatcggtatttctgtcatcttgttggttctgttatacgtacatttggaaggataagttgaacgcacgaagggttttaccgtgccatttgacatgaaatcttggatatactcctcataccagtaaagattgaaattcttctactgtgattccttctagtaattgttgactgtctcgcgcagtggtatatgatacacttatctattatgttttgaactgcctatattgttagtctaatatacagcttataacaataagcatcttttaattaaaagcctcgtcactaattcaataaggttagacaaaatatttaccagtacatggggtcggttgtactgacactacacttttgtacgttatgtacagacttttggagcagagctgctggtgatgtcgagtacttactctaaagttgttcgtgcattccggatatagctgccacttgttcttggtagcttaggttttgctaatatctttacgtaattatgtattagtttatcaaattccatgtcttaaaagctcatgagtcgtactaccagttcttgggtaaatttgtaaatgttcagataaatctttgctatttcctataatctcttttggactatattttttgttagtagacttacctagcagatcgagttaggtgctatcacgaccagttattttttttttctgatcgtgacaaggtggtatcagagcactaggttcgtaggttctacaagtaatgagcaagtgtctagtagagtcctgcagatcggtatgatgacgtccatacctatcttcgggagattactgggaatttaggaaaaatttccctttcttatttccttatcatgcgaccttgttttagcttgaaatgtacaactttgactcctctcaatcacttatatgtgaggttgtgcaatcagtattcattatatgtcgacgattggtgatgctgtagatagattacaacgagttatgcatgcttgtttatcattgcgatatgttgtctagcctaaaaaacagagggggtgttaaatcatccagtcgttcattcatggtatgaggttggttcatatgactggttggcatgtacagatttgggaagattgactggtggcctagctattgtgattaaggtgggttcatggcaaggtgtcgatttgagtataaccggtgggccatctcctgcatgatgagtttggatcgtgtgtctcgtatgaggtttccattcagtggagtgcaagtgttattatttcaaagcatttggcggaatttgtttgactattgcaataatgggtaagagcttgacagagtcttcggggtgttctatgattagtattgcatgaatttttgaagtattcaactaaatagtcgtgcgggatcggggcatgctgtgaagattactttgaggtgctgatgaggtattctatttctctgagttaagtggtggagtctgctaaagacaatcggattgtaggatcatgggccgtatcagtttttggaccgagagattgcttggttattcctttaaatgggcatatactggtgaaacacgggtttttcgatgcgtattagctatgtattgaagatcagagtaagatgagtgattatcgagaaggttctggtaagttccaggtcttatgtagcctttaaggacttttgaatttttctatgggcaggcttgaaattggtagcgaatggtaatcggatctgcagtatttccttgtcaagaaaggtctacatgttaatattgaactgatgtaagaaatggcttcgggttcccaagaagttcccccagggaggtcatgtcagattgagttactttcgggttggcagtctatgtgactcggttgagttagaggtgactggttctgattactcgattatgtgttaccgagtttcgaagaatttatcatggttatgaccaaagtcggagttgatgttttctacaggtatagaagctatattgctataagatgttcatagtgttgcaagtaatcatgttagagacgatgcaccgtgtagggttgaaaagttgcatgtacaaggttgcagttaattttggagggaaggatatgagttcttcatgatacggacgatttcgggtatttaaggttttgctggcactatctgttcctaccggaggagagttctattgttggcaggtacattgtgttttgacttataagtatttttcgtacgatgatgtagtatgagtcacgtgtcagccatttgtgtagcgatgttgaaatttaggtatgaagattctggtattcgtaaggtttagaggctggataatctcgttggcaaactattcttggattgcgagctgtgaagaaatgttgaggaccggatgattgatagtaagtgttattggaaggatgccatggattttggaaggttaatttcatgtttggggatgatgggaatttggtttgggggttgcttttgagcctaatgagaatgtgtattccgtatctaattggatttgtttgttcttgcgtagttgttaccacatgtatatcatcgggcggaatggatgttattcgcaccttggtttatgttatatgtttctctcttatactatgatgggttgtgagggttacatgattctttacacgaatattgtgattcagtttaggcctcatggcactatgggcgaggtggccttcgtgatgttgatttgctaattgcaccataattgtgcttgtccttctcagtattgtttgtttctaataattttctcacagttatattttctgcactttgttgtgcttgatgttgatgcacatgtggtcaataagcccgatgttttatggcttgttgggtaccctatgtggattgatatgatgggatcgggttgcacaccacaacagtacagtgatcaaatgtgactccttattcctatttcgtgtattttgctttcaccttgttgaagatagttcacagtaaaatgctaacatttccctgcctgcttaacttgcttagtagccttcttatttagttttcttactattatctatcatgtctgaattattacttgttagtacatggaatcgggttgtgtggggctttatatgatcattgttggtacttgtcgatgaggctgcttgtattggctgagatgaggtttctagacctaagattttgcgctattgtattgagatgaggaaggtttggaagaataacactatattttgtcgaggatttggacaatagccctggtcgggcgagtgagtttcttggcttattgatcagatgattggttaagcggttatgtgtgtttctttcatcatcgatggggtatgaaggttttgaatgaggttctaattaatatgaggtttgctaccggcaccagatttgtttttgggcagtaattgtggttagaagttcctaatgtgagtgtcgaagtgatgaggtatatcatgtgactacatcttgggttaaggttatgatttgatacaacttgttcagacatatacagtgtgtaactttgggattcgggtcttgtaatgtattttggatgatagagattgggttctatggttttaggactaaggttgaaataaggatctctaatggtgttatgttggctagcttatgtggaacaacatgacatgggatcacctcaggttgatgcttagtaagttacaccaggatttgatagctttggaacgactcctggcacgttcgaggatgaacgtatgtttaagtggtggaggatgtaacgacctgacttgtcgttttgagtatctgcactacgatccatattttgaggctcatgtatctcctcatgatatattatgacatgcgtaaatcgtcggtattggttttcaagttatccggaatcgatttggaagaatgaacttcaagatttaagttctaaattggaagaattgaccaagtttgactttttagtatttgacctcgaaatggagtttcgttagtttcgttagctccgttgggtgactttggacttagaagtatgtccgaattgtaatttggaggtcagtagttgaattagtcttgaaatggcgaaagttggatttttgaccgggagtggaatttttgatatttggggtcagatatcaatttaaaaagttggtataggtccgtaaaggcaaatgtgacttgtgcgcaaaatttgaggccaatcggacatagaagttgaagtttcaaatttcattgattttgacttgaggcgtgattcatcatttcaaggttgatatgcgtgatttgaagcttcgggtaggttcgttttttcatatagaacttgtttgcaaaatttagctctattcgtagttgatttgatatgtttcggatgctcggttgcgattctagaagttcttgaagtttaaattaatcttcatgcattttagcgtccgattcgtggttttagaggttattttgatgttttgatcgcgcgagcgagtttgtatgatatttttagacttgtgtgcatatttggtttagagtcctgagggctcgggtgagtttcagattggtttcagaatgatttttcataatatttgattgctggttttggttttgtcgcatttgcgatgtgttggtcacaaatgcggccatcgcatttgcgaaggcaacctcgcaattgtgaagctgggctgtaggagaaggatttacatttgcgaagaattttctgcttttgcgaaggagcagtgctcacatttgcgaaggcaacagagattctcaatcttcgcatttgcggggttgtcgtttgcgaaccccatgtcgcatatgcgacatctgcagcctgttaagtgctgagaattccgagacttagctttattttcatttagtttgaaccctagcttcaatgagaggtgattttgggaagggattttcataccaaatcattgggtaagtgcctctaatcaattttcaactatatttcatgattttatataagatttaataccatattcatgggaaatcttggaaaacttttggggattttgttaaagttttgaaaaatgaaattttgggatttgagagccgaataggactcggattgaaaacaaaacatatatttggactcgtgaggccataggtagccaagacctacccttagatcgggcggccccggggtttgacttttattgactttttagaaattacataaacatcacaactttattaatcgaaattattttctcttgcattgtgtgatgtatgcaagtcgtcattggctagattgagtcaagcagaggcgaatttgtagaggagaaggctaaattgagtgttgagttagccgaattgaaataagtgttttgcctaactttgctgagagaatttttcctcctatttgtcattgtttgctacatgtgggggtgatatatatatatatatatatatatatatatatatatatatgaggtgacgagcgtatatgtatgtgccagggttaatcaagctcgggggatggattatgctacacttgtgtttgtagaatttcgtgaccttcctgcttcatgacttacttgactcttagatactaagaacatagtattaaatgttagaaatcatgacttagcttattataacttgattaaatttgacgaagattctgagtattcattgacgtgtctaattcggtcatctctatgagaaatcattactacatttctacggtcgatattcttgagatactagactctatgtgttgtagatcatttgtgatatttgtggaagtatttgaatagtacgattcttgaggactgttgaatcactgtcgactcgaaaatttgtgattgggatttgtttggaatacccgttaaaacactctccttgatggtatttatgcttcatgcctgtttgtcattgaaattcatatgcttggcaaggaagagtgtaaagcacgatgggtgatgtcgtgtcatgttattgagagtaaaagcacgaagggtgatggcatgccatattattgagagtaaaaataggaagggtgatgccgtgccatattattgggagtaaaagtacgtagggtgatgccatgccattttatttatattgttatgcttgtatgttttcgtgaggtcatggcatgatgggtattttcatgcaggtgaggatgaggggcatgcattatgtttaatattagtcttccgtggatacgttcatgtctttaccttgaactgtcattattataattatagatttgatgtgactttttgctatttttttatcattgatctctatctcaattgttattttgttactcataccttctacttgcttaacttgtaaataccatgcctattccctgcttttatatacttatgtcgtatctattctattgcactttagtataagccttccaccatgctagtcattcatgcccttatttgttaacttgtaacgatcatgttttttatttttcttaattgttatatttgtactcattcctccattattctagttaattttttttggcaatccgctaggcaagcgcctagggctagttttttattaataaaagaaaaaccaaaatacaacaattaggaaaagtataaataagggggacaatagcaccgatattgttacccatatgccttggctatataatcacttctctgcgcctcacattgccttatgatggcagcctcatgtagaggttcatggtgtagctgccggcaacgtctcacgagggcatataatctcatagccatgtggatatttttccaaagacaaaggacaaaggcaatactaaccgtgctaaacgttaccttaccaatcctattgaggcaaagagaaagcctcatcttctagaaagcatgtaaaaaataggaacttgaaagtaccaagtactgtatgatcgccatagagtttataacacactctatgacgctattacaagtgatgatgctttgaaaatgataaactaagacaatgtagaaattagaatcttgcccctcatttatcaaacttgtgagttcttcaatttgaacgtccttaaaatcctctttaactgtcttcaaataatcttcaaagtttttcatttgttgtcgtatctattggatttcgtagatttggaggtggcaaccccttttttctttgcagctcttattgggagttgcctgagtgttatttcttgagtcactttctttttttcagttttgttagaagtgaaatctccagttgtagccgcctcttccggacaagattcaatcaagtcatcctcttttgcttcttcggagatggcaacgcgtaagttgtcctcaagtttttgattagcttcatcttgtataaccatccacaatggttcatgcctcttcagtgtctttgcactacttggttcctgtctgtttgtcattgaaaaattcagcttcagtccggtcatttttgagtatgatgagaatgcacttttgtgtggttttggactgcccaaagcatacaacaactttctgtcctccaacgaaatagcaggtatatcagttaccattactttggctccagtcatgtttgcattagattgctgctgtccagtcgtgtttgcattggactgcttctacccagtcttgttcgcattggactgctgctgcccaggattagtattaacatcagctgcaccatctgatgcaatattcacagcaaactcaacggaagctacttgcgtaactgcttcagcattgtgagatgtaccaactagtgtagctggtagttctgcattatttcgaattacagtacttaatgtactagcagccatcatctgctgatcgtcggatttcccatttgcattcaatgttttttctagaccatcctcttccttacccagttgtgcagatgtatcagctcgattataccttgagttataacctgtagcaaattcctcagtctgagcaaccatatcatttgagactgcattgataggcttaccacgattatccttcacctctttccattgtcctcctaaatttccagtaggcttttgacctgtgaagatcacaatagttcctgtagcactagccttacctttcgtcttattttgagtatgtgaagtgtcatcgaccactccctgcatttgagtcacattgtcattttcttgcagctgattggcatctcttattgcattcaacaattgccttcctgaagtagaggtccattttggttcgaaacagcagccaaattaccctgtttctctgaaacaaagtccttggcttgaaccacatcttcatcagtagcccgtttctcgttagatttgtgttccattaaatttggatatagcctccagcactctatcatatcatggccctgcaatttgcattccttgcaatattttggcacgaagtcatactggattttcaccctcagttctcgcaactccagtagcctcattctcaatgtccatacgcactctcttcggcaaatctgcttgtaggtcgacaagtacctttactctaacacagctaggccttatttcgtttatggttgccaaatccaattgttatggttttccaacagcagatgctagagaaaacaaacattctttcacaaagtacgtgggcagtaaatgtggaaatgaaatccatgccatcgccataggtgtttcttctccgactttgaaatttttatcatagatgagctgtctcatttggtattcataaccatcttttgccttaatatagtaggtgctttttgacatgattttctgaaaatcctccctcaaagttagacgaatcagtacatgtttgtctctcaacaatccgatattacaatctcctttaataccacattgtacagggattaatcgacgcaattcctggagatctggccatccgtaagagaacttacccagcacaacatactgtagaccttcaataatattcattctatccaccttcgattatgtaaacttgacaaaaggttgtccatgtaagaaagtagctggtttgaaaggaattggctcaaccgatgcatctttctcgttcatctggttgttgattgttgatggttttaacaatctgctataatctaatggttggttgtttttatttgttgctgtttttgatggatcgaagcttgttaatggctgaccagccatagatgaaggctggtcgccggccattatggccattgagctcagatcgccacttttttccgcgatgaatagtagcgggatctactgttccattcactgtttgggcactgtagcgctactattttagactgtttggaactatttgacactatttattgctacagtgacgacggattttttttaattttctatagaagactacttagaaattaggtcttaatttttcaattccccctagccagattggttattagagagtattattctagttaattggagatgatattcattgtttttcaattgtttttattactcatgtgcttttcacctagtcttttaccgttgcccacatgtatatcctcgtccattgttgctatttgcgtatttctactttgtaatttctgttatcagtatttctgtcatctggttggttctgttatacgtacatttggaaggataagttgaacgcacaaagggtatttccgtgctaattgatttgaaatataaattatttatatatggtgagggagatatagaagcacgaagagtgttaccgtgccatttgacatgaaatcttggatatactcctcataccaggaaagattgaaattcttctactatgattccttctagtctaatgtacaggatataacaataagcatcttttaactaaatcctcatcactacttcgacgagattagacaaaatacttaccagtatacggggtcggttgtactgacattacacttatgtaacttgtttacaaacttttggagcagagctgctggtgatgtcgggtgctgactttgaagatgttcgtacattccggatatagctgccatttgttcttgaaagcttatgttttgctaatctgtttatgtaattttcaaatagaacgtgtaactatttgtatccgttttgcaaatttcaagtcttagaagctcatgagtcgcagtaccagttcttgggtaaatttgtaaatgttcaaataaatctttactattttcctataatctcttttggactgtattttctaatagttggtttacctagcggatcgagttaggtatcatcatgaccagtgcttctttttgggtcatgacaatttttttgtaaatagccatcaacgacacacgaaaaattctaaggccctaaggaaaagccaacttcaacagcatacatgagataactcaacagagaatctattttagaagcttattaaagtattttgacacccaaagagcatctaaaattataaaatttcataacagacaattgtttatttggggttttccttatcaagagatatagatacatttgtgtctgttaaaagagaaaagtattttatccactttacgacaattatgaaacaaaactttagactaatttattagttggaataaatgcaggggacttcggctgaatttgttagagtttataaatccaagtgtgaaatttattaaaatacttataatcatataactatttctaaatcaagtgtcatgcatcgagaatttatcaacagaaagaacagtcgttttaactttaacaaccattttaagcttcaataaaatctatttttataaacaacttgctatgtttaacaataatagataaaaaaatatttatctattatgtaactggagaatccatcaacataatacctagtagaaaagatcattaaacttaatccaattacaattatcaagtcaacactattgaatattaacccatatttaatcagagtaattcaatataataaagtaatacataaattctttagaataataaagaactaaacatcatctctcaaataaataagtaaaagtttaacattacttgaggataaacaaatatgcatataaggcttctaaatattttacagtaataaatcttcatcaccagtttcaggttctgattcgatgccttcaataatataatcatctaaggtaacattagtgctgataacatcaagatcatttcttccccagttcataaagtcttcatcttcctcaaacgtacacgagaactcttgagcattttgttgaaaaatttcttcactgacaacaccaccagtaaaataagtagaatgaccattcaagacaatggaccaattgggatgaagattaaccttgacataaaaaacttgttctgcttgagatgcaagcacaaatgattcatttgttgctagctttcggttagtattgatattaacaaaaccatattatctatcttcacaccttttccaatgttatcaacatccaatcactcatatttaaataaaataatcttttaccttcgagatattgaagttctactatttcggtcagagtaccataataatttatattttgaccgttcattatttctcgtactaaaacaccactattctacttcaccatgtttccttcaatttgtttaatataaaatctaaaaccatttatctcataccctttgaatttttggaatccatcaaaaggacttctagccaaagaacccgcaacttacatgtgaatttcctttcttatgcatttgcacaatctgtacaataataaataaacaaaataatgatgctaaaaggtattacaaataaaaattaacaatgtaatgaaaacttactcgatggaaaaaccaagcgccgaagttcatgttcctattgttctgctcgtactcactatttaaaataaccataataattgaaaaaaggctagtaaaatcaagtagaaatgtgcaatggcataaagaaacatactgtaaaaatggttgaacttcttcacaatttctcaaaacttaaagatgagcttgttttcgctcaagctcttcaagatttctagatataactcttaataaagggcaacccttttgttcaaaaataataatccactgaatgtatcaacttgatcaccttcataatttttgtctactggattattctctttcccacttctgtgtaaataccttgtacaaaatatcagactttcttcaacaatatatccttctacaatagatctttcaagtcaacatctattacgaacataatattttaatttgcgcaagaatctacatgataataataggtagttaaacgcttagcatgataaattaataaaccacaaaagttaaattgaaattatgaaatacaaaaacataccactctattgggtacatccaccagtatattacaggtccagcaatcttagtacaaacataccgctcaatttgcctcttggtttattgttaatatttttttaaaaataaattttcctcttatctgggggtgttttattaatcaaaagctggttctcattagtacaacacaagggcccttcaaaatatctggcgaggtgataatataatacaagtttacctgccaccacaaccaacaatatatttgattccaatacttggtatttgacttttgtataggagaaagggcccttagaacccttgggaagttgctgactggagaagtcgtaagtttcagtccgagattttgcagccaatttatttaaacaatcagcgagttagttggcttctctatagcaatgattgatatgtatatttgtcttataccttatatgtatcatcttatcagtgatatgatccatcctataattagtctctttttccacccttaaaatatcagctagcaagagtgaatccatctctaaagggaaagttgtatgtaacgatccggcgggtcgttttgaaaattaatgccccgatcccctattaactgcttcccccgtatcattttcttctattgtgatttgccgggatggttcatcttgagtttcagagtattttgggacacttagtccctaaataagagtttaagtcttagaatttggagtgtaatcgaagcagtatgaaaatggctccagaatggaattccatcaattctgttagcttcgttctttgatttcaggcttaggggcgtgtctggattgtgttttggaggtccgtcgcttatttaagcttgaaatggagaaatttaaatttttagagtttcaagccgataatggaattcattaagtgcaaaatgtagggttaatcggacatggtttggttggtttcggcatcaattgtagaattttaagatttcaaattcattaagtttggattagagggtaatttttagttttagcgttgtttgatgtgatttgagagctcgactaagttcgtatgatgtttaaggattggttggtatgtttggttgaggtcttgggggcctcgagtgagtttcagatgcttaacggattgaattgggatttagatattctgctgaagattgttggaccagttgttttcgcacttgcgaattttggaccacaggtgcagtgccgcagaacggctgggacgccgtagaagcggaaagggacctatgcagctgagactgcaagtgcggctaggggactacagaagtgggactgcagatgcggcctggtgaccacaaatgtggacccagctcggataagtgaccttcgcacctgtgatgatttttccgcaagtacagaaccgcagatgcggccccatgagcgcagatgcgaaaatagctgagcagaaaagaggatttcgagggtttgaaatttcttaatacaaaacttgttttggagctcggtgggaggcgattcctcaatggaatttgaaggaaatctattgggtgactaatcctaactctagtttggtcataatacattaatcaattgttgtatttctcgtctaactaaggaatttgagggtagaagtttggacatgggggaaaaagctccccaattgaaaatatgaggtttgaatgggaattagacatcgaatttggatgatttttgtacgagtgaactcataagtgaatgagtgtccgtaatttgtgacttttacccgattccgagacgtgggcccggggaggatttttgggtgttttcctattttcttcttttagttttgaatttattagctaaattagttgcgtgtagctatatttatgttatgtaattgatttcattagatttgggcccctcggagttggatatttatggcaagagcgtgatttcagattgattttgagcttggttcgagataaatgacttgcctaaccttgtgtgggggaactccccttaggatttggtactgttgttatataaatacggtgtacgtgaggtgacgagtgtgtacacgggctatttgtaggaaattcccattttcattaagtaaatatctatgtttcccttaaatatattaataccagtacatatagtcatcctatttagttatgaaagtatgcctacgtgccttaactgttttaactgctttaactaactacttgaactttgtgaagcatgtttagagtaagaattacctgtctttttttcatatggacttaattagaattgtagattttccttgttgaaactgttgtttatattgaatgagttgtgtatttattttgagactacgaaacggtattgcgggagatccccctgcactggatatttattttggtactacggaatggtattccgggagatcctcctgctcatttatgatttggtctatgggatggtatcccgaaagatcctctgtacatttacgtttgggcctacgggacggtatcccgggagatcccctgttgctatctctatgtattaaattgatgttttctatgatttcatttttcattgactgttagtattcatatttactgcaatatttcatattgttttaccttattatttatataagccagtagggccctgatatgatctcgtcactactcgactgatgttaggcttggcatttactaggtatcgctgtggtgtactcatgccctttcctgtacatgtctttcatgtgcagatccatgtacctcttcccagccatattttcagtgaggcgaggcgatcttagaggcttcgaggtatatctgccacatccgcagatctagaagtccctctttactcttcctcaagttatagacttcctgtattttctttgttgatagattttctagagtttagaaacactatgtacttctatagcttgtgattcatgagtttttgggttttgagagtgcttaagttcagttcgagagtgttttattgtatatgctgagcgacattttaaacgtttttactagatttacctgttaaattgttagctttcatatttttcattctatttccgcaaattgttaggcttacctagttgtagagactaggtgccatcacgacagttcacagagagagaacttgggtcgtgacaagttggtatcaaagctctaggttcataggagtcgtgagtcacaagatggtttattaaagtctcacggatcggtatggagacatgtgtacttatcttcgagaagctatggaactattaggaaaattccaagcttccacagaggagccaccggcagctctatccggagcccatgcacctgatacgcctactactactactacttcagctctctataagacccctgcacagttcatgagcatgtacaacactctagctcagacatggttgattccccttgctgcagccacatctcaggccaggagaggagcatagactcctgccgctcgcactccagagcaacgggttaacattgatgagatcctggaggttataccggtaccaattgtagtcccaactcatcccgggagaagggcaacagtttcagaggagaaatagcggaggcttgagaggtataaaaagtacgaccctcctacattcagtggtctagtatcagaggatgatcagggatttttggaggagtgccaccgtatcctccgcactatgggtataacagagtcgagtggggtttctttcactaccttccagatttgaggggcagcctatcagtggtggcatacctttgagttggacagtccggctgaggcagcttcccttacatggacccagctttcggatatgtttttgagggagcatgtccctcaaagcctcagtgacacatgtcgcgcgaagtttgagcatttgtgctagggtactatgattgtttcagagtatgctgtttgtttcggtgacttggctagacatgcactggccttggtttctacaattcgtgagagagttcaccggtttattgaggggctcattcccagcatcaggtctagcatggcccgggagttagagatagatatcacttattagtaagtggtaagtattgctaggagagtagagagcatgcttgctcgagatagggaggagagagaggccaagaaatatcaagagtcgggccattattctggtgcccatgccccagctgcagctcatcatggtataggctatgtgagtcgcctcgttcattcatctcttccagcagtcagtggtaatctagctcctcctagaccttagaagccttattatgcacctccagtatctagtgcgcctcctgtatggggtgctttcagtggttagtctagcagacctggcccaagccaagcacaaccaccacatcctcccggagctttttttagtgtggtaacacacgccatatggtgagggatttccctaaacttaggaggggtgtacctctatagacttcttagccacaacatgctccacagggttccgaggctatgattacagcactagttgctaccccacctgctcaactaactagaggtggaggtcggggaggtagaggtcaccctagagggggaggccaggctagatactatgctcttcttgcctgtacagaggttgttgcttctgattatatcattacaggtattgttctggtctgtcatagagatgcatcagttgtattcgatacaggctccacttattcctatgtgtcctcttattgcccgcatttgggcgtatctcgggattctttgagttcccctatttatatttctactcctgtgggagattctcttgttgtgtaccatgtttatcggtcgtgtttgattgctcttagtggctttaagaccagagccgatttattattgctctgcatagaagaatttgatgttatattgggcatgagttggttgtcaccccattatactattcttgattatcacgctaagagcgtgacactggttatgctaggtgtaccgcgattagagtgcaggagtactttagattacactccagtagagttattttatttcttaaagctcagcgaatggttgagaaggggtagaacgcgtatctagcttatgtgagagatatcagtattgatacccctacagttaattcagtcccagtagtgcgggatttccttgatatgtttctagttgatcttccgggcatgcggcccgacagagatattaatttcggcattgatttgttgtcgggcactcaacccatctgtattcctccttatctatggctcctcctgagttgaagaagttgaaggaatagttacaggaattgctggataagggctttattcgacgcagtgtgtcaccttggggttctcctatcttgtttgtgaagaaaaaggatggttctttgtgtttgtgcattgattatcgccagttgaacaaagttacagtgaagaacctgtatcctttaccgcgtattgatgacctgattgatcagttaaagggtgctcgattgttttcaaagattaacttacgttcaggttatcatcagttgatgattcgggagctagatatctcgaatactactttcaggactaggtgtggtcattacgagttcctgattatgtcatttgggctgacaaatgccccaacaatatttatgcatctgatgcatattgtattccagccatatcttgacttgtacgtcattgaatttattgttgacattttggtataatcctggagtcgggaggatcatgagcagcacctgaggatagtgcttcagaccttgaaagaaaagaaattatatgcgaagttctcgaaatgtgagttctggttggattctatggtgttcttgggccacgtagtatcgagtgaaggaatcaaggtagatccgaagaaagtggaagtagtgcaaagttagcccagaccatcctcagctatagagatctatagttttcttggtttgactggttattaccgtcgatttgttaagggattatcatctattgcagcacctatgaccaggctgacccagatgggtgctccattcaggtggatggaagagtgtgaggtgaactttcagaagctcaaaatagctttgactacagccccagaattgatattgctcacaagttcggggtcttatactatctattgtgatgcctcgaggattgaccttggagaggtgttgatgtaggacggtaggataattgtctatgcatctaggcagctgaaggtgcatgagaagaattatcctgtccatgatctcgagttagcagcaattgtccacgccttaaagatctggtgttattatttgtatggtgttgcttgtgagatttatactgatcaccggagtttgtagcatctctaagatcactattttgtaccacccgggaaaagccaatgtggtggcctatgctttgaatcgtcgggcagagagtttgcagagtttggcttaactaccaacagtagagagacccatggtgatggatgttcaggccttagttaaccagtttgtgagattggatatttcggagcccaatcgggtcctagtcctagcttgtgcgttttctcggtcttccttgtttgattgtatccgagagcgtcattatgatgaccctcatttacttgtcctcaaggacaaggttccacatgatgatgccagagatgtgaccattggtgatgaaggggtattgaggatgcagggacggatatgtatgcccaatgttgatgggctttgggtgctgattctagaagaggcccacagttcgcgatattccatccatctaggtgccgcaaagatataccaggatttgaggcagcactattggtggatgaggataaataaagatatagttgggtttgtagctcggtgcctcaattgtcagcaggtaaaatatgagcattagagaccgggtggcttgctttagcagatagcaattccggagtggaagtgggagcggatcactatggacttcgtagttggactcccactgactttgggtagtttgatcctatttgggtgattatggatcggctgaccaatcccgcgcacttcattcctatgtgtactacctattcttcagagtggttggctgagatttatatccgagagattgttcgcctgcatggtattccagtttccatcatttcagatagaggcactcagtttacatcattgttctggacagccgtataacatgagttgggtactcgggtggaattgagaatagcatttcacccccagatggacggacagtccgagagcactattcagattcttcaggatatgctttatacgtgtatgatgaagtttggaggttcttgggattagttcttgccacttgcggagtttgcctacaacaatagttatcagtccaacattcagatggtaccatatgaggctctatatggtaggtgatgtagatcccaggtaggttggttcgagccgggcgagactagattattgggcacagacttggttcaggacactttggagaagattaaggtgattaagatagacttcgcacaacccagtccaaacaaaagagttatgcggaccagaaggttctcaatgtttcatttacggtaggagagtgggtcttgcttcgggtttcacctatgaagggcgttatgagattcggaaagaggggaaaattgagcccaaggtttattggcccctttgaggtgttgcgacgtgttgaggaggtttcttatgagcttgccttacctcccaacttggcaggagttcatccagtatttcatgtttcgatgctccggaggtatcacgatgatctgtctcacgtgttggatttcaattcagtccagttggataaggatcaatcttatgttgaggagccagtggctatattggacaggcaggttctaaagctgaggtcaaagagcattgcttctgtaaaggttcagtggcgggttcagccgatcgagtaagcgacttgggagactgagtaggatatgtgcagccgttatcctcatcttttcactacattaggtatatcactatggtcgtttgagggcgaataaatgttttaagaaggggaggatgtaacgacccgacagatcgttttgagaattaacaccccgatcccctattaactgtttccgtcatgtctttttctgctattttgatttgctgggatggttcatattgagtttcgagtgttttgggacacttagtccctaaataagattttatgttttagaatttggaccgtagtcggaatagtgtaaagacgactccggaatggaattccgtcagctctgttgggtgatttcgggctgaggggcgtgtccggattgtgttttggaggtacttagcttatataggcttgaaatggcgaaagttgaatttgagtttcgggccgatagtggaattttttatattggggtcagaatccgattccggaagttagaataagtcagtagtggtgaatatgacttttgtgcaaaatttgggatcaattggacttggtttggttgatttcggcataggttgtagaattttgagattccaagttcattaattttagattagagggtgattcatggttttagcattgtttgatgtgatttgagggctcgactaagttcatatgatgttttaggatcagttggtatgtttggttgaggtcccgggggcctcgagtgagtttcagatgcttaatggattgaattggggcttaggcatttggctgaagatttgctacacctgttgtttttgtacctgcggattttagaccgcaggtgccgacaaccgcaggtgcagtgtcagagaagcggctgggacgccgcagaagtagaaagggtcctatgtagctatgaccgtaggtgcggctgggggaccgtagaagcgtgaccgcaaatgcgaccccagcctggataagtgacctttgcacttgcgataatttttccgtaggtgcgggaccgtagatgcggccccatgagcacagatgcggaaattgctaggcacaaaagaggattttaagagtttgaaatttcataacacaaaccttaatttggagctcggtgggaggcgatttcacgagtgatttgaaggaaagctattgggtaactaatcctaactgtaatttggtcataatacattaatcaattgttgtattccacatctaattaaggaatttgaaggtggaagtttggaaatggggaaaaagtttcccaattgaaaatgtgaggtttgaatgggaattagacatcagatttggatgatttttgtacgagtgaaatcgtgagtgaatgagtgttcataatttgtgacttttatccgattctgagacgtgggacaggggatgatttttgggtattttcctattttcttgtcttagttttgaatttattagctaaattagttgtttgtagctatatttacgttatgtaattgatttgattagatttggctcactcggagttagatactcgtggtaatagcatgatttcagattgattttgagcatagttcgaggtaagtggcttgcctaatcttgtgtgggggaactccccttaggatttggtactgttgttatatgaatgccgtgtacgtgaggtgacgagtgcgtacacgggctatttgtggaaaaaatccgttttcattaagtaaatatctatgtttcccttaaattgagcaaaactagtacatttagtcatcctgtttagctaggaaaacatgcttacgtgccttaactattttcactgctttaactgcctacttgggctttgtgaagcatgtttaaagtaagaattacctgtcttttttataggacataattagaactgtagattttccttgtttaaactgttgtgtatattgaatgagttgtgtatttagtttgggactacggaatggtattccgagagactcccctgtatgtttatgtttgggactacgggaaggtattttgagagacccccttgcactggatatttattttgggactacgaaacggtattccgggagatccttctgtgcatttacgatttggactacgagatggtttctcgggagatcttccatatatttacatttgggactacgagacggtataccaggagatcccctattgttatctctgtgtattgtattaatgttttttgtgatttcatttttcattgactgttagtatttatatttactatgatatttcatactattttaccttattatttatataaaccagtagggccctaacctgatctcgtcactactcgatcgaagttagggttggcacttactgggtactgctgtggtgtactcataccctttcctacacatgtctttcgtgtgcagatccaggtacctcttcctagccatattttcagtgaggcgaggtgatcttagagacttcgagatatatatgtcgtgtccgcagacctagatgtccctctctactctacctcaagttatagaattcctgtattttctttgttgatagattttctggagttagaaacactatgtacttctgtagcttgtgattcatgagtttccaggatttgggagtacttatgttcagttcgagagtgttttattgtatatgcggagaggcattttaaatctttttactagatttacctgttaaactgttagctttgatattttgctttattttcgtaaattgttaggcttaactagtcatagagactaggtactgtcacgacagttcacggagggagagcttgggtcgtgacattatataaccgttttatatacaccaggccattccgaaaagtgttgcataagcttctgcaagattatggttgttgcaactattagggaatgagaatgccatgataatgctgccattatctttcctcaatgcacctcccagtccagctttcccatcattcttgttaaaacttctatttatgtttagcttgaaagttccattctctggtttttgccattgcacaacaatgcaattttgtttggggtgcatccttactagagtatcgcaaaactgttcaaaggcaacttgagattacaattaggataagtcttattgattgcggtttccacattccaactgatttgctgcttcaacttatagaagttgaatatatttttatttacatgcctgcaagcacaaatttcttcccatagtacccaacaaataataataggagtaatacttaacactagtttatgtccatcattaatagacttagtttgccaccaggtatttaacatatatttaatagggtgagggtgatagttaattccaagttgagagccaaaaagttttcaaacataactagctggagtttgtctttccaaagtctccaaaccagaaatgacttattaaaaggagtataagaatgtcaaatcttaccaatgtgttgttgcttaggtctaggatttcttatgtcaagatatttgttggagtattttccattctctataaggtcccaataaaccgtatcctctttgtcttgatttccaatgtcaacttttaggatatgatttctggaaggacattcttcagctttctaacaccccacctgctctcagtgatgaattcacaaaccaaagtaacactaaacctacaagatgacctttcaaggttcaattatcccaccaaaaactacttgagcctgagttgacttgctagaccatgtacttttccgcaatgtttcttattttacgaacatgcttccaggcatgagaattcccattatttcgaaaccaaatgagatctaatgcaatttttatgtctaacatatgtttcccatagggataatgtgaacctgatcccctaccacattttcatagtcaacatgtcactgatatcttccgtctttctaataccaatgcctccctcatttgtaggcacagtgagattattccaggaactccaatggtaccttttatgctcaatagagctaccccagaaaaaattaacaaaatatttttcaattaatttaaaagtagttttggggagagggaggggaggggggggggaagggggacatagcatataaagtataaatgggcagagattgaaggacacttttaatcaacaatagatttaccaccatacgacaaaagcttactttgccaaccattgagccttttcactatcttactaatcaagatatcaaaatattcaattctttttctacccatatatagaggacaaccaaggtaattaaaaaaaaattattatccatgaaaccaacgcactcccttattctattaatcctgctagttgcagttttaggagttatgaaaaaacacttgtctctgttaaccagagcatttctcatagttaccaatttgcttcataacaagattaatagatgtgaaattaccactacagaaaatatcaatatcatctgcataggctaaatggttaattttagggaccttatcaggcatagaaaaaggggtaaatccaggatgattatacaaattattaagagatatggaaagaacctcagcaactataacgaacatagaaagggaaagggaatcaccttgttttagatcttgataggaagagaaaaaacctcgtctagatccattaataattatcgaaccccacatattcgaaatcaatttatgaactatgtctatccagtatttagagaattcaaatttacttaacacataataagcaaaaggccatgccattctatcataagccttaaccatatcaagcttaataacaatattaactccattattcttataagcaatcttgtgaataatttcttgagctagtaaaatattttcagaaattagtctatccttaacacagtcactttgattaggagaaactaatttatgcaaaagtgggtttaatcttaaagaagaattttagagatgattttgttagaaaatctagacagactaactggtctaaactcagaaaaacaagaaagagcattaattttgggaatcaaactaagcaagtatgagagaagaatttagtcaaacctttccttttcaaaaactccagaacaaatgcaatgacctcctctttgataatatcccatcaattatggaaaaacgttccattatatccatcaagtcgagttgtgccaaaagcactaaagctcaacacaacatttttgatttcagcttcatcaaacatcttactgagaattaagttatcctcctcagtaatgcaattagaaatatactctaaaatagcagggttgaggttaggtgttggtaagttgaactaggaattgaaggtcctgactgcagctttggagatctttttatcaccccataattcacttacccatatgatttttgattctatttacttgttgcttcctccttttttccctgagaatgcggtgaaagtatcttgtattaatatcaccagcttcaaaccatttgaccttagatttctgtttgagcagagagtcttggatacttagccatctaatatattcagcatgggctttgttcacattttctcaactctactcggtgttgttttcaatgtctttatctttcaaatattgaagcttctcctcccggttgataacagcctcattaatgtcaccaatgtcttccttagaccattggcttaatctcttactgagagcctcaaggttggattgcacgattcacataggattacccataacttttgtattccaaattttcttaacaatatcatagaaaccaggttgattaacccaacagttaaggaattcgaaatagttaatataattgtggttggcgtaaagatccttcataagcaaaggtctatgattaaatccagtcctagccaaattcctaacggaacatctttgaaacaattggtcgcatagatcattaataaaagctctacccatctttttcaaatattcttccggggcctcctattattacaccaagtaaaatttggaccggagtagccagtgtctgtgaccccacaattgtctatacaattttgaaattcaaggcttttgtacattctataaggtttaccgtctaattttttacttggttcaagaatcacattaaaatctccccagatacaccaaggtgcatccaccaattgactatcatgatccaaagataaccaaaggactcttctatcttctgaactgcatttagtataaactgcagtaacaaatatatcctaaatacctatagccttctccaatttgatggtaatgtgttgctcactttttgtaaaaattacttaagtgttgtatgaattccaaaagcaccaaatttgaccattaccatgagaatgacaatgttgataccctaggaatctcttgtatccgtctaacttttctttagtaataaaaggttcaacgacaactacaaattgtgtgttgttgatgtcaatcagctttttaagcatgtgaatggcttttttggacctcaccctccttatgttccagaagattgcactattcataagaacaatttggggtgagttcctctctttattttcttctttgagaaggatgtgttctgtttctttgacctttgccactttttagagtttcacttctccctcttttagcaatgtattggttttccactttttgactatcagaaacttcctctatgtctcattctctgtgtctctatttctttttgagctcatgttgattctgctactattgccctcattcatattgatcccaatctttgtcatccagatcaacaactaaatttaaaccaagttgattccttacttctgttggaacaacagaggagcttgaggcaccggttgtatgcttgtaaatttcctatgtcttgtcttcttcctcactactagtgtcacacctcctttttgcgcgccccgccccgaggggtaagatgcgcgggtggagtttttccaatttaagtgacaatattcgaaatgagattatttatttaattcagagtcgccacttgggaaaggtttggcttttggtgtcccaagtcactggtttatcttgaatcccaaatcgaggaaattttcgacttttccaaatgaagtctgcgaaccagaaattctaagtaaggaattctgttgacccgagggaaggtgttaggcaccctcgaatcccgtggttctagcacggtcgcttaaattgttataatggctaaatatctgatttaaatacatgttgtgacttatgtgcttttattaagttttaaccgcttttattattatcatttatttttatagaattgcaacgtcgtgaaaatgtatctcgaaccacgtcacaatcaatgcacccgtagttgttaacacatttcgactccgttgagatttgaaattgggtcacataaatgcgcacccgaatttaagaatgtgatttgattaagtcgcgcctaaagaatctaacgcgttattgtcttcggggagggcagtggaattcactaaatagcccgtcccaaattctaagtatttattatgaccaattattgagggccccgcaatttgccttttgatttggcgaggctcgtctcattattttagaagggtactctacaagaactacattttactacatttatcttttaatggaaggatgatgccgaattttgctggtttagacaaatacggactgaatccttattatgtttgccgaacctaaacttgtttgattacttgattgattgttcatgaggtgagagctacggcatgctttgtcttcaacaagtgaatatgcttattaattcgctaagtgagattgcaaacaaactaacaacatatattgagttatgttttaacgacctccaagttctattcttaacactctaacctattcgaaattgataaagaaatcggctgttttattaggaaaaattactactaattgaactcaaaaatgattatcagtttttctcaacaatcattacatcatttcgaaataaaaatctgtaacgaaacccagtatcgaacctgtattggaacgaataaactgacaagagaactggcattcatagccatactcttagtgtgactgtatgggagtttgtttggggatacatttatcccggacccagtatcgcagttttgtcaattcagtggtctaggcaaaatacatacaatgcttaccatgactctatgttatacagtcatactaaatcaaacaagtgttatacttgaactgaatgtatactaaatcaaaacatgctgtccatgtcatactgtcattactattgagccatgctatctaacaattcatcttaaacaaaatgtatgctagttcctacagaatatttgcagttcacagtaagaatacaggcccaaccaacattcgaactatctttttacaccaatgctataacataaactggcgttcattcctttatttctgcttcaacttcaaactttcaacaatacaaggttcaaaggttgtgtacctgggaatatttgcaattgaagaaaaagggcaatcagtagagtaacaatgaacaaatgcagcagcagtaacagcaccaacagcaacagggcagaatagcagcaggcataacaaatagcaagaaacaggctcgagtgcagagatgcaaatatggccaatagaaagtaatagccaaatagcagcaacacccagtggaatagaaacagaaatccaaacagaccagaccaatagtaaaccaatgaaaacactcgactaatagacacaactggaatttcaaagaatcagaattgatttgaaacaggtttaacaactgaaacccagtaataataggaggaaaaagcttctgattgttggttgtatcccctctctcccctcaactctctctgtctatgtgtatctatttgtatgtatttccagctctcctcaggttcaatccctcacagtattttttcttttacaaccctccaagtttttttttccgtcccttttctatatgtctatccctcctttttataagcctctatcctactctttttaaacagcctgttttcagaaatcacagtacctttcccatgtgctttccatttccaactttagctaattaaatattaaaccccatcaacattccctggcagatttcacttttaaaaggtttaaatacttctttaaactaaagccaagtatgggcagtggaatgtatctgacagcatatgctgtcaaattgtttaaaacttaacaaaggcctttatgcaggccacaggctgtgcacaaagcacatgaggtgcattaatgcacatgctgtgcacgaatgcacatgccttccaattcagaatctaaacacaaacaatccaacagctataagtgaactaaactggctcttaattgattcaggcaaatattcaatagaagcaaatcgatttaactttgctcagacagttgaaactaattgacgacacatgtcgactcgactatattagcattaacatacacaatcgaagccaaaaatcagacatttaaagtatgggacacatgacttgacttatactggttaaacaaaattatacttcgaggaatcagttaatcaatacaaatttggaacataaccaatgcacatgctttatcagaataggaggggttcaaacaaacaccgtggttcaagcaaagtggacaaacaaaagttggtaaaaattcaaagatacaaattgaaacaaaacatgaacattcattcaatcactcacatggaccaaacagaaataaagaaagcaagcaagactcacctcaaatcttgaaaaatcaaaaaaccttgactcggacttggacagactttcttaagggtgaatggactttaatcgaagtgtttctcagatgagaaacacttcgattaaggtccattagaccttaatctctttggtttggacggacataggcctgtgatgaagaactacaaagttccaaaactcagatccgggattcatactcccctggtcagattcggaccaaaccaagtatggtttggtcacgaggggggtctggggagtgtctggtatgaatttagggcagattggtgtagattaggttccgactcgaatcttcaaatgaagattcgagaaggtgggataggattcgaggtgtgtggttgatagatttgggttcaggacgtcaagggggttctacggtgttaggggcgaggtcaccggcgtccgtgccgccggcttccatggtgaaggatacaggggcggctctagggtttgattggggaatgaggttgacggaggctggggttaggatagggggggcagggtatgttacgggcttatatatggatggaaggggttgatctgagccattggatgaggcgagatggaaggctcagatctttcttttgatgaggaaacggcgtcgtctctcattcagagtttgggggtcggtttggataagacgggtcgggttagttcatgggtatggggatgtgatctaggccgttgatcaatctgagatcaacggcccagatcaacctgtattaaaacgacgtcgtttggattctctgggcatcaggtggtctggaccgggcaggcctgggttctgggctgttcgtttgggccaattttgttaaaattggcccaagtccggaagggaaggggtcttttctttattttttttattattattttttttatttatttcctttttcttatttattttaaaaacaaaactaagccaaaaaatcaaattaaaattaaatacacactcaatacaattatttgcacacacactaaaatatttcaaaacaggtaaagtcaaaccaaataaaatcaacggacgaaaatgcctattcatgattttctatttaacgaccggattacggtttgaattatgcaggacacatatattttttgaatttcattttaataaagtaaataaataaaaatgggccaaagtcacaaataaatcaacaaggtgccgcacagaaatccgaaattgtacagcagggccagttatattttttttttatttctttttggagcgattgtcgtgcgaaaacaaaaatcacgtgctcacaactagtatctttattatctgacatctaattgacaactcccatttctatgttaggagcttcctcttactctatcctttcattcctgaaagtatcattaacattgttgtgtcgctcttgttcttgtgtatcatgttctttctttctgaatattgtctctaatgatagttatagaataatcattttgttttctaatcgatgtagaaacaacattcgttttgctactgctctaggcaggtttgaatctcactttgcttttcttctttggcatccttttgattttcttctttcttatttcttcttcttcttcttcttcttcttcttcttcttcttcttcttcttcttcctcttcccttctttgttgctaatgctctttgtattttccttcccctcttccggttgtattttaatattgtcaacattgtgtgaatccacttgatttgtatcctccttgccatcattgttttctttcatcatcttgttcatagaatatgcttcatcgtcatttttggtaagctcgtctttatctcctttttcctttgcttgatcagcctttttcttttcaagagcactacaattaactatgtagtgacccagtttccaacaatgtacaatatttttggacgccttcatactcaaattttttgttatacctttttaacggcgattcatcattttcttgacacacaaaaatactttgaggcaaaggttttattaggtccacttccactctaattatgtgcatactgggccttattcaactaattataacaacatctagagcaagaggcatacctccagagctcaacatgtagtgctaatcatgcatatgaaacggtaaagctggaagaagcatccacgccgaagagactggcagatcctcttctggcttgatgtccggcgaccacttttgtaccacatctacataccgtcgatttcgataactcttctgaaccataccgatttccaatcgtccccattgaagagatcaatgaaaacattatgactgtcatagacccctattctgactgaccccttcagcagaataatttccttaaatcgtgacctaatctggtcaatttgggggcgtggtcctagaaattttcccacaattgtgtatttaaatgattcccccattatgccgtagtaatctttagctttgaaaattacagctggcatgccgttgtgtgtcatatgtcttgctatcactttttccttttcttggcgattggagtttggattggggatctgagcaactgatgaaggagttgtgatggtgttagcataggatggttttccaagattagaaccaacattgtgagctatttcacctattgggtgaatctgattcgctgtacgcgctggtgggatgcctctcggcggctccatctagtggagcgtgtgcagatgcattaagatatgaacttttagttagccgttgtagagaggaaaatgtttagagagagaatttttttgggcctacacacactgacgcgttgtaacataaagaaaaaaaagttacactgcaataatgtgtagctcgtaagatcaagttttagaatcatgtgtgtttctttttctcgtttatttaaatgcacgtttactccaaaaatttaacttagtcatttatactatctatgtaatttaacttgtcgtaatagatcgttgctttattttttagaaaattcgttctgcttctcatagatagtatgaaaacatttacttacacattgatcttacgagcaatatacgtaatacttttgctatagtttagcttgagaagcaaagacatttgacaggtttacataagttgaaaaatagtactacaatttaatgtaatactatctgaacaacgatttccgtttattacgtcaacaacctaacaaacacatgccatgacatcagttttggctttatgcttttctcttttatttattgaagaatttgagatattcttcttattttattctacgtgagctaaatattttactacatattaatatagcatcgtcctttcaaactagttgaggctttagttctttgtgtaacggttcaaatccagaattttaataccacaactacatactaaacgtgcgactaatagcctgaaatgaagccaaatatgtagagaacagctgatgaaatcactaaagtgtggttttcactcaatttgaattcattggatccaaacaatatttgagcaaaccatcaactaactcaagctaagacttgctcctgcttttctttatttctaataacttatatatatttttaatttgggatttactagccatctattatttggaccgttcaaaaagccatatatttcgaccagctaacacccaaatttaacgtttaccctcttcaaattttatatattatctttacttcaattatatgtccacagtccttaaacacggcttcatatgctggctggctggacatgagagactactaacaagagtgagattgcagaaaatagggataacccaagatacaaaatgtacaatatgcgacaatgaaccagagacgatagaacacttgttctttgaatgtcagttctcaaaagcgtgtttacaggaagtgctaaaatggttgaatattgcaatacaaaatatcatattacaaggcatatggagaaggctaacaagaggggtcaaaggagaaagttgcagattcgtgaaaaacagcattaacaacactggtatatgttatatggaaggcacgaaatgaaacattgtggcatcaaagagttccaaatcctgggacaatatgtactcaaattcagcaggaatgcaaaataagcattgatagaataggtagtaagaaaggaagtagaaggggcatagagtggatataagaagagctctgaacacaaactaaaatatgctcgctagtcgaatatagtaaaatataatatcgtatcgacagggattggagttaaacaatattattgtagtttgtagctggatcgctatgcaagatgatcaataatttagaattttatgtttaatactaaaattaactaagagtctaagatattgactaatgacaaataacgcaagtagtaagcaaaggaagatatcaatggggagaagatagggttgataagataggtgcaagataaatgtttgggatctaactctagataatccacttctaatgttcaagtgcgtcccgcaaattcacttggttattaattcaattgtttagtagaaactcctctctcgattaagtctcaacctcacaagataaaccaattttaagcatgagaagaaatgcaagaattcatagtagattgctctttaggagaacctctctcgattattctcctaattaggttcaatcaacaattcaactagcctctttcgattactaagaagaaataaagatttcaaacaacaaaatataaaacagcaatatcacaagttatgcctctctcgattacatgaactagtgaatataggagcaacgattataacatccaaaatgattcaatacattaaaaactagagttacttatccacaaacaagtattaatacaccaaattcatcaaaccctaaagaagaattactccatggatatggagaaattcatcacaattaagatcaagtcaaagcaaaacataaaacatccaaacccttgtcttgagtgaggatgaatggtgaaatccttgtgctcttgcttctccctcttctccttagcttctttaggtctaaattatgtcaaaagtcctcataataccattttttcatgtatatataccaagtagggtcgggcccgaacaattacaccttctcctacgtaaaaaaggatacttttcctgaacaggacgtgcgcggccgcaaaattttcacactgttctgccctatatgcacggtcaatgcgcggtttcacatctttccaacaatatattgtggagcctaaacaaaattctgagcaaaaggttatgtgtattttactagacagtgcataatatgcctactcgattttttgttcgttcttagctatcatccgtggatccccgaacatgatcccgacttaattccttgggcttttactcaagtttcaaagctctaaatcacttgaattcattccataacatctacatagatgggaatcacttctacaaggcataaaacatacaactagtgcaaaacactagcgattaagctcgtgactagtgacaaaattagtgcaaaacactcctacaaggcataaaacacacaattaggctcatgactagtgacaccgggttcaggcagtggttgatgttttgcatatttgtttccgcttattttgaaatacttaaacgaaagatttgtgataatatcttatttgtaatggaattaagaaaatgacctattatgtaattgtctattcggcttgcgtagtactgcgattggcgccatcacgatcggggcggtttagggtcgtgacaagttggtataagaacctaggttacataggtctcaccagtcatgagccagtttagtagagtcttgcggatttgtacgaagacatttgtaattatcttcgagaagctgcagaacctttacgaaaaacttctcattcttgaattcctgtcgtgcgaatctgttgattctggtaactaaacattttatattctattctctcacagacggtaagaacacgtggtaccggttagtacggacgactaccagtactaccagttggggccactagaggccgaggtcgtggtcgaggctgtaataggggcaggggtgtagcccacacaggagctaaggatgaacctgcagacccaccaaccaccctagttcacgatctggtcaaagttgcggatgctccaaaaggaccagctcaagcaccgattgtgccgattgttattccagaccttcaggaggccctagcccagattatatctgtgtgcactggcctagcttaggccatctcagttactacggccgcagctacttctcatgccaggagaggcacccagactcccgcagcttgcacatctgagcaggttgtgcacggaattcagacattgggggaacctccagcccagccaattgcacatgcttaggattatgtggtaccagttatgtctgacgacaaacagcattgattggagaggtttggtagactttagcctccaactttcagtggtgtagagggcgaggatgcctagggtttctcggacaagtgtcagagaatgctttggaccgaaggtattttggagaccagtgtggtctcgttcactactttccagttttcaggagctgcctttacttggtgggaggcttatgagaggcataggcctgttgatgcagcaccccttacttggaagtagttctctgctctctatttggagaagtatgtgccaaagtctcgtagagaggagctgcataggcagttcgagcatttgcatcaagatgatatgactatgacgcagtatgagattagattttcagagctagctcgtcatgctatttagttgattcctacggatagggagaggatcagtaggttcgtggatggcctcacatatcagctttgaattcttatgaccatagagagggtgttaggagctacttttgagcaggttgttgatattgcccgagatattgagtcagttcgtcgctatgagcgagatgagagggaggccaagaggtttcggggatctggtagttttggtgatgctccttcgagaggtcagtttcagcaccacaaaggttgtccatttagacatgttcagtcagctcgcccagttcatcatggggcatcatgtggccatggttctcacaattctcatcagggacattaatcacttagtgcccttccagcccagagtttgtcccgtgctccatcagtatagggctcttctataccaggctcttctactggtcatcctagtgctaggggttcccttcaatccccatcccccacactaggaagttattatcagtgtggagagtttgcacatatgaggagacagtgtcctcgtcttcttgggggtccatcttagtagaggagtcagccctcgacttcagctccagttactttaccacccacccaggcagctaggggtaggggtcagtcagctaagggtcgccctagagggggaggtcaatcaggtgggggtcaggcccgtttctatacactcccagccagactagatgttattgcttcacatgttgtgattacatgtattgtctcagtttgccacagagatgcctctgtgctatttgatcttggttccactttttcatatgtgtcatcatcttttgatcgttatttggatacgccctgtgagtctcatttttcattggttcgtgtatctactacggggggcgatactattgttgtaaaatgcatatatcgatcatgtgtggtgactattgggggtttagagaccccagtggaccttttgtttctttgtatggtggattttaatgtgatattgggcatggattggttatctccgtgtcgtgctattttggactatcatgctaagacagtgacgttggccatgccgggtgtgcctcggattgagagatgaggttcgactgattttgttcccagtagggtgatttcatttctaaaatcccaacgcatggttgggaaggattgcttttcttacttagcctttgtgagggatgttggtgtagagactcctactagtgatttagtcccgatggtgagggactttccagatttgtttcttgcagacctgccgagcatgccaccagatagggatattgacttcggtattgatttggtgccgggcactcagcccatttccattccaccgtatcgtatggcatcgacggagttgaaagagttgaaggagcagcttcaggaactccttaataaggggtttattcggcctagtgtgtcgccttggggtgtgactattctatttgtgaaaaagaaggatggcacgacgaggatgtgcattgattacaggcagttcaacaaagttacaatcaagaacaagtatcctttgcatcgtattgatgatttatttgaccagcttcaaggagcgagagtgttctccaagattgatctccgtttagggtatcaccatttgaagatcagggactcagacattcttaagacaaccttcaggacccgatacggtcattatgagttccttgtgatatcatttgggctaaccaatgccccaataacgttcatgcatctgatgaacaacgtgtttcagccttattttgactcatttgtgattgtttttattgatgatattttggtgtactcgcgtagtcagaaggagcacgctgagcatttgagagttgtattatagcggttgagggagaagacgctttacgcaaagtttgccaagtgtgagttttggctaagttcaatggctttcttgggacacgtagtgtccagtgagggtattcaggttgatccgaagaagatagaggtggtttagagttgaaccaaactgtcctgagccacagagattcacggctttcttggtttggtgggttattatcattggtttgtttaggaattttcatctattgcatcacccttgaccaaattgactcaaaatggtgctctattcaggtggttggatgagtgtgaggcgagcttccagaagctcaagactgcattgaccacaactctggtgttagttttgccatcagcttaaggttcatatacggtatattgcgatgcttctcgagttggtattggatgtgtgttgatgcaggagggtagagtgattgcttatgtttctcgtcagttgaagccccatgagaagaactaccctgttcatgatttggagttggctgccattgttcacacaatgaatatttggaggtattatctctatggtgtgtcttgtgaggtgtttactgatcatcgtaacctccagcacttattcaggcaaaaggatctcaatttgaggttgcggagatagttggagctgctaaaggattatgatatcactatcttgtaccattcgagaaaggccaatgtagtggccgaggccttgagtaagaaggcggtgagtatgggcagtttggcatatatttctgtcggggagagacctctcgcagttaatgttcaggccttagccaatcagtttgtgaggttggatatgtcagagcacagtcaggtcttagcttgtgtggtttctcgatcttccctgttttgatcgcattaaagagcgccagaatgatgatcctcatttattattcctcaagtatagagttcagcacgacgatgatagatatgtgactattggtgatgatgggggtattaaggatgcagggccggatatgtgtgcccaatgtagatgggatttgggagttgattttggagaaggctcatagctcgcggtattctatccatctaggtgccgcaaagatgtatcaggatttgagacaacactactggtggagaagaataaacaaagatatagtgggatttgtagctcggtgctcaatttttagcaggtgaaatatgagcatcagagaccgggtggcttacttcagcagatggatattccagagtagaagtgggagcggatcaccatggattttgtagttggactcccacggactttgagaaagttcggtgctatttgggtgattatggatcgactgacgaagttcgcgcacttcattcctgtgtgtactacatattcttcagatcggttagctgagatctatattcgagaggttgtttgcctgaatggtgtcccggtttccatcatttcagatagtggtactcagttcacattgcagttttggagggtagtgcagcgagagttgggtactcaggttgagatgagcacatattttcatcgtcagacggacgggtagtccaagagcactataagcgcttgtgtcattgattttggagggtcatggtatcagtttctaccgttcgcgaagtttgcatataataatagttattattcgagtattcagatggctccatatgaagctttgtatgggagacgattgttacacaccgtaagtttaacaaccttaccattatatgcatatatatgatatggtattttgagtgatacatttatgtaaaaaaatagtttgaaaaatataattttatatagttattaatattactactttcggatatgttttaaattatacacataatatgagaaaagtttatgagatgttcttcattgtaaagataagaattatttttttcacaagaaaagaaggttatcttttttttaccattttaaaaattaagtatacaaaaatttatactctttatatgaaattataaaacttataagttaagaaaatatatgtatttttacatggatattttaataaaataatattgtatgcatttattttatatggtaccacatgaccacgatagtaagttatataatatgtgttaaaagtgagtggtattttaagtaagttgaaataatttttaattatgcgactaattggtaactatccaaaaataaatttggataagaacatcatgtggtagccatgcaatagtcataagataaactcacatcgaacaaaataatataatgcttgaaagaaattgagtttccacactgccaaagatttcattttgcgcaagctgctttccaccttgaagtattctaatgccaatagaaccattgccccatcatccgccacgatatgctaatgaaactcttcatggtatagaatgtcattgttttcttcccttcattgccttggttccgaacgacgaccattgtagcttatccaaattcaaaattcccttcctttggtgtccagccccacaaatgaattgattatgagttccccgcctgcattgaaggctaagtcttgtgagcacgtgattgttgctctatgagaactactctctaaaattcaaaataaaatgattttgtgttgtttgcgatttatttgtattttgtctgcgcatgtttgtttctactttaaatgacaaaagtacaaaaatatgtgttgcatgtgcatttagggtttaattatgcatttctgaattaattaaaccacgtcctattttaaagaatgaaaatcgcgaaaaatatgaattccggtagtttgtcattttattgtttaattgtgcgattttattttttcgatcttgtgtgttaattgttattaagggttaattaatatctttttaaataatattggtttttcaattcaatttaggaattttgaattaagagaatagaagaaaaagaaaatagaagaaaaagaggaaaacaagagaaaattagactgggccaattgtaaaagagagtccaggcccagtccaaacaccttcttgtccagtccaacccagccagcctagggaacgaatggaacgacgccgtttgggcatggaaaatcagggccgttgatcttagctgatcaacggtccagatcaattcctctgtcacccgacccgttcccatcgaaggccgatccggtctcaagagtagacgaagcgatgccgttcctcttaaatgaagcaatccaggtcgttgatctcatcagatcgaacggcttggatccaatccccacgtacgtatataagacctccaaacgaaccccgcccccaaaccaagccccccctctcattcttttccaaacctcgtctctttcagagacgaggaaccctagtagccgccaccctatcccttcaccgtaaacccggcggcgctggctccgatggccataaaattaacacccctgagccttctaaccaccctcaacctgaatccctactccgttgtcctcgaatcatatcccagcttctcgaatcttcgatcaaagaccccgtcccaaaccctagcttgtccacataaccccaaaatcacacctaataatcccctagacctcctcgttgctaatccctaaccagattggttcaaatccgagtaaaaactcatcgaatggcggatctagggctcgacagttcgagattgtttcgaagctgtcaaggtcgaatggtttttggttagtattataagtctatttctgatgaaatagatgtataatactaactggaaatcaagttcgaaagggcatatggttgaaattcgagaaaagaacagtgagttcctctttacttctttttctttttttctatgtgtttgtttgtctgtgtgattagtcatttctttagggtttttagtttaagttaatccagtatatatattctgtttctttttctgattttggttaaattaaatattccaatgttgtttgagcagttcaatcaacttttggtttacctagattaggttcattgtaattcgtctattgtctgttattttctctcttctccatcagtttatgttctgtcgattaataacataggttataaatagtttcgtcgattagttcgttcttgtttgtaaaccaataagctcgtcaaatggttgttgcgtatgcttgatctatggacgcttagcttcagggcattgtcaataggctgacaatgaacctgcattcatgtgcatattgattcaattttcaatttcggtttaaatgattctgttgagttctgtgtgatgatttaaattcagttcattttgtttcaattgggattcgaccttagtcaattagctgtcaataagtttggttatagctgttagtcagatttagtttttaaatctttgttagcttgaacagatttcagaattaaaagttttgatatagttgaaaatttgtattaggggcagtaatattaaggggtttcaggggtgatttgggattggaacagttaggataatattttaatgttagtgttttgttagtgggatattagtgtctttaaattaatatggtaatggggaacaaaagggaatgaggggctgaaaataaggaaaagttttccttagtgggttttaaagtggaaaaattcagatttttagtgaaaaaggggggtaaggcagtaagtataagaaggcagagggaggtctgtagaagtggactgaaaattgaattctgaaagctgaaaaagttgaaaaagaatagctattttatttatctgatttaggatctgaaattagctagaactttcttccttttacttctgctctatacttggggaagtatatagttgctggttatttgtggctgcactactggttgtcatttctgttggttactactgctgctgctgaccctcttcttcctcttcttgtattgtctataccaggtacatgtcttgaatctcaaatcatgtagatgtccggttggaatgaaatgaaaatggaagtataacgtcattggaagctttagttcttgccgtgttttatcatagttgattgtagtagtttggactgtaattaaaattgttttacaatggtttagattggtttggactgttaaactcatggactgttcgggacatttgatcgtttgtaagacatgtggtagtttaatttcatttagtgtagttaagttttgaaaatcagaagttattcaaaatataaagcgatcttctgattcacagtcctcactcgtcctaataaatggctgtgtaatcctggagtcacattgttttgtattttgtaatggtaattgtgagttagtttagagctggacgtgtaatttgactgttggatttgcttatcactaattaccctagaatagtttgttgattaactctgttaaaagacatatgtttgaaaattgattctggacttgcatttttagctgataattggatatttaaatgattgtggataattagttaaggttaattgcaacatgagttaggaagtattattaactaggagctgaagcaaaactgtgctgaacgttattagcataaaattagtgtagaatttcaaactcagcatgttaagtgcatcacgtgtgtgttaacacaaaattagaccctgaattataacacggatacgttaatgctgctgttgatctcgcctgatttttgctaatgggccaagctgagcacaggtgtggctcacgctctgcaatgggaactcagactgagaagcatgttctcaaggcccaactcgctggttggtttcaattcagcagggattgggccaattacttgagcccataattgctaaagggtccttattaatatgttttgtttaagtaactccaattatttagggcctctttttatttattcttaggaacaaaatatagaaaatcatagttgctttaggtttgtcctgtaattaataaaatgagacgagcctcgaaaaactcaccgattgtggggccctcacaattgtatatatattaattacttagaactcgggatcgaccgcttagcgaatttcacggcctttttcccaaagtaataactcgttagtcactgttaggcacgtacttttaataatttaccttcttaactcgggtgcacatttatgtgacccaaatccaaatctcaacgaagtcgaaatgtgtcgttaatcacgggtacattgattgtgacgtggtttgagatgcatttccataacgttgcaaattcttttaaaaaaataatgaatgaaacgagcctcgacaaacaagaatacacaaagtgtgggcccctcaacggacagttatttcaaatgcttagatttcgagacaggccgcatagcgaactttacgactttttctcaaaaataacaaacgcgttagtatctttaggcgcgaatttaataatgttatcttcctaaactcgggtgcacatttatgtgacccaaattaaaatctcaacgaggtcggaacatatcgaaaattgcgggtacatttatgtggcgcaattagagatgcattctcacgacgttgcaattctttgaataaataataacaaaagcggtaaatagttaaaattttcacgtaggttcataattgtataaaatcaaataatcaagccgaatatgacagttgagctactgtgctagaaccacggaactcgggaaagcctaacaccttctcccgagttaacagaattccttatccggatttctcgtgcgcagactgttaaatagagtcattcttttcctcgattcgggattcaactggtgacttgagacaccacaaatctcccaagtggcgactctgaatctttaaataaaatcccgtttcgattgtcctttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaattgtcactgaagccggaattgatgatgatgaatggatcaaagctcgcttggaacagttgagcctgatagatgagaaaagattggcagcagtgtgccatggtcagctgtaccagaagagaatgacagagcgtataataaaaaggtgcgccccaggaagttttgaagtagggcagcaggtattgaagaagatcctcccacatcaggtcgaggcgaaaggaaaattcgtcccaaattggcaagggccttatatcgtgaccagaatattgtccaacggtgctttgtgtttgacagatgtcgaggggtagatgtgtcgacatggctatcaattcagatgcagtcaagagatattatgcgtaatttcattaattatggcaattattcggtttgtttgtttgtatttggcatttattggataatgagatgacggaggcaattctttcttctacccaaacactgtttaacccttgcttccccctttgagccttaagcaaattctttcaatgcccctcttttggaatcactaatgggaaagatacgaaaaaaaaagaaaaaaaaagaaaagaaaaagaaaagaaaagaaaagaaaaagacatgaaaaaaaggaaaagaaaatgaaaagaaagaaaagaaaaatcaaggaatataaaaccgtgggaactacgtttgacctgattcctcaaagaggatacgtaggcgcctcacggctcggtcatagtgtgcatcatagcaaatataggatgcataatgtacatagtgtgcataataggcacaatgtgcgtaacgcacgtagctcaacgtaagcataaaagataaattccccaagcaagaaaactggggcagaggttatgttttaagttccaacaaaggtttgattccaaaagtagtagcacatcacccttcaaatttgttttcatttttatagcctttcttcaaacccacaccaaaaccaacatcaacatccaaaagacctcccgatcaatgttcgagagatgccaaatccggcaaataagaccgagaatgatacactgatccccagcaaagaagaggatcgtgagactgggaatgaattgatagtcaaaggaatctccagaagagagggtcgtatctacaacgccctgattcatcgaaagaaaaaaaatgagagagtctcatcggtgaaaaccttcgcaggcaccgagaggcgacgtaagacgagggatatgaaatgagagagtcttattggtgaaaaccttcacaagcaccataaggcgccgggagatgagagaaaagagagagtctcattagtgaaaacccctcgaagggcactatgaggcgacaagatagagcagcaaaagctaccacattcgcaacaagatgaacatccatttatcatccccagcaagtcagaccatcggacaaatcgattgatacaaacagactgggtcgggaatctatggtgcacgccatgatcacggggaccagtcatgtcctccagataagttcttttgattagctcctcccacaaaatattggttcacaaagtttttctcttttccatatctttattttcttttcctaaaatgtgtctttaaagactttttcaaagcttactaccagaaatcgaaggggaattcatccaatgcaggagaatacaaacagtcttaaaagtcggcccctggcaatgcagggattgtgctcggaaattttgaaagaagtaagctccaaaagggagtggtttcgggaggtagaagcagactcccacagaatatgcttaaagagaaagcagaaaaggggataaactgaaaaccgatccccagcaggctagaaaccccccaacaggcaactttgcccgccaaccaattatggggacaaagagcaagagaaggggaagagagaaaaatggcgcgccagaaaggcaccctctaccaccacgattaaaactgattaaatccttttgtctgctgcagggaaaacaaaggattgatgatggcagcaagatgcaccgccatggaagtcaccaaaaaccggggcagaaaattttctgccaattgtcgaaaattttctcggaagaacggggaaaattactttaagttctaggtcgcccaccagtataatgcgggaatacattttaagttctaggcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacttttaagttctaggtgcccaccagtataatgcgggaatacttttaagttctaggtcgcccaccagtataatgcgggaatacattttaagttctaggtcgcccaccagtataatgcgggaatacattttaagttctaggtcgcccaccagtataatgcgggaatacatttaagttctaggtcgcccaccagtataatgcgggaatacattaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacattttaagttctaggtcgcccaccagtataatgcgggaatacatttaagttctaggtcgcccaccagtataatgcgggaatacatttaagttctaggtcgcccaccagtacaatgcgggaatacttttagctctggagtttggaatcagtagccccacctgaagacggaaggttacaacagagagccccaagcaggaaaaacaataaaatccccagcaccaagaagcaggcaactgcagaggcaagcgcgcaattcaaaaggaaaaatgaacgcgtctcaaaaaatgtagtttgggaacgttgtagcatgcccagtataacaattctgatggaaagccataccactgaagaaaccattggaagatttaaagaagaaagccgtgtccccagcaaatcaagcaaagtgatgagaactgacattcagaaaaggtgaaggaccaacatcatctccaagttcacaaaatagaggcatcggaggaaagcgatagccgataagaaagcaaggcaacaagaacaagtcgaagatggatgagatttcaggatcctcagtttagcttagcttcttgttttccttctagagcaatgtaacagagagatcggttgagcagtagcatcctatagcagcatacaacagcgcacaacaacagcaagcaatacagtcacacggtagtcccagctaccaaaatttcccgaactacattgacctgattcctgttcagcccaggatatgtaggaaacctctgaagcaaaggttcggtcaaatctttttcaaaaaatgcttcacacggagtattcggacgggcaaaaatcgctcgctttatctttgcgcgaaaacccttcgtgtcttcgtgcaaagaggggcagctgtaagcacgtgatttttgcttcacggacaatcgctccaaaagaaaataaaaatagtggcaaaaggcttcgctgtacaatttttcgatctttccgtgacatgtgttgttagtcgtttctgagtctgtccattttgcatctagtcattatcaaacaaaaatacaaaaaaatatatgtggcgttaaaagaaaattcaaaaaaatatatataaatatatgtgcatcgtccgttttaggttgtgatttaacttacttggtatgataattatgttgaaatgccatattgttatttgttttaatttcatttgttttattagttatttttatttttatttttctttaaattggaaaacaaaagaaagctgaaatcaatttgggcccaaaagaataagacaaaaaaaaaggggcccaaaccaacgatctgacccggtccaaaccgactgcccaagcacctcctgaaacgacgtcgtttcaggcaaatcaatcccagtcgttccaatcaatccaaaggtccaggatcattttcggcaacccgtgttcaaacccgacccaataaccaatccgacccaacccctcacttaaaccaaacgacctcgtttaactaccaaacgaccccgtctcatttctcagcatcagatccaagccgttgagatcatttgatctaacggctcagatccaatcccctactccgtatataaaccttcccttacacccacgccccctataccaacaccccaccccttcgtccccaagctcaaacccagacctctcattagaaaccctggccgcccccgtctccctcgccattaaagccggcggcatggacgccggtggccacctcctgaacaccctaggaccacctcactgtcctgaacacaaatccactaaccacgagcctcgaatcacttccgttcgtctcgaatcttcatttgaagatttgagtcgaacccggatctatgccaaaccatcccatcttcataccagacactcccctgaccttcctcgtgaccaaaccaaacttgttttggtccgaatctacccacaactccctaaaaatcagatctggaaatccagactttagaacacatgcacctggggaatccgggcggtttggacatgggtttgaggtctaatagaccttaatcaaggcgttctcatgtgagaacaccctgattaaagtttgttcggcctcaaaagttcgaggttaaatcagatttgggtctgtttgatttaaacattttcggtaagttttcctttcttttgttttatttctaaataagttgtcagcatatctctttgtgtttggttgttattttgttatttttttggatttctttcatctctgtaaagaccttttatttggtcaattgttttctgtgtatgatttgaatgtattctgtgatgaacatgttcgattagattagtcgtcaaatgaataaacttatataggttcccagtaattgaacacaaaattgtctgatgccctttaggtccctgaacatattgtttatgtgagcgactgattattacttgctataattagtatagtcgactcgataaatgtcgttgattagtttctataactaatgaatcaaacgagctaataatgtcgcatgactaattgatactttgccactgattgaaggccccaacattgtttgaaatagtttgtttgcattgaaaaatgactgaaaggttcagtctaggcagtcctgaatttgaactttcatcagttcaaaaatgccctgatgctgcaaagggtcaagacagtgataaccagggtttaacaggggtagtctggggtttgaaaaggacaaaaatgattagtttaaatgagctgacaagtagggtactaatttaggattaaactaatacccatggggagcaagacataagagtatgaggcttaaaatgaataaataaaacgagcccataactcttgattaaacaaagaccaggcgtggggaacaaatgggctggtaccaaagatgcttaggcatgggcttatagggtatgggcattctgccaattggcagggcaggcagctcagctgtactggttcatttggcctataaataggccatttgataacttaaatagggtagagattttagtctggagaaaagagaaaaacaaagtgaaaattttcagaatactttgactaaaacattgcccaaaactgcacaaggaactaggttggttgagctgttctggccaagtcagttattctaactagggtcatcactgttccgttaagagaaggctgtgtgttttctgctgtgattgttactatactgagttttctgtgagctgtggattgagttttagccttcttgattgttggaactgtactgagtacttgctgagttttgtgattattggatcttctgttgctgttacatttggtatcttgggttttcggttggttcattgttctttttctgggatttgtctgtctgatgctcaagcacctgtgggctacatagttgctgttggttgtgttgctgcgttgttgctatctgttgttgctgttgattacttgctgctgatactctctctcttcctcttcttattgtgcaaatatccaggtacacgactaatactgtcaatgtaacttgaagttgagtatgaatgcaaaagagaagaattgaagattatttactttaagcataggctgttgtattgaatatcatgtaatgcatgatagtttacattcgtttggatactgaaggcaacttgcatgcatagtaaatatcaatgtatggggattgaatgttagttatatatgtaggctgttagatgaatattcctaatgcagtaggttgtatcccagacttaggtttaaattgtgtaacatactctttaatgtaggccaggcatgtaaactatccactgctagtatagttctttccccttttgctagtttgtcacatataaattgataaagaacaaagaatcagttctaggcctccaccccaggaaggccgagcccaaatcgaaagtcagctaggcctgtatcggaaaaacagggcccaagtcgggccatctcgcatgagctggatttgggcccataatttgcgactagtgggccataaatgcagtcacattttattattctgtagcagcactttaaatacggttttataatcaactaaggctatttactgctttcaattgatagagacaaacacgacgagaaacatagttgctataggatatcccttaaaaataacaacgagatgagcctcgataaaaataaacaaaacgcagatacggggcccttgttaaatgcatattagtgaagcatttagtttccaggacgggttgtttagccaatctcacaacctccctaaaaataacaatacgttagactcttaggacgcgccttaataaatcttaccttcgtaaactcgggtgcacattgatgtgacccaaatccaaatctcaacggaatcgaaaaatgtgtttctaatcacgggtacattgactgtgacgtggttcgagatgcgtgtccatgacgttgcaaattcattttaaaataaggatgagataagcctcgccgaataaaaatataaattgcggggccctcagtaaatatttgtttaaaattacttagacttcaggagggccgtttagcgaatttcgcggccttcccaaaataataacacgatagtctctttaggcgcgtcttaataatttattttttcttaattcgggtgcacatttatgtaacccaaatccaaatctcaaccgagtcgagatatgtcaataaccacgggtacattgatgtaacggggttcgagacatgttttcacgacgttgcaagtcctataaaataacagtgaatgataaaagcggtaaaaagttaaaattttgcacgtaagttcactcttgtataaaatcagataatcaagccaaatataacagttgagcgaccgtgctagaaccacggaactcgggaacacctaacaccttctcccgggttaacagaattccttatccggatttctggtacgcagactgtaatatagagtcattcttttcctcgatgcgggattaaaattggtgacttgggacaccctaaatctcccaagtggcgactctaaaataattaaacgaatcccgtttcgattgtcctttaattggaaaaactcccttgcaccctctctggtgcggaaaaaggaggtgtgacaaagggtacagaggccgagaacattcactccactgggagaaacctatgctactttgttccataagttgaggcagttaggcctattaagtcttgttgagcccaaattgccaaatccccttcccaaaaatctggaccactcagtaagctgtgaatattgttcgggggctctcgggcatgatactgagaagtgttggaagttgaagactgccgtacaagatcttatcgacacaaataggatcgaggttcaggcactagaggcacccaacatcaatgagaacccgttaccggtgcaccaagaggcccacatgatcgaacttgtgcacgaaggagggaagcccaagaaaccctcacaaacgataatgatgattcgtgccagtccaagcgagaagccgaccagtggaaaggcagtggtacagttgggaagggtagatgacaagccagttgtggtaatagggaaaggttcgtctgtcgttgcgaagaagccggagccggcaaggtagtgctgcagggagtatcaagcacaccagtgttagttgtgaaaggggcccgcgtagaaccagttgttatcaggccagtaatgcagttgccgataacaagtgagaaagctgtgccctagagctacagtcaagtgacagtgatgcataaggggaaggaggttgtggaagaagtatgcgaggcccaggggttaactcgttcgggaatgtgttttgttcccctagaattgagaagggccaatcctataacaaaaaaaaagccagtgacggaggaagaagcagaggagtttttgaagaagatgaaggcaccagactatccattgtagaggagttaaggaagaccctgacccagatttcgttgctatccttgttgatccattcaagcgatcattgtcgggtattaatgaagattctgaacgaagcccatgttccggacaagctctcagtgaacatttggagaaaatagtgcacaaaatcttcgaggtaaaccgagtgacattttctgacgatgagttgccagtagagggtatagaaaacaacagagcactctacctgaatgtgaaatgcgaagactcgatggtcactcgagtactgattgataatgggtccagtgccaatatttgtcctttgtccactctgaacaaaatgaaggttgatgatgataggattcacaagaacaacgtctgcgtccgatgttttgatggggacggtactgacacagtgggtgatatcattctgcaattgataattggtccggtcgagttcaccatggaatttcaagtggtagacgtggcggtgtcatataatcttctgttgggacgaccctggatccacactgccaaagtagtgccctctacactgcattagatggtcaaatttgaatgggatagataagagattgtggtacacagggatgacggtacacacgccgttagtgatgccattgtgcccatcatagaaatcgacgatgacaagggcccatgggttcatcaggtttttgacgcagtctcagtggacaaaattcctgagggcgggggccttctacttcctagaatcgcagctgcgaccttcatgatagcctcggagatgttaaacaatgggtttgtaccaggaaaaggtttgaggattgatctgtagggaattgtccagccagtttctttgcccaagaatctggatacttttgggctgggattcaagcctacggcagcagatgtaaagcggggttgcaagttgaagaaaagagtctgggtcctccctaagccaatcccgcgcctatccagatcatttgtcggagcaggtattagagagttgtcagtcccgaaggttctcggaccactgatcgggccagatggagatttgaatgaagactttgaaaggctgttcgctgatgtcaacatgatagaagctggagaaggttccagtaaggcagacatacagtttgtggggcctagggacaatgtcaacaattggtcagctactcctcttcctactcggagggagtcctggtagttggctctgattttccttcctgttttctggattattccagggttgtaatccagattcctttttatttttattgtgttcatcaaagtgtgaaaccttgttatcccataattcaataaaataaaaagtttcttcttcattccttattttattttttattttttaattttgttttctacttttctttttctgaacagttctctttatattggttctattgacatggcatgcccaacggatcttcatctcagtctaaaaattcaatctaattccgaactaattgtacaagaggtcgattatgataatgaatcggaatctgatgaggatgaagccttcgaagagataaacagagagttaagccagtttgaagagaaatccaagcccaacttaaatgacacagaagccatcaatttaggggatgcagatgatatccgggaaactaaaattagcatccacattgcaccaaatatcagggaagaactaatcaaaacacttattgagttcaaagatgtttttgcatggtcgtatgatgacatgccggggttaagcatgaatttagtgcttcacaaattgcccactgacccggcatgccctcccgtcaagcaaaaattgaggaagttcaagacagatatgagtgtgaagattaaagaagaagtaaccagggtgtgcgtcgattaccgggtgtgcgtcgattaccaagttcacccgatatcctgattggttggctaatgtggtgccagtgccgaagaaagatgggaaaatcagggtgtgcgtcgattaccgcaatctgaatagggcatgcccaaaagataactttccattacccaacatccttatcttaatcgataattgtgccggacgtgagatcggatcttttgtagattgctatgctggatatcatcagatgcggaaaagacgacattcattacgccgtgggggacttattgctactgggtaatgccatttggtttgaagaatgctggggcaacgtacgtgagagcaatgactactgtgtttcatgatatgatacacaaagagattgaggtatacgtggacgatgtgatcataaagtccaagcatcaggaagtccacgtagcagacctaaggaagtttttccaaagacttcgaaggtatgatattaagctcaacctggccaatgtgcatttggtgttccatctggaaagctgttgggattcatcgtcagtaggcgaggcattgaactggacccgtcaaagatcaaatccatccaagatttgccatcgccgaagaacaagatagaagtaatgagtctgttgggaagattacatcagcaggtttattgctcgactcacagcaacttgtgaacccatttttcggctactgaagaaagatgctgcgatagaatggacggtagaatgtcaggaggcatttggccaaatcaaaggatatttatcaaatccaactgtgttggttcccctgagccggggagaccgttaattctttatctaacggtcctagagaattcgtttggctgcgtattaggacaacacgacattacaggaaggaagagcaagctatctattatctcagcaagaagtttacagtatatgagtttaagtacactcaacttgagaagacatgttgcgccctaacttgggtggcccagaaattgaagcattatctgtcatcatatactacttatctcatttcacgcttggatccattgaagtatattttccagaagcctatgcccatagggaggttagcgaaatggcaaatattactcacgaagttcgacatcatctatgtgacgaggacaaccatgaaagcccgagcactggccgatcacttggctgagaatcctgttgatgaagaatactagccattgaggacgtattttcttgatgaagaagtgatgcatatagatgagttggatttacctgaggaaccaggttggaagctcttctttgatggagccgcaaatgcaaaaggagttggaataggagcggtacttatctctaaaacgggacatcgttatcctgttacggcacaactgcgtttctattgtaccaataacatggctgaatatgaggcatgcattttgggtttaaggttagctgcggacatggatgtccaggacgtcttggtcttgggagactcggacctcatggtgcatcagattcagggtgaatgggaaataaggcatttgaagctcataccataccgacaatgcttgcttgatctgaccaagtgatttcgatcagtgcagttcagacacatcccaagagttcataatgaggttgccgatgctttggctactttagcatcgatgttgcatcacccagacaaaattcatattgacccgttgcctatccaggttcgtgatcagcaagcttattgcaacatgatagaggaagaaatggatggcgagccatggttttatgatgtcaaggaatacctcagaatggggatatacccaaagcgggccatagaagatcaaaagagagtcattcggcgattggcaaatggattcttcctcagtggaggagtgttgtacaagagaaccccagatttgggattgctgagatgtatagatgctagtcaagccacgacagttatgacagaggtacatgctggagtctatgggccacatatgagcggatatgtgttggcgaataagattcttcgagcagggtattagtggctcactacggagcgtgattgtatcaatttcgtgcgaaaatgccatcaatgtcagatacacggagatttgattcattctccgccgatagaattgcacacaatgtcaacaccatggccatttgttgcttggggcatggatgtcattggacctattgagctggcagctaccaaaggtcataggttcattcaggtgaccatcgactatttcactaagtgggttgaagctaaaactttcaagtcggtaacaaggaaagcattggtataatttgttcattcccatatcatctgtagatttgtggtcccgaaagtgatcatcacggacaatggtgctaatcttaacaacagtttgatgaatgaagtatgtcagcagttcaagattacacatagaaattccaccccatattatcccaaggcgaatgtagcagttgaagcagccaacaaaaacataaagaagatactttgaaaaatggtagaaagttcgaggcattggcatgaaaaattaccatttgcattgttgggttatcgcactactgtccgtacttcggtaggggcaactccttatttgttggtatatggaactgaagcagtaataccggtggaagttgaaattccatccctttggattgtcgctgaagctgagattgatgatgatgagtggatcaaaactcgtctggagcagttgaacttggttgataaaaagagattggcagctgtgtgtcatggccagttgtatcaaaagagaatggaaagagcatacaacaaaaaggtgcatcccctgaagtttgaagtgggccagcaagtgctgaaatgcatccttccacatcaggctgaggcaaagggcaagttctccccgaatgggcaagggccattcattgtaaccagagtgttgtctaatggcgctttgtgtttaacagatatcgaagggaaatgcgtcgacatggctatcaattctgatgcagttaagagatattatgtatgatttcttttaattgtaattgttgtttgcttgtacttggcatttatcggagaatgaaatgacggagacaattctttcttctatccaaacactttaacctttgcttcccctttttgagccttagttattctttcatactcctcttttggaatcagtaatgaaaatgaaatagaaagagaaaagaaaataatgataataaagacaaaagaaaagtcacaagaaaaacaaaggaaatgggaactacgtttgacctgattcctcaaagaaggatacgtaggcgtctcgcggctcggtcatagtgtaacgtagtgtgcataatgtaacataatgtaataaaaaataaaaatccccaagcaagaaaaactggggcagaagtttgtgtttgtaattttggaaagaaagtatgattccaagagttgtactattttacccatcacgaaaacccatattgatgtccaaaaaagacctcccgatcagtatccgagaagtgccaagtcatgcaaatggaagtcggggatagcaccccgattcccggcagagaagaggatcatggactggaactgaattgatagccgaaaagaatccccagcagagagagtcatatcggcaacactccaatccccagctgaaaaataaaataaaatgagagagtcttatcggtgaaaaccttcacaggcaccataaggcaatgggagttgagagaaatgagagagtcttattagtgaaaacccctcgaagggcactatcaagcgacacgacaagattggcggaaagggtccacatttggcaaagagttgagtgctttttatccccagcaagatgaggccgttcgaaagattgattgatgcaaatagactgggttgattagtccggaatgcacgacatgatcgttaggatcagttatatcattcagataagttcttttctttctttttccccagcatttgttcagaaagacttcttctttttctattttttgaaatcaacacttttcatttcttggtttaaatactttacctccctagcagtttgtttttgaaaaggattttcagagcttactaccggttgccaaagtggtgcaaagcaaaatgcgaataggacaggccaaagataaggcgacaaagcgaaaagaagttggtcgaaagaccaaatgatgattgggtctagatcccaagaggaccaaatttccaggggaagttggagaaaaacgaaaaagcaacagttaaaaggttatgaggatccccaacagatttgcaagatacaggaacaactatcatccccagcaagttttgtaataaaacgcaaagcagggaaagggagaagaaaaaaaccatccccggcaggagtggcacgaccactcaccacgttttaaactaacaattttttttgatttgaagcagggaaaggaaatattattgacaacaggaagacagggccacaaagaagattatctaactggggcagaaattttctctcattacgaaaattttcttgaaatcagatagccacttagggaagagggaagataacacgagttttgaaggaagtgaaatccccagcaatatgtgagagaaagcgatacatgttttaaagaaagcaatcttggaagaagcaagataacccaagttttaagggtagtggtctttgaatcagtatcatccccaccattgttaaagggaggaaagtaactagtcttaaataaggaagataattccccagcagtgttatccctggcaggtttcagagaagtaaaaacaccagcttgaggaaagtagtccaagtggaaggaaggcaccagctttaaagaaaatagtctgtgaagaaggaaaataacatagttgtgaataaaacactggcgttgtccccagcagttttcggaggaataagacaccggttttgagggaagcagttgaaagaagatgattcaagttgaggagtcaagagcctacctagagaatggaggtgttacatttaaggagttgttgaagtcaggagcccgcctggagaatggaggtgttacatttaagaagttgttgatgtcaggagcctgcctatagaatggaggttgttaaatgttaaattgttgaagtcaggagcccgcctgtagaatggaggttgttaaatgttaagttgttgaagtcaggagcccgcctggagaatggaggtgttacatttaagaagttgttgaagttaggagcccgcctggagaatggaggtgttacatttaagaagttgttgaagtcaggagcccgcctggagaatggaggtgttacatttaagaagttattgaagtcaggagcccgcctgtagaatggaggttgttaaatgttaagttgttgaagtcaggagcccgcctggagaatggaggtgttacatttaagaagttgttgaagtcaggagcccgcctggagaatggaggtgttgcatttaagaagttgttgaagtcaggagccttcctggagaatggaggtgttacatttaagaagttattgaagtcaggagcccgcctgtagaatggaggatgttaaatgttaagttgttgaagtcaggagcccgcctgtagaatggaggtgttacatttatgaagttgttgaagtcaggagcccgcctggagaatggaggtgttacatttaagaagttgttgaagtcaggagcccgcttggagaatggaggtgttacatttaagaagttgttgaagtcaggagcccgcctggagaatgcaggtgttacatttaagaagttgttgaagtcaagagcccgcctgtagaatggaggttgttaaatgttaagttgttgaagtcaggagctcgcctggagaatggaggtattacatttaagaagttgttgaagtcaggagccctcctggagaatggaagtgttacattttaataaagttgttgaagttaggagctcgcctggagaatggaggtgttatattttaagaaggttgttgaagtcaggagcccgcctggataatggaggtgttacattttaagaaagttgttaaagttaggagcccgcctggagaatggaggtgttacattttaagaaagttgttgaagtcaggagcccgcctggagaatggaggcgttatattttaagaagtaattggtgttgaagtcagtaaagaggaggaatacaaccaaaatccccagcgggaaacaacaaaaatccccagcagagaaaggcagttcaagatttgaagggaaaataatgcgaagctcgccagaaggaaataaacagttctagatcggcgatcaagggagaatacaagtcaaattagaagtaaagaaatacaagaggaaacacaaggcaacaaggcaacaacagtcacatgaccatgctcgggaataaatctttgtaattcatagatcatagcttagtataacttctttatctattatcaaggtgtaataaggaggtcagtaagcggtaacattagcaacaacagcagtaacaacaaaattgcagtcccatggtagccccaactattaaaatttcccgaactacattaacctgaatacctctagccagagatatgtaggaaacctttgaagcgaaggttcggttaagtactttcaaaaaaaaaaatgcttcacacggagtattccaacgtgcaaaaatcactcgtgtccgctcacttcatctttgcacgaaaaccctttgtgttttcggacaaaggggggcagctgtgagcatgtgatttttgctctatgagaactactccttaaaattcaaaataaaatggttttgtgttgtttgtgatttatttgtattatgtctgcccatgtttgtttctactttaaatgagaaaagtacaaaaatatgtgttgcatgtgaatttagggtttaattatgcattttggaattaattaaaccacgtcctattttaaagaatgaaaatcgcgaaaaatatgaatttcggtagtttgtcattttattgtttaattgtgcgattttattttttcgatcttgtgtgttaattgttattaagggttaattaatatctttttaaataatcttggtttttcaattcaatttaggaattttgaattaagaaaatagaaaaaaaagaaaatagaagaaaaagaggaaaacaagagaaaatcggactgggccaattgtaaaagagagtccaggcctagaccaaacaccctcttgtccggtccaacccagccagcctggggaacgaatggaacaacgccatttgggcatggaaaatcggggtcgttgatctcagctgatcaacggtccagatcaattcctccgtcacccgacccgttcccatccaaggccgatccggtctcaagggtagacgaagcgacgccgttcctcttaaatgaagcaatccaagtcgttgatctcatcagatcgaacagcttggatccaatccccacgtaagtatataagacctccaaacgaacctcgcccccaaaccaagccccccctctcattctctcccaaacctcgtctctttcaaagacgaggaaccctagtagccgccaccctatccctttaccgtaaacccagcggcgccagcttcgatggccataaaattaacacccctgagccttttaaccaccctcaacctgaatccccactccgttgtcctcgaatcatattccagcttctcgaatcttcgatcaaagaccctgtcccaaaccctatcttgtccacttaacccgaaaatcacacccaataatccccttgacctcctcattgctaatccctaactagattggttcaaatatgagtaaaaccattgccccatcatccgccacgatatgctaatgaaactcttcatggtatagaatgtcattgttttcttcccttcattgccttggttccgaacgacgaccactgtagcttatccaaattcaaaattcccttcctttggtgtccaaccccacaaatgaattgattatgagttccccgcctgcatggaaggctaagtcttatgagcacgtgatttttgccctatgagaactactccctaaaattcaaaataaaatggttttgtgttgtttgcgatttatttgtattttgtctgcgcatgtttgtttctattttaaatgagaaaaatacaaaaatatgtgttgcatgtgcattaagggtttaattatgcatttcggaattaattaaaccacgtcctattttaaagaatgaaaatcgcgaaaaatatgaatttcggtagtttgtcattttattgtttaattgtgcgattttatttttttgatcttgtgtgttaattgttattaagggctaattaatatctttttaaataatcttggtttttcaattcaatttaggaattttgaattaagaaaatagaagaaaaagaggaaaacaagagaaaatcggactgggccaattgtaaaagagagtccaggcccagtccaaaaaccctcttgtccggtccaacctagccagcctggggaacgaatggaacgatgccatttgggcatggtaaatcggggccgttgatctcaactaatcaacggtccagatcaattcctccgtcacccgacccgttcccatccaaggccgatccggtctcaagggtagacgaagcgacgtcgttcctcttaaatgaagcaatccaggtcgttgatctcatcagatcgaacggcttggatccaatccccacgtaagtatataagacctccaaacgaaccccgcccccaaaccaagccccccctctcagtctctcccaaacctcgtctctttcagagatgaggaaccctagtagctgccaccctatcccttcaccgtaaactcggcggcgccggcttcgatgaccataaaattaactcccctgagccttctaaccaccctcaacctatatccccactccgttgtcctcgaatcatgtcccagcttctcgaatcttagatcaaagaccccgtcccaaaccctagcttgtccacttaaccccaaaatcacacccaataatccccttgacctcctcattgctaatccctaaccagattggttcaaatccgagtaaaaactcaccgaatgacggatctagggctcgacagttcgagattgtttcgaagttgtcagggtcgaacggtttctggttagtattataagactatttctgatgaaatagatgtataatactaactggaaatcaagttcgaaagggcatatggttgaaatctgataaaagaacagtgagttcttcttaacttctttttctttttttttctatgtgtttgtttgtctgtgtgattagtcgtttctttagggtttttagtttaagttaaaccagtatatatattctgtttctttttctgattttggttaaattaaatattccaatgttgtttgagtagttcaatcaactcttggtttacctagattaggttcattgtaattcgtctattgtccgttattttctctcttctctatcagtttatgttctgtcgattaataacataggttataaatagtttatttgattagttcgttcttgtttgtaaactaataagctcgtcaaatggtttttgtgtatgcttgatctatggacgcttagcttcagggcattgtcaataggctgacaatgaacctgcattcatgttacctgcattcatgtgcatattgattcaattttcaatttcagtttaaattattctgttaagttctgtgtggtgatttaaattcagttcattttgtttcaattgggattcgaccttagtcatttagctgtcaataagtttggttatagctgttagtcagatttagtttttaaatctttgttagcttgaacaaattttagaattaaaagttttaatacagttgaataattatattaggggcagtaatattaaggggtttcaggggtgatttgggaatgaaacagtttggataatattttaatgttagtattttgttagtgggatattagtgtctttaaattaatatggtaatgggaaaaaaagggaatggggggctgaaaataaggaaaagttttccttagtgggttttaaagtggaaaaattctgatttttagtgaaaagggggggtaagggagtaagtataagaaggtagagggaggtctgtagaagtggactgaaaattgaattctgaaatttgaaaaagttgaaaaagaatagctattttatttatctggtttaggatttgaaattagctagaactttcttccttttacttctgctctatacttggggaagtatatagttgctggttatttgtggctgcactactggttgccatttccgttggttactactgctgcttctgaccctcttcttcctcttcttgtattgtctataccaggtacatgtcttaaatctcaaatcatgtagctgtccagttggaatgaaatgaaaatggaagtataacttcattggaagctttagttcttgccgtgttttatcatagttgattgtagtagtttggactgtaattaaaaatattttaaaatgatttagattggtttggactgttaaactcatggactgttcgggacatttgatagtttgttagacatgtggtagtttaatttcatttagtgtagttaagttttgaaaatcagaagttattcaaaacataaagcgatcttctgattcacaatcctcactcgtcctaataaatgacagtgtaatcctggagtcacattgttttgtattttgtaatggtaattgtgagttagtttagagctggacgtgtaatttgactgttggatttgcttattactaattagcctataatagtttgttgattaactctgttaaaagaaataagtttgaaaattgactttggacttgcatttttagctgataattggatatttgaatgattgtggataattagttaaggttaattgcaacatgagtcaggaagtattattatctaggagctgaagcaaaactgggatgaacgttattagcatataattagtgtagaatttcaaactcagcatgttaagtgcatcacgtgtgtgttaacacaaaattagaccctgaattataacacggatacgttaatgctgctgttgatctcgcctgatttttgctaatgggccaagctgagcacaaggtgtggctcacgttctgcaatgggaactcaaactgagcagcatgttctcaaggcccaactcgctggttggtttcaattcagcaaggattgggccaattacttgagcccataattgctaaagggtccttattaatatgttttgtttaagtaactccaattatttagggcctctttttcttcattcttaggaacaaaatatagaaaatcgtagttgctttaggtttgtcctataattaataaaatgagacgagcctcgcaaaactcaccgattgcgaggccctcatgattgtatatatattaattacttagaactcgggatcgaccacttagcaaatttcacggcctttttcccaaagtaataacgcgttagtcactgttaggcccgtacttttaataatttactttcttaactcgggtgcacatttatgtgacccaaatccaaatctcaacgaagtcgaaatgtgtcgttaatcatgggtacattgattgtgacgtggtttgagatgcatttccataacattgcaaattcctttaaaaaaataatgaatgagacgagcctcgacaaacaagaatacacaaagtgcggggccctcaacggacagttatttcaaatgcttatatttcgagacaggccgcatagcgaactttacggctttttctcaaaaataacaaacgcgttagtatttttaggcgcgtatttaataatgttatcttcctaaactcgggtgcacatttatgtgacccaaatccaaatctcaacgaggtcggaacgtatcaaaaattgcgggtacatttatgtggcacaattcgagatgcattcttacaacgttgcaattctttgaataaataataacaaaagcggtaaacagttaaaatttgcacgtaggttcataattgtataaaatcagataatcaagccgaatatgacagttgagcgactgtgctagaaccacagaactcgggaatgcctaacaccttctcccgggttaacagaattccttattcggatttctggtgtgcagactgttaaacagagtcattcttttcctcgattcgggattcaaccggtgacttgggacaccacaaatctcccaagtggtgactctgaatctttaaataaaatcccgtttcgattgtcctttaattggaaaaactctcttttatgcccctttgcggggtgtaggtaaaaaggaggtgtcacaagtctgccaaatgatcagctagcttgttacctcaggtttattctcttgtatcaaatgacttggttgtttttctgtaggcctgtcattgctcaaatttccgagacaaatcattctattagaagtagtatctgcaaaagtaaaatctttctaaataatattatacggatttttccctactttgatccgccgttacgtgttttcgcaaaagagaatcggctcaggaatgttaagtctatcccttctttcttttttgcattatctatacgatacaagagaaatgagcaaatgcacaattttcttaaattactctatttgtagaaatgctagagatgtgtatattctttttctcccataagtcttattattctatcatttgttcatgagtcttagaaaaactagagttatataaaaacatactactaaaccattgtgtatgtatctgcagcattgaagaatggtgtttaacaaatcttgggttccgaagaggaaagaatatcacttaaatccgaaaagagtaatatctaactaatactgtagatcacaggaagcttgttccacaataacttttggcttctagaagcattaccttctttgttcattcttcatataactcattgaaccgaaagtcacatttagcctcaatcgtgctaaaacgtaaaaatagcacggtaaagccagctttcggattgattattcaaaaatagccagtgtttacgaagtcaatgaaaaatagccactattttgctgcaataaagatcggtccagcataatatactggagttcggtgcacctgtgtatgaactccagcatattatgctggaccggtatactttgctgactccagtatcatatactggagactggagcaccggtggtccaaactccagtatattatactggacaattatacttgctggaactccagtatattatgctggagttcaagcatacttatgctggaactccagtataatatactggcgtatttttcgggttttgaacaatgttttcgctcagatttatctttacataaaaaatagctaaatttcgattacttttgaaactggtctatttttgaacaaccagttgtaaatctggctatttttgaatttctccttgctaaaaccgaaagtagactacttattccctaactgacatacttattcttaaaaaaatggcatacaacatttgatttccttgcaaactattattggttaagtaaagaataagaacggttataatttgaatattcaaataacaagcaagattggctaaatctatttatgttggctgtattagtttgggattgaaatgatctatttggaaaaatcttctcgtgtgtattaaaaaatttattcacaagttacaaatatttatgtgtttccctaagcaatttgttaggttgagaaagaggcaaacccgaaaataaaaaagataaaggacaccaaattttagtatgcaaaacccttcaaatcgaaggtaaaaaccgtgggatcgtaaagatccaaaaaagctccactataacaataagagggttacaaaagttttccaaatttggctacacaacaagtgccaaacacggagcaataatagtaacaagagcaacaactaatcaattgaagaaagtggagaatccacaaaaatgaagctgttgttcgatgctcaaaatcagatgctacgagcctccaaatccgatctccaccgttcaaatataagaccaagatgttacgaacactcaataaaatttcagcctcatccaacggttaacgaattggaaaacatgatttgaaattgtctggtcggaataaaactctgcagcaaaacaaatacttttcttctatcttctctcttgatgaaagctctctcaaaacccactcttatatgcttaagtctttcggaacttccatcaatgagcatagaataattctccaatgttgtcctatttatagatcatgagtggtgctttctcttaaagccaaaacccacttaaaatagaaataaaccgaatcaaattccaaatagaaatggaaaccaaaagagaataggattaggccattgggcttttggctggacaacatgggcatgtgcccaacaaactctccctcaagccaaggggacaaatatgttttcaagtagaggaactattgacaggcttcatgcctgccaattttctacaaaattcatgtttatctgcaaccaccgcctttgtcagcatatccgaaggattttcatcaatgtgtatcttctcaacatcaaataatttcttttccacgaccattcttatccaatgatactttctatttatatgtttggtcttagaatgaaaaatggagtgcttggtgagacagataacactctagttatcacaaaataagatgtaccttggctactcaaagcaaagatcattaataaactccttcatccataatagttctttggcaccttctgtgacagcaatatattcggcttctgtggtggatagagctatacacttctgtagtttagattgccaagaaatagctccctctgcaaaagtgatcaaataaccgtaagtggatcttaatatatcaagattgcctcctaaatcagagtctatgtaacaaacaagttcaggctttccattgccaacgcacaacttcaaatctgcagtacctttcaaataccttatatccattttactacatcccaatgttcttttccaggactaaaaaagaatctactaatagtaccaacgacatgtgcaatatctgatctagtgcaaaccataacatacatcaagctaccaacagcagaatagtaaggaatacgagacatctcctttttctcttcatcagtagatggactctaactaatactcaatttgaagtgtttagcaagagtagtactaaccacttttgcatctgtcatattgaacctcttgagtaacttctcaatgtatttcttttggcacaaaaataactcctttctatttctgtgtcagtggatttgaatgcccaagattttctttgctatccccaagtctttcatcgcaaacgttttctcaactgcttcttaaagactgcaattatggatttattcttgccaacaataagtatgtcatccacataaagcaataaaataataaaatcatcattagagaacttctggaagaatacacattggcctaaagaagttttcttgtacccttgttcttctatgacagattcaaacttcaaataacattgccttggagcttgtttcaatccatacaggctctctttcaatttgcatacataatttttttcccttagttacaaagccctcaggttgctccatataaatctcctcatctaaatcatcatgaagaaaagcagtcttgacatccatctgctcaacctctaaatctatgcttgtagctaagcctagaaccacacgaattgaagacatcttcacaacaggggagaaaatttcatcaaagtcaactccattcttctgtccaaaacctttaacaactaatctcgccttgtatctagtcgcagaggtatggttatcatgctttattatgaatatgcatttgttagataaagctctcttacctttaggcaattttattaactcatatgtgtcattctcatggagtgacttcatctcatcttccatcgcttcgatccactgatctttgtgagtatcttgcatggcttcatcataattctcaggttctcccatgtcagtcaaaagtacatactcttcaggaggatagcacatggatttttgcttctccctagatcttctaagagaggtttcaggagcattcgaagtagttacctgtgcaggaattggttgctgatctaccaaaacttcatcaactggagcatccataacatctacaccatgatgatcattttgatgttgatcactatcttcatcattgtcttgtgttccttcacgtgcaataggtgccttagcaattgaaaccggatcaatatcaactaagctttcattactctgcgaatctatctctcaactttgtcaatatcttcaatagtttggtcttcaaagaatattgcatcacgacttctaataattttattgtcaactggatcataaaaatgatacccaaactcatcttgaccataaccaataaagatgcactacttagttttgacatccagttttgatctctcatctttaggaacatgcacacaaactttacacccaaaaactctcaggtgatcataagaaacatctttggcaaaccaaactctgcctaggacatcaccattcaaagcaactgcaggagacaaatcgataacataggcaacaatgtaaagtgctttcgcccaaaatgtatttggaagtttagcctctaaaagtaagcatgtaactctctcaactagagttctattcatcctctctaccaaaccattcaattgaggcgtcttgggtggagttttttgatgacgaattccttgttccttgtaatagttatcaaagggaccacaacattcaccaccattgtcagcgcgaatacattttcatttcttccccgtctgtctctcagctaaggcatgaaattccttaaacacgataagtgcttgatctttagatttcaaaggatacacccagagcttacgagaatgatcatcaatgaaggtcacaaagtaaagtgcaccaccttttgactttactttaaaaggaccacacaaatcagagtgtactagctttaataaatcagactttcttgagggaggatggctataaaggaaacctttttctatttgccagctaaacaatggatacaccttttcagctttgtttgtttcactccagaaagcaaacttttcttagccaaacacgtaatctgcctctcgctcatatgactcagtcttcggtgccacaattctgataaagtattactttccaccagatttatggagtcaataagaatagggccttgtgtcacatataattgaccagacttgactcctcaagccactactaacgagcccttagcgagcttccattggccattaaagagggcattatagtaactttcatcgtctaatcttcctgcggagatcaaattgaaaggaaagtctagagcatgcttgacatcttgaagaactaatgttgaaccattattattttcaacaaactattccaacaccaaacactttaacatcactagcattgcccatctttaacactccaaaatcaacatgagtataagatgagaaaaaatcttttcttggtgtgacatatgggtagctccagaatctactatccacctcgtctcatgggataccaaattgatgacattttcatcataagcaaaaaaaggtcatctagaacaatagcaacaacattgttcttgttattttcagctttctttccttctctagtgtcttgattcaacttgcggcaaaaccttttgatgtgtcctttcttgccacagtggttacatgtaatattatagtatttgaaccttgacttacttctacttttacctctattccttgagcctcttgttctatctctcccccagttttctgtaaccaagatatctgcttgtgaggatgaaccctaagattttctccttacttcctcgtgcaacacaccactcttggaatattacatggtcaccttacctccatgagctggatttgtcaaagaaacacgaagagtttcccaaaagtctggcagagtattaagaagccaaaatccttgtatctcatcatcaaaattaactcccattctagatagctgatcaaggatgccctgaaaatcatttatgtgatcaaggatagggatggcttccttgtatttaaaggtcatcaattgctttagcagaaacaatttgttgttcccgatttttaaagcataaagagtctctagcttttcccacaatgatctcatatgtatctcgttcacaatatggttgcaaacattatcttcaacccattgttgtatatatccacatacttgttggttctcaaaatcccaatattcatcggatatactctcgggtttataagctgaaaaaacgggtagatacaacttcttcacgaacaacaagtctttcatcttgcttctccaaacattataacttatcccatttaaacatgccatattgctcatatttgcctccatttcataacaacccggataaataaccaaggctctgctaccactgttatgtcgaggaagaggcaaacccaaaaataaagaagataaagaacaccaaattttaacgtggaaaacccttcaaatcgaaggtaaaaaccacgggatcacaaaaatctaagaaagctccactataacaataagagggttacaaaaattcttcaaattggctacacaacaagtgccaaacatggagcaacaatagtaacaagagcaacaactaatcaattgaagaaagaggagaatccacaaaaatgaagctattattggaggctcaaaatcttacgctacgagcacttaatctgatctaaccattcaaatctaatatcaagatattacgaatattcagtaaaaatttcagcccgatccaacggttaacgaattgagaaacataatttgaagttggctggtcggaataaaaatctgcagcaaaacaagtacttttcttctctcttctctcttgatgaaagctctctcaaaacacactcttatttgcttaagtctttcaaagacttgtatcaatgagcgtagaataattctccaaggttttcttatttatagatcatgagtggtgctttctcttaaagccaaaacccactcaaaatagaaataaactgaattcaattccaaataaaaatggaaaccaaaagagaatagaattatgccattgggcatttggatggacaacatggacatgtgcccaacacaattggtaggtagtgtttgaagaaaagtctcaaaagaccataagttggaattgccttaaagatctgtgcttcaaacctagagaatcataatggaacatcttgtgtcatcccatagtaaactcagttgttgctgatactttattatcatttcctccttccacaactagagctcggacattgacaaaactattttgataatgtagcaaaaagttctagtttttatttacttgtttcttttaccttttgatgaaggtggcaaaagattctagttggaggtggcaatttgaaactctaactattgttgatgtggtaattaccttagtgttgatctaggaataatggtcttatgaaatttcgagagattttgttgacgtacttctcatgcattgcattcatttatacatgtatattgatccatgaccagatgacattatatacgtgtatatatatatatgtatatatatgtatatgggatatgagaaaggttatggtattatatacgcaccaccacctaatcagctcgtatacgttgataattttgcccagagtggccaagatgatatgatggggtgccctcaaaggcttgatgatgttatggacatatgtacctatgcacgacatgacattcatatgcatatgcatgacactataagtatttcatgatttacagagtcatcaagacttacaggttgagtcctttactccatgtttcttccatgctctttatatatttatttacatgccttacatactcagtacattattcatactgatgtcttttattggcgatgctacattcatgcatgtaggttagataattagttagacgagccctcataatagaccagattgacattcagcgaaagatcggtaagactccgcctcattcggagtacggccgagtctatgagtcatcgtgtcagagttttgctacagacttatgggtaggccggtaccttgtcccatttgattttaaaaaaaatcttagaggctttggagacagaggttcggtttgtacagtatgttagagcccttgtcggcccatatgtattcatattttaagaaagatagtttattgatacagtgctgcccatacattacaagttgtgtcatgttggcccatgatagttacaaaagaaatgaataagttacagagtggttcgctcgggccactagggcaccgggtgccagccaggcctccctaggttcggagcgtaacagagtggtatcatagcagttcgtgtcctaggaagtctgcaaagccgtgcctggtatagtctcacttataggtgtgttgcgcgccacatttataattgagaggctatagggcattttggaaatttttaccattcttttattttcagatcgtgccatagagctgagttataagaagttagtatcaagctttcactggattttgtatgcaccaggggtgcaggtatcacagtaaagctttaagacgtaatttccacctactataaccccaatgaaggaattagatttcgcaaaaattataaagagttcatatagaatcactcagatttctcaaacagtttcataagctataagattcatcaagtatcgctaatacaatttggtttaaaggaaatactagtatcaagattttaggcagccaatatttctcaatacgagcaagtctatgtaagtgaactaccaacacatgagcactccccatgttatttttttttatctatttctccaccttccataaaccaactttttaattaatttttctcaaccatagtgaagaacgagatactcaactacaaaaggttgtgaatagtcgagacttcagatatagtttgggttttattttagtttacagaagagaccctagtaaaaaaattgcaaatctctaagagttacattcgatgacgaatgttctaaaagggggaaagatgttacaccccgtaagtttaacaaccttaccattttatatatatatatttaatatgatattttgagtgaaacatttttgtaaaaaaatggtttgaaaaatataactttttatagttattaatattactactttcgtatatgttttaaattatacacataatatgataaaagtttatgagattttcttcattgtaaagatatgaattatttttttcacaagaaaagaaagtttttttttaaccattttaaaaattaagtatacaaaaatttatactctttatatgagattatgacaattataagttgagaaaatatatgtacttttatatggatattttaatgaaataatcgtgtatgtatttattttatatgctactacatgaccatgatagtaagttatataatgtgtgttaaaagtgagtgatattttaagtaagttgagataattcttaattatgcgggtaattggtaattatccaaaaataaatttggataagaacattacgtggcagccatgcaatagtcataagatgaactcacatcaaacaaaataatataatgcttgaaagaaattaagtttccatactgccaaagatttcattttgtgcaagctactttccaccttgaagtatccgaatgccacataatagaaccattgccccgtcgtccgccacgatatgctaatgaaactcttcatggtataaaatttcattgttttcttcccttcattgccttggttccgaacgacgaccactgtagcttatccaaattcaaaattcccttcctttggtgtccagccccacaaatgaattgattatgagttccccgcctgcattgaaggctaagtctgccaaatgatcagctacctcagctttattctcttgtatcaaatgacttggttgattttctgtagacctgttattgctcaaatttctgagacaaatcattttattagaagtggtatatactgcaatttttctcaagaatattatacggatttttcctactttgattcgccgttacgtgtttccgtaaaagagaaacaactcaagtatgttaagattattcattctttctttttggcatgatctatacgacacaaacgaaatgagcaaatacacaattttcataaattactgtattcgtagaaatgctagagatatgtatattcttattctcccacaagtcttattattctattatttgttcatgggtcatagaaaaactagagttatataaaaacatactactaaaccattgtgcgtgtatctgcagcattaaagaatggtgtttaacaaatcttgggttccgaaaaggaaaaaatatcacttaaatccgaaaagagttatatttaactaatactgtagatcacaggaagcttgttccacaataacttttggcttcaagaagcattaccttctttgttcattcttcgtataactcattgaacagaaagtcacatttagcctcaatcgtgctaaaaccgaaagtaggctacttattcccaactgacatacttattcttaaaaaaatggtatacaacgtttgatttccttgcaaactattgttggttaagtaaagaataagaacagttataatttgaatattcaaataacaagcaagattggctaaaactgtttctgttagctgtattagtttgggattgaaatgacctctttggaaaaatcttcccgtgtgtattaaagaatgcattcacaagttacaaatatttatgtgtttccataagaaattggtaggcagtgtttgaagaaaaagctcagaagaccataagttgggattgcctcaaagatctatgcttcaaacctagagaatcataatgaaacatcatgtaccgtcctattgtaaactcagttgttgctgatacattcttatcatttcctccttccacaacttagagctcggacgttgacaaaactgttttgagattgtggcaaaagattctagttggaggtggcaatttggaactctaactattgttgatgtggtaattaccttagcgttgatgtacgaataatggtcttatgatattccgagaaattttattgacatacttctcatgcattgcattcatttatacatgtacgttgatccatgaccagatggtgtcatatatgtatatggcatatggaaaaggttatggcggtatatacgcaccaccatgtaatgacccgaccggtcgtttcatgagttaccgctccgtttcccccattttgcttattattgccttgttcagttgtattatgtgctatcgggttggttggctcgggttcagaaaagttttggtaaggtttgagacacttagtctcttttgagtgagcttaagttggaaaagtcaaccaaaagttgacttatgtgctaaagggctcgaatgtgagttccgattgtttgaatagctttgggaggtgatttctgacttaggagcgtgatcgaaatgtgttttggaggtacagagtagatttaggcttgaattggcgaaattggaattttggcgtttcaaattgatgtgtgagattttgatataggggtcagaatggaatttcgggagttgcagtaggtctgttgtgtcatttgggatgtgtgtgaaaaaatttagatcattcggacgtgatttgatagactttttgatcgaaagcggaatttagaagattttggaattcttaggcttgaatccgatgcaaatttggtgttttgatattgttttgagcgttccgaaggttggaacaagtttgaacgatgttatgggatatgatggcatatttggttgaggttcctagggcctcaggtgagtttcgggtggttaaacggatgaaattgcatgttgagaagttgcagatttttggcttcagctgttgcaggtttttcttcttcgcgatcgcgtagggagtctcgtgatcatgtagggccttgatgggggcagttcaggttgtgcttcgtgattgtgtcatgaccccaaataccgattgtgatggagcctatcacatcactaggcaagccaaccaatcaactaaccacgacccattttcctttaacattaagccattttctaacacaagttttaaatactgaagtcattataagcgttaaaacaacagaaatatgcggaaggtcaagtaaaatcctttttcaactagtaacaagtaattgacacgtaattaaggtgaagcaaacaaatagatgttcgcccctcacaatgataacataaatacatggaagaacacccagacacaaccctaaccggggtgtcacgagtcatgagcatctataagtcataatacaagtctgttaaatctataagctagtacagatgtctgaaaggagataaagatgataaaggagtagagacacggggctgcaaatgccatgcaactacctcgaagtcttcgtcaaatactgaacagttgaaagccctcactcggccgctcgtgtacctggaactgcacacaaggtgtagggagtaacgtgagtacgcaaactcagtatgtaactagagtaaataagtactgaaagcagtgacgagcagttaaaaaatacataactagataatcaacataatatcatgtcatctttccagtttaaattcagttttcgttataaaatcacatttccagtttaaacatttggaatcaaatacttagcagaatgtcaaacagaggcttatataaaaaaagagtgaaataagtgaaaacatcataacaaggcctctcgggcaaggaatcactcagaatatggcccctcgagcagcctctcagtcactcgtgactcgactctcatcacacagtactcactttcagcactcggctcattagtatctcataataagagaaatcatagtaaccgctgcggcgtgcagccctatccataatttatagtcgactatgctcactatggggtgtacagactctggaggggctcctacagcccaagcgtcatatagctgcggtgcgcagcccaatccaatatacaattcgctgcggcgtgcagcccgatctatataagtatcactgcggcgtatagcccgatccataatatatgcatataatatcctcactattaggttctcaacctctctcagtcattaacctcacaacctctcgggcacaacaatagaacttagggaactcagcctaaacagtccttacaattagaagtggagtgataaaaccagtcttaaacttttaaataggtaaacaatgactaaggatatgctttcaacaaataaagtgaggaaaaacagtaacaatgcccctaaggatatcaacaggtcgacataaggccccaaacatggcatacaacccataatacagtagagataactaaagtacggaatatcataaggtttcaaatcaaatacgcggctcaatagtcgctacgggatggagaaagtcacaatccctattggcgcatgcccacacgctcatcacctagcatgtgcatcaccatatttatcaaaacaagtcaaataccgaggttttgtaccctcagttccagatttacaatggttacttacctcaaaccggtgaaatacaactccgcaacgcctttgccccttgaatcgacctccgcgcacgtcgaatctatccaaaatcagaacgaggatgtcaaagtatgccaagggaacgaagcccaagcgaaaacaatcgaaaaataccaaaaatcccgaaattactaaaacccgacccccaggcccatgtcttgaaattcagaaatttttaaattaatagattcctcgtctccccacgagtctatgcatatcaagaacactaaaattggagtccaaatgacccctcaaatcctcctttaaaggcacttaaactcaagccctaatcctctatttttagcccttaatctccactaaaaccatgattaaatagtggaaaaatgatcttaatcccaagtaattaagcttagggaacttacccaaccgatatcctttgattgctcttgagatcctatgccttagcctctttcccgtcttcaaaaatggagttctttgcaaaaattcgcgaaggaagcaatatataccttctcgcttctgcggttattcacttaaaggaccaacctcacatctgtggtcaactctccgcacctgcgcctttgcaggtgcggtcaaactaccgcatctgcgtttcctgctgttccctcaaaaatccgcttctgcggctcctgttctgcacgtgcggcatcgcacctgcggtccccaatctacaggtgcggaaataccagaagcagctgagattctgcaacttcacaagtctaaacctttctgtcaaccatccgaaattatcccgaggaccccgggacatcaaccaaaagtaccaacatatcctaataccttgttcaaacttttaccaatcatcaaaacacttcaaacaccatcaaatcacctaaaacacatcagattcaagccaaactttctaaaatcttccaaattacattttcgataaaaaacccaaccaaaccatgtccgaatgacctgaaattttgcacatacatcccaaatgacacaacgaaactactgcaactctcagaattccattccaactcctatataaaaatctctcttatcaactggaaatcgccaaaatatcaacttcgccaattcaagcctaaatcaattacggacctccaaaattcattccaatcgtgctcctaagccacaaatcacctcccgaagctaactcaaccatcagaactcacttctaagccctctaacacataagtcaacatccggttgacttttttcaacttaaacttccttaaaagagactagatgtctcaaaccttacccaaatttcttccagatttgatccgaccaacccgataccacaaaatacggataaagaagcataaagaagcaaaaatagggaaaacggagcggtaacccatgagacaactggccgggtcgtcacatattgtgtatcatgagtcgcgatcgcgtgacttaggcaagttatgaatcgcgaatgcgtggttctattcgcgatccataggtgtaaggtcttgtacatcgcgttcgcgtgggtctgtccacgttcgcgtagaataaatttggggtcttggaagcttgttctttgcgatcacgatgagggtcccgcgatcgcaattaaggaaatttaatagctaggcagaatttttaaaaggccatttccgcgattttgaacctaagttcctccatttttgggcgattttgaagctttttgaaggggattgaagagggaatcaagggggaacacttggaggtaagatttatggactttatactcaatcctaatgtattttctacctaattaatcatggaatttaagcctaatattgaagaactagggtttgtaattggagacctaaaattagggatttgagattcatggttggattttggtgattttgatatgaatgaactcagggaatgataaggagtctgttgatgtaatttttatgagaatacgatacgtgggcccgggagtcgggtttggccaaattcgagatttgtgttgtaatttgatttctttcgagtgggccttgttcctttagcatattttttatggttttgcactgattttagttagatttgaagcatctagaggccgattcgagaggtaagggcatcgcgtgatagagtttggactggattgaggtgagtaatgattgtaaatattgtcttaagggtatgaaaccccaaatttcatatcgtttgtgctatattgaggtgacacatacactagatgacgagcgtggggtcatgcaccattggggattgtgacttactctatcccaaatgactgttttaccgcgtatttgattgaaaactatttgctatcatcatgttttgggctgaatgtcatatttgggcctcgtgccaactatttggacccttaggggatttttactgttacttactcactgttttgattttatatctgtacttagtcatgctatattatactattttcataactcagccatgtttactctattttaacaattaaatgatattttgggctgagcatcatattttactgtgcccaagtggcttttagagatttctgactgagtaaggcgagggcctgtgttgtgaggattattatgggatcgggcttcacgccacaacagtgttattctgatttttattataaggccaagggactgagttgtacgctacaagatggcttgatatgaggtcgagagcctatttattatgccccgagatggcttgatattgcgcttgggccgtaaggggcccctctcagagtctgtacacgggaacccattgtgctgtgagatatagctcgaggggctggagttgttctgtgttattgtcagaggggctgattctattgatattgtgcccgagaggcggattttatgtgtttatcttttctagctgctttttatttatttgtttctgttgaaaagatgttttaaagaagcttataataaactaagatgttttacaaggtttcactattttactggttttactctgcctttctatagcatgttgttgtgctttacgtgatttcttatcgcttagtcttcatttattgttattactcactgagttggagtactcactttactccctacacgcggtgtgcagatttaggagctttaggtcccgccagtgagggttgattgctcccagtaggccattcggtttccactaggtagctgctcggcgttcgcagcccagtatttctccctcctatcctactttatgctcctagttctataatagactgtgtaaactctttcatacttgtagacttatgatagatgctcatgactggtgacaccccgatgtcaggctgtgtttattccacaaattgtattatttcactgtttctttgggatttaatcatgttaatgacttaaattgtgttactttaattgcttaaaatgaattgggtgttgtttcggctgaccttgtcttcacgagaggcgccatcacgaccatgtctaggtttaaggtcatgacaagttagtatcagagcctaggttacataggtctcgcgagtcattagtaggtttagtagagtcttgcagatcggtgcggagatgtgtgtatttatcctcgaggagctgcagaacctttaggaaaaaacttcatattctagaaattcttgtcatgcaaatttgttgatccgagtaataaacttctgttattttattctctcactgatggtgaggacacacactatcggtcaggatggatgaccaccagtaccaccagctgtggtcactagaggccgaggacgcggtaagggcaggggtgtggcctgcacagcagctagggcagcaattgcatatccaccagacgccccagttcaggatcaggtcctagttgtggatgctccagcagcaccagctcaggcaccagttgtgcccattgtgattctgggtcttcaggaggcctttgctcagattctatcagtatgcactggcctagctcaggcagtttcagttactatagtcgtagcgacttcttaggccgggggaggcacttagaatcccgctgctcgcacacctgagcaagtcgtgcagggacttcagacaccgggggcacatctagcccaactggttgcagctgctcaggactatgtagctcctgccatgccagtggacgagcagcgcaggttggagagatttggtagacttcatcctccgactttcagtggtgcagagggcgaggatgcccagggtttcttggacaagtcttagagaattcttcgtacaacgagtattctagagaccagcggggtcactttcactactttttagttttctggagctgtcttcacttggtgggaggcttatgagaggtgtaggcctgttggtgcagcacccctttcctggcagcaattctccattctctttttggagaagtatgtgccatagtctcgcagagaagagctgcgcaggtagtttgagtggttgcgtcaaggagagatgactgtgacacaatatgagataaggttcttagagttatctcgcatgctatttggttggtttcgatagatagatagaggattaggaggtttgttgatggccttacatatcagcttcgtattcttataaccagggagagggtgtctggtgctacctttgaggaggttcttgacattgctcgtgagattgagtcagtttgtcgctaggaacgagatgagagggaggccaagaggcctcgaggatcttgtagttatggtagtgctccttcgagaggttagtttcagcacagcagaggccatccattcaggcatgctcatccagatcgcccaggttatcatggggaatcatcgggtcatatttctcatagttatcgtcagggccagtcatcacttagtgcccttctagcacagagttcatcccgtactccattagtttagggctcttctatgccaggtgcatctgttagtcattcaagtgctaggggttcccttcagtccccatttccagcacccaagagttgctatgagtgtggaaagatgggccacatgtagaagtagtgtcctcgtcgtcttggggttcatctcagcaaaggagtcagccatcgtgtttagcgctagttacatcaccaccacccacctacccagttaggggtggaggtcggtcagctaggggtcaccctagagggagaggtcgattaggtggtagtcaggcccgtttctatgcacttccagctagacccaatgctgttgcttcagtcgccgtgatcacaggtattgtctcagtttgccacagagatgcctctatattatttgatcccggttccacttattcttatgtgtcatcatactttgctcattattttgatacgccccgtgagtctcttatttcacctgttcatgtatctactccggtgagtgatattattgttatagaccgtgtgtaccggtcatatgtggtgactatctagagacctgggtggatctattgttgttatgtatggtagacttcgatgttatattgggcatggattgactatctccatgttgtgctattttggactgtcatgctaagacagtgacattggctatgccgtgtgtgccacgtattgagtggcgaggttcgactgattatgtttctagtagggtaatttcaatcttgaaggcccaacgtatggttcggaggggttgtctttcgtatttggcctttgtgagggatgtcggtgcagagactcctagttttgattctgttctagttatgagggattttcccgatgtgtttcctgcagacctgtcgggcatgccaccggacagggatattgattttggtatttatattgtgccgggcactcaatccatttctgttccaccgaatcgtatggtaccagcggagttgaaggagcagcttcaagaactctttgataaggggttcattcagcctagtgtatctctttggggtgcgccggttctatatgtgaagaagaaggatggcattatgaggatgtgcattgattataagtagtttaacaaagtaacagttaagaacatgtatcctttgcctcgcattgatgatttatttgaccagcttcaaggagcgagagtgatctccaagattgatctccgttcaggttatcaccagttgaagatcagggattcagatattcttaagacggcttttaggacccgatatggtcattatgagttcttggtgatatcttttgggctgaccaatgccccaaaatgttcatgtatttgataaacaatgtgttttggccttgtcttgacagtttttcatagttttcattgataatattctggtgtactcgcatagtcaggaggagcacgcggagaatttgagagttttgttgcagagattgcgggaggatgagctttatgaaaagttctccaagtgtgagttttggctcaattcagtggcattcttggggcccatggtgtccagtgagggtatttaggttaatccaaaaaatatagaggcggttcagagttggccaagaccgtcctccgccacagatattcacagctttcttgatttggcgggttattaccgtcggtttgtttagatgttctcatctatcgcattgcctttgactaagttgacttaaaagggtgctctattcaggtggtcgaacgagtgtgaggagagcttttagaagctcaagactgccttgaccacaactccagtgttagttttgccatcaacttcaaattcatatacagtgtattgtgatgctttgagaattagtatagtgtgcgtgttgatataggagggtagagttattacttatgtttctcgtcagttgaagccccataggaagaactaccttgttcatgatttggagttggctaccattgttcacgtgttaaagatttggaggcattctttgtatggtgtgtcttgtatggtgtttactgatcattgtagcctccagcacatgtttaagcagaaagatctcaatttgcggcagaggagatggttggagttgctaaagaattatgatattactattttgtaccatccgaggaaggccaatgaggagatgtgatttccttaatttctagctctaatccctggaataataacataggaatgagttttaagtccaaatcccttacctcaatgaagtctgctggaatttcctctttcaaatcgcccaaaaagctcccaagccgaagtaaaaatggtgaaatagctaaatttcgcgaaatgaaataacttatatgttctgcctaggcctttctgcatctgtgttaccgcatttgcggacattattccacttatacggaaatcacttaatcggccacatccgcatctgcgatcatccgtctgcatctgcgactccgcagatgcggttctcttagacgcttatgcggtccctgacaaatccccataatccacttctacgaccacccactcgcacatgcggcaccgcacctacggtctccaaaccgcaggtgcgaaaacaccagaagcagcaatttcagcagcagcaataacatctcaacttctccgttaaccacccaaaattgccccgaggcccccgggacctcaatcaaaagcacaaacatcttccaataccttattcaaacttgttccaatcaccaaaacacctcaaacaatattaaatcacccaaaacacatcgaattcaagccaaacttcctaaaatcttccaaattacgctttcgatcaaaaacccaaccaaaccactttcgaatgacctaaaatttgcacacacatcccaaatgacacaacggaactactgcaactctcagaattccttaccggcccctataacaaaatctcgcctatcaaccggaaatcgcaaaaatatcaacttcgccaattcaagcctaaatctactatgaacctccaaaattcattccgctcacgctcctaagccacaaatcacctcctgaagctagccgaaccatcagaactcacatctgagccctctaacacataagtcaatatcttgttgacttttccaatttaaactcactctaaaaagactaagtgtctcaaaccttgccaagtcctttccggattcgatccgaccaacccgatcacatatagaaccgatagataaaataataagaagcagaaatagggaaaatagagcggtaactcatgagatgactggtcgggtcatcacatcatccccaacttaaactatgggtgttaatcgggctgggctgacccgttttcagcccgcttcaacccagttcagcccgctactgttcacgttgggacggtttgggatgagttgggatggggggcaggttgtgtacgttcacgtttagactaacggtgccccgaacccgttaaacacgaatttccttaacgggctgaacacgggctgcaacccgttagccgcccggtttccgtttgaaatttttttttaattaaattggaccgttcccaacggtcaaattcataaatgaccgtttgggaacgccaaaaaatgcagaaatggccaatttcagccccccccccccattaattaatatagccctcccaccttaaaatctataaatagccccccttcttcttcattttttctcacacattcacacattcactctcttactactctaattctctctcaagtatcaaactctcaattctctcttgatactatagtttttaaattctcaaatctcaaattctcaattatttattatttcaagtttcatcaattatttagtttagccattacaaaattattattatcaaatatcaattattcaagtaaagtgtggtattaattatcaagtattcaagtattatcaactatcaagtttcggtctatcaattgatgtttgaattttgatatcaaaaattcaaaattagtgcggcataaggaatcctggtacactcgttccatctctttatcttatttggtgtacacttattttattaattagtttcttaatttaatttcttaatttaatttcttaatttaatttcttactttaatttatatattggatttacttagagcggccaaaaaagcgtgcactaaaggtggtagtaagaaaactttaaaaagaataagaggtggtgttggttcttctagtagctttacatatatttctgaaagttcacctgaaaatttaaatgtagattatgagcgaatgcaagaaaattatggtgtagatgatgatttagatgctttgttagatgagattcaatcacccgataatcttgacacaccaccacctacacctggtaatgctagtcaaactcaaaatgttaggggtgcaagtgtaacaagtaggcctcctctcgctattaagaagaatcgacgattaaaaagtaagtgttggatgttttttgaaagactagaagatcaacaaaaatatataaaatgtaaaatttgtagtgaacattgtgagcacgtgattttttccctatatatgaataattcccaaaattccaacaaaataatttctctttattcttacaatttctgtgcatttcggtgtcattttttgataattgtcgcattttatttgcgcatgttaatttatataaaaaacaaaaatatgcatttcgcatttaggttttagttttattttttagtatcaattaagggttaatttgtttagaacaaaacatgaaaagcacaaaaaattagttcacttttgcatttttatgatttttattatgaatttgtcatgaaatagtattaaacaattttaggtattaattagttttaattttgaaatatatattaggactttattttggcaattttacaaaatcaaaaaatacaaatgaaaacaaagaaaaagaaagagtaaaattagaaaaataaaggaaaaacaattaaaatggaggtagtcttaaaaagacccagaagttgggccaattccgttcttaacccccagcccaaacggatcccagcccaatcacgcccaagcagtccagaaccctccggtccaaggtgttagattcaaaacgacgtcgtttggcgtcgattaattcaagccgtcgaggtcccatgatctaacggccaggaagcctaacaccttaatatatatatatatatatatatatatatatatatatatatatatatatatccgaaacattacccccttcccaccccagtctctcaccttcctcaccctacctctcatcttcatgaaccctaatccgcgccgcccctaaatccctcgccggcggtgagcgtcacttacaccgttcaaatccagattaacaccatagatcccccatgaatccctctttctattcccgttattagtttccctcgaatgttgtcggggctcgtcgaatcttcgattgaagtttccggccaggtcgcaagtttatccaaaccaacccaaaataataccacacaatccccagaattcccttaacccaaatccatgaccatcttccttcaaatctctgagaaggggctcgaatttcagatctaaatttctggccaaaaccctaaaccaaaatctttatgatttcgaaccgtaatatccttaaccatgtgttctcttgtaagaacatgtggttagggatgttgcgtgtcaaaaatctgtagagattcgaaaggcagtgcttagtcggagatttagctctgttgggtaagttttctttaactctctgaatcgttttcaatagtctcatactcccttatttggttagttggattgtttgtttatcgatcatattttaatgtcgttcatagataataatagttgttagtttaattagctagtattaacgttagttcatgctgatacactattttgattgccctgtttgtctctttctggttgtttaatgattctgagtttagatattagtttaatgttgacgattactctcgtttgattaatggattgttagaatatgcagtaggataagttgtattttgattcaattttgatattctgccttagagttggacctggttggttgtagttgagcaaatcttttgttttagttaactttagttagattttagctggggttaaagggattgggatcagttaaccttagtctgtaaattccagactagtagaagggcattttagggatagaaaagggtagtttcttttaggaatagtaatttcaaagtaagggcaagggtagtataggtatttggtgggtagaagagcatcctagggccttctagaatggtacttcagtgcagatgttggcatattagagggacttgcttgtttggcaagtcaaaaataaagggatcaaactgaaaataagggaggggctaaaagagaaacctaaaatctgattccccttcttgtgtcacctataagaagggcatcaagtgccttgaggaagggtcttctttctcagccattcttggactcaaaaacagttccttaccactagcctatttccagtaattcttgagttccaagtctgttagctaccactactgatttgaatggttttatccagttagattggatttctaatgttgactagaataaggggccgtgggtttaccaggttttcgatacagtctcagtagaaaaggttcttgaggggaaaagtgtcccggtccctagaataacagctgcaactgtcatggtagcctctgaaatgttgaaaaacgggtttttaccaggcaaagggttgggtgctgatttgcaaggtattgttcagccagtttatttgcccaagaatctagatacctttgggctgggtttcaagtatacagcggtggatgtaagacgagcccacaagatgaagaaaagaggctgggttcttcccaaaccaattccacgtctgtctaggtccttcgtcaggccaagtatcgggaagcaattattggcaaaggtgtctggtccactgactggtgtggataagaacttggagaaagggattgagaaggtatttgctgagttgaacatggttgaggccggggaagggtcgagcaaagcagatatacagtacatcgggccacatgctaatgtcaacaactgggaagccactcctcttccatctcgcagggagtcgcggtagtgggttttgttttccttttgttcacctggattattccagggtttgtaattcagtttctatgttccgtccgtttggatgagttaaaaccctgttatctttacattcaatgaaatgcaattccttttctttcttaattactaattttgtttccatttctttttccttttcttttctgtacagttctctttatgctgatatcgatgacatgacatgcatgaggaatcttcggcccagttttaaaagccaatctaattcagaaataatagtgcaagaaatcgagtgtcatgatgaggtggaatatgatgatgacaaggcctatgaggaagttagtcaagaattaagtcacttttaataaaaacccaaacctaacctaaatgacatagaaatagttaatctaggggacctagacaatgttcgtgaaactaaaataagtgttcatctggagccacagctcaaggtggggataatcaaagcattgttcgattgcaaggatgtttttgcatggtcgtatgatgctatgcgggtctaagtaccgatttagtggttcacaaattacccactgacccgacattccctcctgtcaagcagaagttgagaaagttcaaaacggacataagtgtaaagatcaaaaaagagattaccaagcagttcgatgcgaaggtcattcaggttacattgtatcccacctggttagctaatgttgtgcctgtgccaaagaaagatggcaagaccagggtgtgtgtcgattatcggtatcttaacaaggcaagtccaaaagacaattttccgctaacgaatatccacatattgattgataattgtgccaaacatgagagtggttcttttgtggattgttacgcgggttatcatcagattttaatggacgaggaagatgtagaaaagacggcattcgtcaagccatgggtaacatgatgctatcgggtcatgccgtttggtttgaaaaatgctggggcaacttatatgagggcagtgacaacaataatccatgatatgatacacaagtaaatcgtggtgtatgtggatgatgtgattgtaaagtctagacagcaatctgaccatgtcagggatttgagaaagttcttccaaaggcttcgcaggtacaatctcaagcttaatcctgcaaaatgcgcgttcggggtgccatctggaaagttgttggggttcatagtcagccgccggggtattggactggatccatcaaaaatcaaggccatccatgaatttccacctccaaggaacaagaccgaggtgatgagtttgctggggagattgaattatattagtaggttcatcgcccagctcacgacaacttgtgagcctatctttaagttattaaagaaagacgctgtggtcaagtggacaaacgaatgtcaggaggcgtttgataagataaagaggtatttgtcaaatccacccgtgttggttccgccagaaccagggtgacctttgattctatatttaacagtattggacaattcgttcggctatgtattgggtcagcatgatatcactgtaaggaaggagtaggccatctattacctcagcaagaagttcacaccctacgaggttaagtatactcattttgaaaggacttacctcatatctcgtttggacccgttaaagtatatctttcagaagcctatgcccacagggaggcttgcaaagtggcagatcctgctcacagagtttgacactgtctacgtgactcggactgcgatgaaagcacaggccttggcggaccatctggccgagaattcggttgatgaaaattatgaacctttgaagacttatttccctgatgaataggtgatacatgttgaagagttggaacaagttgaggagccaggatggaaacttttctttgatggggccgcaaacatgaaacgcgtgggaataggagcggttcttatttatgaaacagggcaacatcaccctgttacaactcaacttcgtttttattgtacgaacaacatggcagaatataaggcatgtatcttggggttgagattagctatagatataggtgtccaggaagtcttggtcatgggtgactcggacctactagtacaccaaattcaaggaaaatgggaaacacgggacttaaagcttataccgtaccgataatgtttgcatgagcattgtcaacggtttcagtcaatagaattcaagaacattccaaggattcataatgaagtggccgatgcattggctactccggcatcgatgttacaccatccagataacgcttacgtggaccctttgcagattcaggtccgcgatcagcacacttattgtaatgtagtggaagaggaacttgatggtgagccgtggtttcatgaaatcaaggaatatatcaggatgggtgtgtatccgatacaggccacaggtgattagaaacgaacaatacgatggttggcaagcgggtttttccttagtggagaagtgttgtacaaaagaactccagacctcgggttgttaagatgcattgatgcgagacaggccacatctatcatgactgaggtacattccgtagtttgtggaccgcatatgagtgggtacgttctagcaaagaagattctcatagcaggttattactcgctcactatggagcaggattgcatcagttttgtgcataaatgtcatcagtgccaagtgcatggagattttattcattctccaccatccgagttacatacaatgtctacgccatggccctttgttgcttggggcatggatgtcattgggccaattgagccagcagcatcaaacaggcacaggtttattctggtggccattgattatttcaccaagtaggttgaagcgaaaactttcaaatccgtgactaagaaagcagtgtttgattttgtgcactcaaatatcatctgtcggtttaggattccgaaggtaatcatcacggacaatagcgctaatctcaatagtcatctgatgaaggagacatgtgagcagttcaagattactcatcatcattctactccataccgtcctaaggcaaatggtgcggttgaggcagccaataagaatataaagaaaatactccggaaaatggtggaaggatctaggcagtggcatgaaaagttgcctttcgcattgttgggatacacaccactgtttgtactttggtgggggcgacttcttactctttggtgtatggtatggaagcagtgatacccgaagaactggaaatcccgtctcttcgaatcattgcggaggctgagatctacgatgatgaatgggtaaaaagccgccttaagcagttgagtttgattgacgagaagagattggcatcagtgtgtcatggtcagttataccagcaaagaatggcaagagcatacaacaagaaagtgcgtccgaggaagtttgaggtgggacagttagtgttgagacgtatttttcctcattgggcaggagcaaaaggaaagttttctcccaattggcagggaccatttgtcgtaaccagagtgttgtctattggtgcattatatctgacagatgtggaaggaaaatgtgtagaaatggccatcaattctgatgcgatcaagagatactatgtatcatttctttattttgattgtaattgtttgtatttggcatattttaaagattgaaatgacgaaggcgttttgttctgctatctaaacacttttaccccttgtcatcccctttgagccttacttattttctttcatatccctctttcggaatcaatgtcaccattaagaaacacgagtgcggaagaaaagaaaatgaaaagaaaaagaaaaagaaagaaaagtgaaaagaaaggaataaaagaagaagaaaattgaaaagtgaaaagaagaaagaaaagaaaaaaataaaaaggaaagaaaatgaagaaaagaaaggaaaagaagagcggaaaaaagagaggagaaaaacatcaatgtactctctatgacgtgaactacgtttgacttgatcccgaaagggtacgtaggcagcctctctgaggttcagtcataccaaaataaaatccaaaagtccccaagcaagaaactggggcagaagtcgtggttgttgtaagaaatctgatttcgaaagttgtaactttaaaccattttgaaattattttgagactttcatacactttttttctagccccgtccaaagcccacattacggtccaaagaaagaccttctgataaatctttgagaaatgccaagtcaagcaggtaaatgtaattcatgtctggggcaacactctggttcaagcaagaaaagcaaaaagataaaaatgagagagtcttattggtgaaaacctgcacagtcactgtaaagcaacgggagttgagagaaagaataaaatgagagagtcttattggtgaaaacccttgcgggcaccttgaggcgaaagtgagttgagaaattattgatggagaaaggtctgttggtggaaaattgtttcgaggcaccacaagacgaacaaggctaaggtttggataaagtaataaactgatggaaattctggggaaacaaagggtggcgaccaagagttggttagttggacagatttggccgattagtccgaaatgcatgtcatgacgattaataccagctgttccggtcagataagtttcgttccccttttctttttagcagtcatccaattttgtattcttctaatccctaactcataaactcattgcatttcattttctttgggggatttatctgtctaaaatgtttcaatgtcagttttgctcaaagcaagtggaaagggatttcaaaacttactaccagattccagaaagtgtaaagcgcgatgtggtcagagcatgtaaaaaataatgtgatgaaaggtggaatacagggaatcaccgaaaatgtcatcggtggaatgattgggaaatgtcgtgggaagtgcaaaggttcagaaaaagggtcagaggtgtgaaacaacaacatgggtacagaacactcggtttgtcagagtcaggggttcgaagatcagtcagaaagtcaaagcggttcagggccagttcgggaagccagtcggaacaaaataatgcagcagaaagatctccagcaagaatgccaccaactaaccaccattttaaactgacaaattttctttgattaaaataggggcagaaaagtttgtttgtttcagaggaactctttggagaaaggcagtcaccaaaaaggtttgctttttaattttcaggaccctcctggaacatgggacctagtttaaagttcaaaaataacataatcaagcataaacgtaccctaaaggagtataagttggtttagaagtgtgcatgttcgagacaggattcaattaggagtttctaggaccctcctgaataatgggacttagctttaagattttaattagataaccacttttagagtaaactctgttgtagggtagtgtaattcagacatgaaagttgtcacccttatgataaaatttgacctttgattttcaggactctcctagataatggtgagtagtttaaagatcctcttagatagcatgatttagcagaagtcacacctgtagaagatataacttagattttaatccgtcgtttagttaagagttgtcaggacccccctgaataatgggacctagctttcaaatccttagtaatacttggtaatatggtttagttttacaatcacatctgcccctagccaccaaactggggtagaaaagtttctttgttttgtctatttaaagtcaggagcccgcctgaagagtagggaatacatttcaagtcagcagtcaggagcctgcctggagagcagggaatacatctcaagatagaagtcaggagcccgcctggataacagaggaatacattcatgttcaagttcagcagtcaggagcctgcctggataacagaggaatacattcaagttgaagttcagcagttaggagccaacctggataatagaggaatacattcaatttcaagattcagaagtcaggagtccgcctggagaatagagacatacagttcaagtttcagtaatcgggagcccacccgtacaataagggaatacattcaagttcaacaatttgaagaaaggaacaacacctcaatttgtagtttgcaatggcaacaagggattttaccaagaaaacacaagacaacaaggcaacgaggaagtacaacaacaagtttgaagaatttagataggattttgtaattcataggtcatagtttagtttagcttcttttattttaccatggtgtaataaggaaggtcagcaagtagtagcagcagcaatcgcaatgaaatcatagctcctggtagtcccagctaccagacacacctgaactacactgacctgattcctgtttagcccaggatacgtaggcaaccatcgaagcagggtgcggtcaatttttttttttaaaaatgcttcacacggaatattcaaacgggcaaaaatcgctcattttcgctcatttatctttgcacggaaattcttcgtgtttccaggcaaagaggggaagctgtgagcacgtgatttttgcccaaagcaaattattcccagaaattcaaacaaaacaatttctttattaatttacaattttttgtgaattttcgtgtcattttctgttaattgttgcattttatctgtgcattttaattcatatgaaaaatacaaaaatatgcatttgcatttaggatttaattttatatttttagtattaattaggggttaatttgttttagaacaaaatatgaagaaaataacaaaaatagttcacttttgcatttttaaattgtttaattgtgagctcgtcccgaaatagtttgtaaaataattttagaaataaattagtttatttttgaaatatattaggactttattttatttgttgcaattttataaaatcaaaaaaatacaaaaaatatacaagatgaaatacaaaaaaaaaattagataaaagaaacaaatgaaaaggaaaaaagaaaacaaaaagaatagagaaagggctgcccacgatttaggccatgcccaagtgattcacccaggcccaaaccccttgacccggtccattccctcagctaaacgaaacgacgtcgtttcgaggggcgtcagatcaggaccattgaggtctcttgatcgaacggatgagaagtgtgggtcgttgagtatattatcccccccgtccatctctaacctaaaccctaaaaaccagccgcccccatatcctttcatcggagctcgccggcagtgaacgacacctactccaaattaccccaaaataacaccacgagacctcctcttctccctcatcatgaatccaccacccatttccttcaaatcccgccctagctcgtcgaatcctcgatcaaagattctccggccaaaacctaaagtaacccaatcaccaccaaatcaacaccatgtgaccgcctgggcctcatctacccaacacccatagccctatctctcgaatctacctggaacagctcgaatatcaaattgaaggtttccgaccaaaaaccctaatgcaaagtctccatgactttggaccctaacaaccctaaccaggtgttttcttatgaaaacacatggttagggatattacgggtcaaaaatttcgggggatttggagaaacaaccactggccggagctctttgttgttagtgagttcttgttggcattttttttatttcaattctttttccttttttgattttctgcatgtgtgaattccatagttaatgtctagtttaatttgcgttttaatttttgtcaatattgttctaatcttgtgtcctgatttttttgattaagtctagttgtttgtttgattttaatatgttccaattcctgatcttagtttgatttttagttaagccgttgataatttgttaattagttttactaagttttgtttgaattaatttctggtgttcctagtttaggttaattactagttagttcagtttcagtttaattagtcgtcgtttggtagttagtttggtcattaattctgagttcaatcgatagattcaacaagagtttaaattggggtatattcagagcttaagaaactgtcttagttagctgtagttttagtttaagttcagtggtagcttagacatttaggattgggcagcacatggcagttgaaactagaatcttctagggccttctagagtggtaatttagtgtagatttcaataatttttgtgggattacttgggtaacaagttagaaaataatggactaattgaataaataggtaagggactgacattgaaaactgaaaatctgagggctgccctcattggtgcttataaaagggcatgccctttacttcatggggaggtttttttttcagccaccgaattccccccaaaactctctctctctctctgaaatttttagatctgaagtagaaatttaaatttaaaaaaaaaacaaaaacaaacaaaaactcaacaaaaaaaaatcactatttcattggaaattgtatactgatgttgatgttctagttactaattcacatcctctagttcactctttgattgctgatgttcagaatggttgttgggtgatttcgagcagtttttgggtctaattagattgtgtttgattgagatttggttctgtgaaagtatgctgatacatttctagcataactgagtgcatttcaacggttttggtttaatcggcttgtttcatttgagttctgaaccttcctggaatttctggattcattttctgggttgtttgttgttctatactgctgaaaattgcttactgctactgttgctcgtgcgttgcttcagctgacttccaactcttctttgttttgtggtctaaatctcaggtacatgtcctgaatctcaaatcatgtagctgtccaattggaatgaaatgaaatggaagtataacttcattggaagcttcagttattgctgtgttttatcatagttgattgtagtagtttggactgtaattaaaattgttttacactgatttagattggtttggactgttaaactcatggactgtttgggacatttgatcatttgttagacatgttgtagtttaatttcatttggtgtagttaggttttgaaaaatcagaagttattcaaagcataaagcaatcttgtgattcacagtcctcactcgtcttaataattggcagtgtaatcctagagtcacattgtttgtatttagtaatggtaattgagagttagtttagagctggacgagtaatttgactgttggattagcttataactaattagcctagaatagtttgttgattaactctgttaaaagacataagtttggaaattgattctggacttgcatctttaattgataattggatatttgaattattgtggataattagttaaggttaattgaacaaggaactgaagcaaaactgggctaaacattattagcatagaattagtatagaatttcaaactcagcatgttctcaaggtccaactcgctggttggtttcaattcagcagggattgggccaattacttgagcccagaattgctaaagggtctttattaatatgttttgtttaagtaactctaattatttagggcctcttttgctttattcttagaaacaaaaatatagaaaatcgtacttgctttaggtttgtcatgtaattaataaaatgagatgagtctcgcaaaacaaaacacataaattgcgggggcctcaataatgttatatgaaaatatttagaattcaggagggtcgttcagcgaatttcacggttttccccaaaataataatacgctagactctttaagcacgactttaataaaattacgttcctaaacttgggtgcgcattgatgcgacccaaatccaaatctcaacggagtcaaaatgtgttgaaaaccacggttgcattgattgcgacatggttcgaaacacgttttcacgacgttgcaattcttttaaaataacaataaaagcggtttacgaataaaaagcacataagctatcatgtattaaaatcatataaaatcaaatacaatagttgagcgaccgtgctagaaccatggagcccgggaatgcctaacaccttctcttgtggattggatctaccggtcctgtgaggtcaaattctgtggtttcgagactagagaggatctcttgttgcttgatatgatcgaatttgagatcatgccgagcatggattaattatctccatatcacgtcgtcctagattgccatgccaagactattacattagcgatgcaagggtttccaaggttggtgtggaagggttccacagttgatacatctagtcaggttatctctttcctgaaggctcggcatatggtcgagaagggtgtttggcttatctagcttatgttcgggacaccaacgcagagtccccaatcattgattcagttcatgtagtccaggagttcgccgatgtgtttccttctgatattcctggcatgccaccagatcgtgatattgatttctgtattgatttggctcctggcacctagcctatatctatcccaacgtaccgtatgactccgaaagagttgaaggagttgaaggagcagcttgaggagttattagcaacgggttttgttagacctagtgtatcgccttggggtgggccagtgttatttgtgaagaagaaggatgacactatgcggatgtgcattgattaccgccagttgaacatagccaccataaaaaacatgtatccgttgcctcgtatcaattattcgtttggcttgttgcagggtgctagggtgctctctatgatcgacttgaggtcagggtatcattagctgaagatttgggacttggatgtatcgaagactgcattccggactagatatgaccattatgagtttttggtgatgtcctttggcttgactaaagccccagcagcattcgtggacttgacgaacagggtgttcagaccttatatttattcctttgtcatcgtcttcatcgacgacatcatgatatactcacgtagactgggggagaacaagaagcatttgagagtagtacttcagaccttgcgagagcaaaagctatatgctaagttctccaagtgggagttttggatagagtcaatggcattcatggggcatgttatgtcaggagagggtattaaggtggatccaaagaagattgaggtagtccatagttggccatgtcctactttagtgacccagatcaggagtttcatggtgttagcaggctattacagacgattcgtgcagggcttttcatctattgcatcacctctaactagatagggtgctcctttccgttggcccgatgattgtgaggcgagctttcagaatctcaagaccgctttgactacaacactagttcttgtgttgctttccagttcagggatgtatacggtatattgcgacgcttcacgcgttggactgggatgtgtattgatataggaggggcgagttattgcatatgtttcgcgtcaactgaagattcatgaaaaaaattatcctgtgcaagattttgagttggttgcgattgttcatgctcttaagatatggatgcattatttgtatggggtgttatgtgaggtttatactgatcatcgtagcttaaacattttattcaggcagagggatctcaatttgagacaatgtagatggcttgagttactgaaggattatgacatcaccattctttatcacccaggcaaggcaaatatggtcgtgaatgccttaagcaggaaagctgagagtataggtagcttggcattcattcctgtagaggagcgaccactagcttcggatattcagtccttggctaacagacttatgaagttggatatttcggagcacaaccgagttcttgcatgtgtggttgctcagtcttcaggttcattcagcctagtgtgtcaacatggggtgcatcgattctgtttgtgaagaaaaaggatggcacaatgagaatgtgcattgattttaggcaattgaacaaggtaacaattaagaacaagtattctttggctcacattgatgatttatttgaccagcttcagggagcgagggtgttctccaaaattgatcttcgttcaggttatcaccagttgaaggtcagggactcggatattcttaatacggctttcaggacccgatattgtcgcgacccaaatctcgatcgtgatggcgcacaacacactactaggcaagcccgaccattattcaacacttaacccaatttatcaaaaatagtggaaagaaatatcaattaagcaagattaaagtactgaagattttaacaaaatacataatataatctcactaggacccagtgtcacgaatctgagcctctagaatacagaatatcaccctaatacacggtatatccaaagtccgataatgcagaaataaagagataggataggagagagaagatcaatggctgcgaacgcagtgcagctacctcgatactcccagaggctggatctgctgatcaactagatctactgagcctgagactgccttggatttgcacacaaggtgtagggggtgaagtaagtactccgacctagtgagtaataaaagtaactacagtccgaaaataagaaaatccagtaaatacacaaagtaagctacaatccgaatatacaacaacatatggaactgagcaacccgagccatccatatttatttatcgtcgacggcgctcactggggtttgtacagactcaggaggggctcctacagcccaagcgcaatatcttggtcagtcattgttacatgatcggtcagccattgttatctgaccaatttatatcatacagtgccattgttaccactgttcaagtatatcatccagtgtcattgttaccactatttcaagtatatcacacagtgtcattgttaccactatttcaagtatatcacacagtgtcattgttaccactgtttcaagtatatcacacagtgtcattgttaccattgtttcaagtcactttataatcagtccagaaaataatataataagccccttgggcatttacaaaacagaagttcccagcccggaatacatttaaaaatatcatttaagttttcaacacttagaattatggctgagtttgcaaaacagcatttaaaaccttggactgaaattaaatgatatgcaaatcatgctaagcagtaatatcaatcctcgaaggatattacaaatcggtacaaggccccaaacatggcatcaagcctagttatatcaatgaagtatgtgtatcaattaccagtatagtataaacatcacacgggatggaccaagtcgcaatccccaatagtatccgaccctgcagtcgccatggagtgcgtttcacgcctcaatttagcgttacgatgtgaaagtccggggtttcaaaccctcagaacaacatttacatctattactcacctcaagatggcaaaaagtctactccgcgataccctttcaattcgaatcgacctcctcgtgcgtcgaatcttgccaaaaccacaaggaatatattacaataggctaagggaatataacccaatcgaaaagactcgaaaaatatcgaaaatcacgaaatttgcaaaacccgagccccgggcccacttctcgaaaaattacgaaagtcacatcaccggattcctcctctcgccacgagtccgtacatataaaatttaccaaaatcggagttcatttgacccctcaaatcaccaaatcttattttcaaatccctaggcctaaatcctcaatttttctacaattttcatactcaaatccatacataattgatgtacttaactcaaaataggtggggataacttaccttcacattgatgatgaaaatcccctcttgaagctccccaaaaatcgtccatactttgaagaaatgaagaaaagtgagctaaatccgtgtataaaagaatctgtctgtgcttcgttgagttgtaccttgcacttgtgctatacaagttgttacatcctattaaaattgttccttgtcggacaccttctgtttaaacacccataacgtcttgtataaatacccaaatgacaaacgatttgaaaatttagaaactagactcaaagatctttaatttgataggttgtacaccatataactctttatatatcctgagatacgagcttctaaagtgcatcataaattctgccgaaattgctccagcagccctttagatccatagtaactttctgagatgatatccaaatcgtgaatggtttaactttccaaaaactagaatgtatgggctacaaatttcgtgtttcgcactttttctgatttcttatagattacaagatatgtgcttccaaactggactactcgcacctaaaattttctgggcacaacagaattttctgcaatttttcccaagtctgaaatcacttcgagacacctccgaaacactcccgagccctcggggctccaaaccaaatatgaacactgactctaaaacatcacacgaacttgctcgagcgatcaaatcgccaaaataacatcaaaatcaatgatttaagccttaaatccaagaattctttcaaatttcataaactttcaaatttccaatttaaggccgaaacccgtcaaacaacgtccgtttgtaaccaaacattacaggaagcacttaaccaacatatatgacctgtaccgggcgtcggaaccaaaatacgagcccgataccattactttctgatcaaatttcattttcattttccttaaacattttcagaaaacaatttcacgaaaaaattcatttctcgggcctgggacctcggaattcgattccaaaaacacgttcaactcccatatttttctatggacctttcgagaccgaaaaaacacgggtctgggtctgtttaccaaaaatgttgaccaaagtgaactttaacaatattaaatatcaaaatttttcaatttttcccataattcatatatttcaacacaaagatattccggacacactcctaagtctcaaataacctaacgaagctatccaaaccataaaattcgcatttcgaatccgatatcaaaatttccacttccggccaaattttctcaaaaaccttcaattttccatctttagccgaacgactccaaaatgacctacggacctccgaattcacttctgatcgtgctcccaaatctagaattaccatacggagctactcccagtctcggaatcccaaacggacatcaataatactaaaatgcattttaaaccaaactgatgcaatttcttctaaaatgctatctttcacaataggcgccaaaacgctcccgggttaaccaaaacccgatccgggcatacgcccaagtccgaaatcatcatacgaacctgctggaaccttcagattccaattttgaggtcgtttactcaaaattccaatcctggttcattttttcaattttaagctttcaaaatgagaatttccatttagatttgactccaaacttcctgaattttaattctgaccatacacataagtcaatatatctgagatgaagcttctcatggcctcaaactactgaatgacacgccggagctcaaaacgaccggtcgggtcgttacagttattgtcattattagttcttcgtgatgtcttttgggctgaccaatgccccaacatcgtttatgaatttgatgaacaacgtgttccagccttatatcgattcgtttgtcatagtattcattgatgatattctggtgtactcgcgtagtcaggaggagcacgcggagcatttgagagttgtattgcagagatttagggaggagaagatttatgcaaaattcgccaagtgtgagttttggctcggtttagtgtctttcttggggcacgtggtgtccagggagggtattcaggttgatccaaagaagatagaggtggttcagagttggcctagaccgtcctcagccacagagattcgtagctttcttggtttggcaggctattatcaccgttttgttcagggattcttatttatcgtatcgcccttgaccaagttgactcagaaatgtgttccatttgtatggtcggacgagtgtgaggagagctttcagaagctcaagacaactttgaccacagctcttatgttggttttgccaatagctttaggttcatatactgtgtattgtgatactttgagagttgggattagtttattattgatgcaggagggtagagttattgcttatgcttctcgtcagttgaagacccatgagaagaactaccacattcattatttggagttggctgccatagttcacacattgaagattctgaggcattacctctatggcttatcttgtgaggtgttcactgatcatcgtagtcttcagcatttgttcaagcaaaaagatcttaatttgaggcagcggagatgattggagttgcttaaggattattatatcactatattgtaccatccgggaaaggaaaatgtggtggccgatgctttgagccgaaaggtagtgagatggggagtttggcttatattccagttggggaaagacctcttgcaattgatgtttaggccttggccaatcagtttgtaagattagatatttcggagcccagtcgggtgttggctagtatggtttctcggtcttctttgtatgatcgcatcagagagcgcctgtatgatgatccgtatttgcttgtgattaaggacagggttcagcatgatgatgccagggatgtgaccatcggtgatgatgcggtattgaagatgcaaggcctgattacgtgcccaatgtggatgggcttcggtagttgattcaggatgaggcccaaagctcgcggtattccattcatccgagtgccgcgaagatgtatcaggatttgaagcggcactattggtggagaagaatgaagaaagatattgtggaatttgtagctcggtgtctcaattgttagcaggtgaaatatgagcatcaaggaccgggtggcttgctacaacagatgaatattcctgagtggaagtgggagagaattattatggatattgtttttagacttccacggactttgaggaagttcgatgctatttgggtaattgtggatcggctgacgaagtccgcacacttcattcctgtgtgtactacctattcttcagagcggttggtagggatttatatccgggagattgttcgttcccatggaattccgatttccatcattttaggtagaggtactatgtttacttcgcagtattggtgagccatgcagagagagttgggtactcaagttgagttgagcacaacttttcatcgtcagatggatgggcagtccgagcgtactattcagatattggaggaaatgttgtgtgcttgtgttattgatttcggagggtcatgggatgagttcctaccacttgcagagtttgcttataacaacggctaccaatcgagtattcagatggccccatataaggctttgtataagaggcggtgcagatctccagttggttagttcgagcccggtgaggtcaagctattggggactgatttggtacaggatgctttggagaaggtaaaggtgattcaggagaggctttgtacagcgcagtcgaggcaaaagggttatgctgataggaaggttcgagatgtgtcctacaggttggcgagaaggttctgttgaaggtttcacccattaagggtgttatgagatttgagaagaaagggaaattgagtccttggctcattgggccttttaaggtgcttcggaggattggggaggtggcatatgagctttcttttccacccagcttgtcgagtgtgcatccggtatttcatgtttctatgcttcggaggtatatcgatgatccgtctcatgttttggacttcgacacagtttagttggatgatgatttgacctttgatgtggagccaatagctattttgggtcgtcaggtttggaagttgaggtcaaaggatatagcttcagtgaaagtacagtggagaggtcggcccgtggaagaggctaccttggaggccgagcgggagatgcaaagcatatatcctcacctattcgaggcttcaagtatgtttcttgactcgtttgaggacgaacgattttttaagttggggaggatgtgatgacccggccagtcatctcctgagttaccgcttcgttttccccatttcagctttttatgcttcgttatccgtatttttgaggtatcgggtttggcagatcgtgtccggaatgagtttggtgaagtttgagacacttagtctcttttaagaagtcttaagttagaaaagtcaaccgggtgtttaattatttgctagaaggctcggaagtgagttctgatagttcgattaactttgggaggtgatttgtgacttaggagcatgatcggaatgatttttggagttgtagagaagatttaggcttaaattggcgaaattgatattttggtggttccggttgattgtcgaaattgatattttagtggttcttggagttcttaggcttgaatcctaacttaaattggtgattgatgttgttgtgagcattctgaagctttgaacaagtttgaacgatgtcatgggatgtgttggtacaattggtatgaagtttggggagttctggctaggttccgggatgttttatgccgaaaatcatagctgtagcaggtccagaagggtcgcaggcctcggaacccacccacgcggtctgcacaaaaagaagtgaggccgcggtatgtgctttgcggaccgcacaaaatgaagtacggtcgcggtaggtgctgtgcagacctcacaaaatgcagtgtggttgcggtggagaacattccactggtcctacttcagaagctcatatcttttgatcaacaaggaattttgggatgattcaaaaacaaaggttgtatccattggtgtctagtttccagaaaagtaaagatatcagaatttggacatctgtagaaagagttatagccaaaatactaaagcctgtcactgtagagaaaagcctgtgtggccgtggtcatttttgtgcggaccgcggtcgattttgtgcggtccgcggaggtgaaaatctgtggggtactctataaatatgaggttttgggttttatttgatattttgacctagagagctcggattttggcgatttttcgaaggtttttcaagaaattcatcggggtaagtgattctaactcagatttggctatagtatatgaatctatcatcgcattcatcacttaattcgtgatttgggatggaatttgggaagcaaattctgaaatctttcaaaaatataaaatgatgatttgaaggaccaaatggtgtcggaattggataattttcatattgctagactcgtgagagtataaggattctagttttgtgaattttgtcaaattccgagatgtgggtccgatggtcgggttttaccaatttctggaattttgtggtaatttcattgttttcgcttgtctttgttcccttagcatattgtgacgtattcgttctgattatggatagattcgacgcgcgtggagtccgattcgaggggtaaaggcatcgcgagttagagatttcgccgattcgaggtgagtaatgattgtaaatgatgttgtgagggtttgaaaccccggatttgcacatcatagtgctatattgaggtgagtcacacgcttgatgacgagcgtggagtcgtgcactattggggattatgactaggtccgtcctgattgatgattttaccgcgtatttgactgaaacttatatgttatcatcatgatttgggctgcttgccatatttgggctttgtgctaactatttgaacccttcggggatttttattactatttcctcactattttgacttactaattgaactcagtcatgttattttccactattttactactcaaccatttttactcctttttgagacttaaatgatattttaaataatgttttgggctgagaaatactgttttactaatgcccgaggggcttgtgagtattttttactgagtgaggccgagggactagttttgaggaaacactgatactgatttgaggctgagggcctgagatatgtacgcgacgaggtggcttgttgatttagtttatgaggccgagggcgtgagatatatacgccacaaggtggcttaattgatatgacgtcgaaggcctagatttgatgccacgagatagcttgatattgtgcttgggccataaggggcccctcccggagtctgtacacccatagtgagcgcgagtacccattataatgtgagattgagcccgaggggctggcattgttttgagattgagcatgaggggctggtactgttgtgagatgttgcctgagtggcggttttgttgatactatgcccgaggggcaaacttttacttgttatttacctattaattacttattttacatgctgaaaaagggattttacttgattcttcactgattttaagtgatttttactgcttcggtataaaataccttgtattttacgtgttttcttactttcagtcattatttatatttattactcattgggtcggagtactcatattactccctgcaccgtgtgtatagatttaggcatagcaggtaccgctcctaagtgctgattcctctagtttcgggtggtttttcggagactacgaggtagttgttgacatctgcagccccgtttctctacttctatatcatttttgtttcctttcaaacacttgtaatagtttatgactttagcagactagtattatggtatagagatgctcgtgacttgtgacaccccggttagggctgtgtcgggttggaattccgatttgttatctctatttccgctaattgtgctattaaatcatgtttgaactattcttatgttatttaactacttaaaaggacaaaatctgttagactggttggccttgtcttcacgagaggtgccatcacgaccgagttcggggttagggtcgtgatagaactaaaaggataacaattggagtataacattgaagaagtcacttacacaagggacctaagatcataatgcacctttttgtgtttgataatatgctcaaacgagctagaatcttactctcgtctctaattcttggttcaattgtaattcttatacaatagattgaagtgctaagagtcccgaaattttataagaattaggggaaagctattgaagtatgtatggctaaaacccctcctcttagtaattgagcatccatggttcccgtataagtgttgtaagttcgaaacttgactgatgcaatgcttgttatgttaagtgaattgatgttgtgaaaatgtatgtggtaagtacttctttatgtgtttaatgttctattcttgtaaatggaagatgtggggataacatgatttatgtgctaaatgcctaacgatcatgccaaggttactttgaaactaacatgccaaacttgatgaatttccttctatgcttatgacctaaattgcttttgtatattcctatgactttaagtggcaaggtaaatgttgggaatgagaacaatgtgaaacttaagttatgaaatgtggaaattgtggccccaagcaccggtaaactaatgcatgtgtagccaaagattggagtgagatgaataacggaaagtggtaacatctcggggagacggcttagccgatcgggccgtgatcggatgccatgatatatatatacacatggtggtaatgtattgattattgaaaccggaaagtttgaatgaaataatggtaatgtcttggggagacggcttagccgatcgggccgtgatcggactccactcacagaagcggtggtaatatggataatgatgcaacaatgtgggattctccaatctaacattgtaagaactatgtaaaaatcatatgaacctccttatattgttggcatggtgcttattggaaactttgttgcctttaatatttcctcttcactctagaatggttgttctttctaacatgatagtgtttagttatacatacaagtactattccatggtactaacgtcccttttgccgggggcgctacatttttaaataaatgtaggtggctccatagtggatagtgccgatcgtatgtagcatagtatccttttctcaaaatcttggtaagccccttcctccttcaaggggtcatgttgtacaccttttgttatagacatccattttgaggtatagccgaggccttgttgccggcgttgttatcactgtcttttgtatccttagaggctccatagacatttgtgtgggttatgtatgggtattggataggtcaatgaaccatgtcataaccttatactcttgctttcttttaaactataactgtatggaatcttggacacttaactacgatttaatgttatgatataaaatgaactaaaatgttgaatgtactatctttccttgtctaaataaatgaaagcatggtttccttattcatattgagttcgatgggtagtgtttgataaggcttgctcagttgggttcactcgattgagcgccggtcgtgcctcccgaggttggggtatgacaaacttggtatcgaagcctaaggttttgaagtgtcctaggatgtctaggagccgtatctagtagagtccttcttatcggtgtgtagtcgaccacatctataagttggaggctactttggcatttaggaataacacccttctttgttattctggatcgtgcggtgaaaatgttccctctctaattagtgcattgttctatctttcagtaaatgacacttaagaagaaagcgagaattggccaaggagccaatgccacctcaggagtggcaaatgaatcattgcttgatattacgggtgagggtagttgccctactattaccctacctagtactcctattccaggacagactaccccagttcctgcacctgtgggggatactactatccttcacattgatactcctgtcccgcctccagccccaacttccggttctggtatctctgatgggaatcttaggggagctattcagatgctgactcagttagtggcctcccaggcctagaggtcaaatgctacacctagttcatctagccagtaaggggattccactagttctagggtaaacaaatttcttcagttagaccctctagtgttttcgggtgccaatcaagaagaggacgattaggattctattgaattagatgcacaagactccgagggtcatgcgtgcaactaagacagagggagtagagttggctgcctaccgcttgaaaggggtggcctatgcatggtttgagttataggaagaatcctgcgaggaggggatccctccggcgaggtggagtaagctcactgatgcttttataaatcattttctgcctgctgagacaagggtagcccatccagcggagtttgaaaatcttaaacagggtagcagaagtgtgtgggagtaccacatggagtttgctcgcctgtccaaatatgctattaacatgtttcccacaatagaggctagggtgcatcggtttgttcagggccttaatcctttgagtattaatgaggcttctacagctaccttgaattctaaaatgaattatgggaagatggtggtgtttgctcaggccacaaagaaccacaaactaaagaacataatggagagagagggtaacagaaagaaccaatctgtgggcaacatgggtgagtcactaggtgggggaataccagcttttcggggaggatcatcaggaccatcccagtctgttgcatagtctttagctagtgcaccgccatcagggccttgccagcagcaacagtggacttgtttcaggctcagtcagggaaatagaggatcctatcagcgggattggtcaggagagagaccccaacagcagcaaaggtccccatgccctaagtgcgggaagatgcatttaggggtttgctacttggagttacccgtgtgctatggatgcaggatgaggggccacattcagaggtattatcatgcatctcgccagggagcaggtaggggcacaacacattcatccggttcagcagttgctatatcttcagccccctctccagctcgaggtacccagcacccgtagggcgaggtgcagttaggggtgttgtgcagagttcagaagggcccaaccagttctatgttgtgagtgggttccagactgcaaaggcttccccaaatgttgttataggtattctgactatccaatctcatgatgcgtgtgcacttattgggatagaaccagagcagcttcatgaaccattttcgatatctactccggttggtgagtcaattttggctactcgagtttatagaagttgtgttgtcacgatgtgtggtatgaataccatggccgatcttattgaactagagatggtggattttgatgtaataatgggaatggattggctctattcatgttttgccaagcttgattgtcgaactagaactctgaggcttgagtgtcttaatgagcccattgttaaatgaaagggaggtaatgtagttcctaaaggtcggtttatttctgaccttaaggccgcaaagatgataaagaaggggtgtatctatcatttagtccatgttagggacaccgatgtcgaggcacctagccttgagtccgtacctattgtgaataaatttccggatgtctttcagatgagctccttggggttccaccagacatggagattgactttgggattgatgtgatgcaaggcacgcaacctatatcaattccaccttacagaatgacaccggcggaattgaaagagctaaaggaacaattgaaggattttctagaaaagggtttcatccggtcgagtgtgtcatcttggggcacatcggtcttgtttgtaaagaagaaagatggttcgttacggatgtgtattgactaccgacaactcaacaaagtcacaattaaaaataaatatccccttcctagaatagatgacttgtttgatcaattgcaaggtgctgtgtgttttttaaaagttgacttgtggttcgggtatcatcaattgaagataagggagcaggatattccaaagacagctttcaggactcggtatgggcactttgaatttctggtaatgtcttttgggctaacaaaagccccggcagctttcatggatcttatgaatcgagtcttcaagccatttctatactcctttatgatagtattaattgacgatattctcgtaaattcccaaagtcaataagatcaagctaaccatctcagggcagttctgcagacccttcagcaacatcaactgtatgttatgttttcaaagtatgaattttggcttgaatccgtaacgttcttgggtcatgtcgtctcttgggaaggaattatggttgatcctcaaaagattgcggcagtgaagaattggcctaggcctaccactccaacagagattcgcagtttcttagctttggctgggtactaccgaaggtttgtggagggatttctactcttacctctccattgactaaattgacccagaaagcagttaagtttcagtggtgcgatgcttgtgaaaggagatttcaggaattgaaattaagactgactacagcgccggtgttaaccctgctagagggtatagagggatttgtggtatattgcgatgcttctaggatcgagcttgggtgtgtgttaatgcaacatggcaaggttatagcctacacttctagtcaactcaagaatcatgaaaagaactaaccaactcatgacgtagagcttccggcagtggtgtttgcgctaaagatttggtgacattatttgtatggtgtccatgtggatgtatttacggatcacaagagccttcaatatattttcaaacagaaggagttaaatttgagatagagaagatggctagagttactcaaggactatgacattgatatcttctatcacccgggaaaagctaatgttgtagcggatgctcttagtcaaaaatctatgggaagtttggcgcacttagaggcatataagaggccgttggccagggaggttcaccagttgtctagtttgggagttctccttgcagactctaatgaaggaggggtgattgtacagaatagggctaaaacatcgcttgtggcggaagtgaaaagaaatagttcaacgatccaatgttagcacaattgaaagaggggattcataaagacaagaccacagctttttcccttggcatggatgatggtaccctatggtaccaaggccgcctatgtgttctaaatattaactgtctttgggaaaggatcatggcagaagctcatacttccaagtattccgtgcacctaggttctacgaaaatgtattatgttctcaaggagtttattggtggaataacatgaaaggggatgtggcggactttgtggctagatgtccaaattgtcagcaagtgaaggtcgaacaacaaagacctagtggattggctcaaagcatagaaattccaatgtgtaaataggagatgatcaacatggattttgtggcagggtttccgcgcactccacacaagttcaactcaatttgggtgatcgttgatcgactaacaaaatcagcacactttttgccaatgacatctactgacacggcggaacaatatgctcagtcatatatcaaagaaatagtcaggttgcatggcactccagtctcaatcatttcagatcgaggggctcagttcactaccaacttcttgaagaaatttcagcaaggtttgggtacgcaggtaaatcttagcacggccttccaccctcagatcgacgggtaagaggaacgaactattcaaatgcttgaggacatgttgcgtgcttgcactcttgatttcaaaggtagttgggatgaccattttccactcatagaatttgcttacaacaacatctttcatgctagtatccaaatggcgccatttgaggcattgtatggtaggcaatgtagatctcccattgggtggttcgaggttggagaagctaaattgatagggccgaacctcgtgcatcaggctatggagaaagtcaagattattaaagaatgactgaaaactgctcagagtcgccaaaaatcttattcggatgtgtgtcacagagatttggagttcaacgaggatgattgggtatttttgaaggtttcccccatgaaggatatcatgcgatttggaaagaaaggtaaattaagtccgatgtatgtcggatcatacagaatcattcagagtattggtcaagtggcatacaagctcgagctgcaacccgatatgtctttggtacatccagtcttccatgtgtctatgttgaagaaggtagtgggagatccgtccattattgtgccaattgaaactactggggttaatgaagaactgtcatatgaagaaattcttgttaccattcttgacaggcaagtccggaagttgaggaataaagaaattgcctccgtaaacgtgttatggcggaatcggcaagtccaagaagccacttgggaagccgaggaagaaatgagaaagaagtacccacatttgtttgaatagtcatataaatatcctctatgcatttgattcctatgaactcttatcttttgacttgatctatgtaaaactattctattttggttatatatattgcttatgtggctatggttggtgatgtacaagttatgttgtgtctatggaacatgtatatgctgttaggatatgtatcgggggccctctgacaggtagataggcctagttacaaaggaaactctgccaaaatttttggaaattttgggagttaaccaaatttagggctgtggatatgtttcatgttgtgaaaagctgaggttgcataaacattccgaataagtgagccctgatcctcgtttgaggatgaatgatcttaagtgggggaggatgtatgtccccgtgaatatttctactcaaaaacctgaatctcatggtgctaagttaggagcatgtgttagaaattcataaaattcttcgcggctagcttgcttgctgcggttcagacccttttaaaccgatctatgcacaaaaaagtcaagaaataatattttccagaaaagtgtgattctgcagttgggaatgtggtcgcatatcaggtatgcagactacagggtcgccgcaaagtgagtcagtgtgttggtcaaatttgaggtcaactatgggtcaattatgcgatcgcataaccgatatgcggaccacatagtcatcgcataattcccttaggattttgtaaggagtagttctgcggtgcattatgcgaccgcagaataggtatgcggaccgcttctctgccgcatacccagacaatatgttcaggttttggggagcaaatttgtagtccattatgcaggccgcatgtcaactttacgatcgcaaatgcgatcgcagatctgactcagggctcctattttctaatttttaaaactcgaacctattccattaaaacaccatattcaatattctctatgtcatttttactgaaaatagagtgagaagaggagttctagagagagaaggggtgaccttcgtctaatccccacccaactcttaccccaaaatcttgaagattgtcaagaaagttgctaggtcttcaccctaaagaggtaagaacttgttccataatctgtaatttggggattctatttaaaaataggtgattaacaattgagttcttgggtaagagggttaatagtcttgcatgtataagggccaatggggtatggggaagataagaactaaaaggataacattcagagtataacattgaaaaaatcacttacacaagggacctaagatcataatgcacttttttgtgtttgataatatgctcaaacgagctagaatcttactctagtctctaattcttggttcaattgtaattcttatacaatagattgaaatgctaagagtcccggaattttataagaattaggggaaaactttattgaggtatatatggctaaaaccccctcctcttaaaaattgagcttccatggtgcccgtgtaagtgttgtaagttcgaaacgtgactgatgcaatgattgttatgttaagtgacttgatgttgtgaaaatgtatgtggtaagtacttctttatgtgtttaatgtgctattcttgtaaatggaagatgtggggagaacaagatttatgtgctaaatgcctaactgtcatgccaaagttactttggaactaacatgccaaacttgatgaatttccttctatgcttatgacctaaattgcttttgtatatgcctatgactttaagtggcaaggtaaatgttgggaatgggaacaatatgaaatgtgagctatgaattgtagaaattgtggccccaagcaccggtaaactaatacatgtgtagccaaagattggtgtgagatgaataacaaaaaatggcaacgtctaggggagacggcttagccgtcgggccatgatcggacaccatggtggtaacgtattgatgattgaaactggaaagtgtgaatgaaataatggcaacgtctcggactccgctcacagaagcggtggtaatatggataatgatgcaatagtgtgggatgctccaatctaaaattgcaagaactatgtaaaaatcatgtgaacctccttatattgttggcatagtgcttatttgaaactttgttgcctttactatttcctctttactattgaatggttgttctttctaacatgatggtgtttagttatacatacaagtactattccatggtactaacgtcccttttgtcgggggcactacatttttaaatgaatgtaggtggctccatagaggatagtgtcgatcgtgtgtagtagatcatccttttcccaaaagcatggtgagccccttcctccttcaaggggtcatgttgtacaccttttgttatagacatccattttgaggtataatcggggccttgttgccgtcattgttatcactgtcttttgtatccttggaggctccgtagacatttgtgtgggttatgaacgggtattggataggtcaatgaaccatgtcgtaacctttgctttcttttaaactataactgtatggaatcttggacacttaactacgatttaatgttgtgatataaaatgaactaaaatgtcgaatgtactatctttccttgtctaaataaatgaaagcatggtttccttattcatattgagatggatgggtagagtttgataaggcttgctcagttgggttcactcaattgagcgccggtctcgcctcccgaggttgggccgtgacaaacttggtattagagcctaaggttttgaagtgtcctaggatgtatcggagccgtgtctagtagagtccttcttagtagtgtgtagtcgaccacatctatacgttgaaggctacttgggcatttaggaataacacccttctttggtattttggatcgtgtggtaaaactgttccctctctaattactgcattgttctatctttcagtaaatgacacctaagaagaaagcgagaattgtccaaggagccaatgccacctcaagagtggctgatgaatcattacttgatactacgggtgagggtagtcaccctactatcaccctgcctggtactcctattccagaacagactaccccaattcttgcacctgcgggggatactactatccttcccattgatactccagtcccgcctccagccccagcttctggttttggtatctctgatggggatcttaggggagctattcagatgctgactcagctagtggcctcccgagcccagaggtcaaatgttgcacctagttcatctagttagtaaggggatttcaccagttccacggtaaacagatttgttcagttagaccctccagtgttttcgggtgccaatccagaagaggaccctcatgattttattgaatgagatgaacaagactctgagggtcatgcgtgcaactgagacagagggagtagagttgtctgcctaccgcctgaaaggggtggcctatgcgtggtttgagttatgggaagattcccgcgaagaggggagccctccggcgaggtggagtgactcactgatgcctttatagatcattttctgcctgctgagacaagggtagcccgtgcaacggagttctaaaatctgaaacagggtagcataagtgtgtgggagtaccatatggagtttgatcgcctgtccaaatatgatattcacatgttgcccacaatggaggctagggttcgtcggtttgttcagggccttaatcatttgactattaatgacgcttctacagctaccttgaattctgacatgaattatgggaagatgatggtgtttgctcaggccacaaagaattgcaaactaaagaacagaatggagagagagggtaacagaaagacccagtctgcgggcaacatgggtgagtcactaggtgggggaagaccaacttttcggggaggatcatcggaatcccaatcggacattgataacgctgtaatgaacttcaagccaaacttaggaaatttcttccaaattgttaacttccacaatatgcgctaaaatgcttccgggtcatccaaaacccgatccgggcatatgcctaagtccgaaatcatcatacaaacctgctggaaccttcatatcccgattcctaggtcgtgtactctaaaatccaatattagttaattcttctaacttaaagcttccgaaatgagaattatctttccaaatcaactccggacttctcgaaattcaattccgacaacatgcacaaatcataatacctaaagtgaagctgctcatggcctcaaactgctgaacagcgcgctagaactcaaaacgaccggtctggtcgttacattctctcccatgtaaacatacgttcgtcctcgaatgtgctgagaacaacactgaagtagtctgaaatcactgtttaaaatctcatgcaccttcccgtgctaccacaactcagttgggcacattagctcgatcaactctgaagatattcccttttattcaagaaaataagccttagagcccaattccaacatccagaattttatgccatacatgttctaacatacgctcaccgaatcgataaccgcatgcagcaccaagacatggctgcataccttagccaaattcacaccttacaccattttactcataggaccacaataacattctctaatcaatttcatcgaaattccatgactcggatgctctcattacatctcatgacatacataagtcttgctctaactcttacaataccgacacgacggatgagatgtgaagaaattcataaccactgccgaaataataattcattggcctatactcctggcaagaattatcacctcattctgaactaaacaatggccttagctccttaatatacttcatataactagatttcactgattccgaattcaaggatcccatctcacctagtacgaactcgtcaggcaataagccaccccggacataatcgaaagtctcatatgatgccacaatgtgccaataggctaccaattcaaacgcgatacaaaaggaaactactctgaaagggaaatccaattaccccgctcctgaatcatacatgcgacacggtcaacatgctaaataggcaccccgctcgcgaatcatacttgcgatgcggccaacataattaaacaaacacccgctcgcgaatcatacatgcaactcgggcacacggctaatatgagctttcctcaccaaaaataggaaaccaaacacataaaaatagatacggggaactatactcagcatcacactgttgcagcgcgtaacccgatccaaacaacataaccgtggcggtgtgccacccgatccacccataaaactcacataaagagatacaaaccgagctagattgctcatttcaataaattaccaaatatcggtcactagcacactaagtgcataatttcatccatcctgaggtgcgatatacgatctgaatctcaaagccatcctgctcacataacatcatctctacgcggaatctcagcacatagaaaattcagcaagccgtcccacaactcgcacgacacaatacatcattacatgaaatagctgacgacaaaacaacacctcgactactctttcataaggagcactttgttgaaatgaacatatctggcctgatatagagcccatactaacgtttaaatccatccacagacctcaagtcgatcctgatcgtaccaaaataggccaataacctttcgaaggtccatactaacttcccttttctcataacatacaagaacaactatcacaaccggagtactcctccacagccaacaacccaataaaccaagtaccctccaagcataaattctcaatttaaagacatcgccacaatcttcatacttggtttaacttctttaataaatgaagtgactacatgccacacttaaacaaccttcccgtggggcacgctcccataactttccgtaacaggtaacatgtctgtacatccaaaccactggccgcactaacattgaaaagcgattaagaatccttaaccatgatgcaaggcctctttcataaaacaccaatctcaggtgatgctgaagataataccaacttaccttaaacaccgaaactcctttcctgttgatccgagttcgtgacatccctgtcaacacagaactgcaaccttgatcctcacttcaaatcccataccactcactgcacccaacatgccaatatacaatataacatgttttttcatcataacatcggaaccactaatagattaacacttcatcatataaaaacttttcacttaactcatttcaggagaaccgtagcaatatacaggtgaattctcataaccgtggaatatgcaaatctctaagtagcggactaagccaccatagcccttccaagatcagcctacacataacagaccataacagaagaatactactgaacaatataaattacggcggcaaacaagcctcacacgttccgctacaaatcacatgcataacttgatcacgttgaagggactgatctataccaccaacatgccaactcaactatggttaactgatctatcttcttttgatttaccctgatttccttagaaataataataactccattcaacatataccatactctatccgcactcatcctgagtgaccttgaatcataagaccatgttgtcttaaaacccacaaaccatttcatacctcccaaatggtacactgcaagccaacacatcatagaacattctcgacctcttttcataagctgttacagtagcttgactcttaaccgtacctacaggctcaaaatcattaggcaccacactttacccctatgaatctactaggatcgttgttgagagccacccgctctgactcgccctcgaatatatttaactccatgaatcttccatcacatgaataccctctcggcaaagcacccggcagaatcactcccctttaaacgcgcttctatacaaggcataaatcctgaatacttccccaagtctgaacatgtgccaataaggacaaccatagcacacttgttaaagaaattaaaaatgggaaaatggtaattggtgtaagtggtcggcttgcctagctttcactagtacgcgccatcacgacccccgagggtgaaaaatccgggtcgcgacaaaatttgttatcatcttttattttttgtttttagatctttctaacatttttttcaatatttattttactttatcttattttctgatgtcattatttcttttttttacaaaaaaataatttatttcactataaaaggatgagttttaataaaaattgtctacataaactttaataaatatttttagtctttggttgaaattatttcatatttttctgttggctttatctgatcagcctaaataggtgttatcggtatatcatctatttatattagctataaaaagtaaacaataaatatggtcggaaatcatgtaaatattccataagatttcatttttttgagtttatccattatataacttctattataataattttaaaactctctattaatgttcaaaaaaatcttatctttttattatctttgaaataaaaaaaataaagagttttttcgaaataatttgtttacatttaaaaaaaatcacgttatatcaatttttgttttatatatactctttgttacacttaaaaacctctataaaaactatcaattagaaaccaatttctctcttgttgagtttgaaaaaaaaaacctttcacataatctaatgattcaaaactaatattcttcaacgaaaaaatattatacccttacaatattggcctgactatagttaaatgaaggggtttcatcttatacccttcaattccttgaatgtgctaaattgaaattaatgatagcaattgtatagacaaaattttgttatttatgtctatttatgcaaattgactcttcaaataaatattcttcaagaaaaaaaaaacaatttcttttaatattgattgattttgtgatgtttctttctccagtatgtatgtttactttataatatatgtaagtgtcacggcccaaattccattatgagtcatgatggcgccagatactgctgtcaggcaagccaaccaatacttaattaaattctcgttttaataattttgaaaactatgattttccttcaattttaccactaaaagataatcgtttcaaatcaagtatgaatgttaagaagttaatacaagatacccataatcatcctagaacccggtgtcacgagagcatgagcatttactagggaatggaataaaatacagtaactgtccggaatacaaagtgggcagaaatgaaaaacacagaaaaatactatgagtagggctctcccgggtcgtctcgataaatgcagctcacctaagtctccgtatcaaccatgccgctatgacactaagccactagccacatatgaacctgtgcaacaacaatgcatagcaagtgtagtatgagtacgaaaacaacatatacccaatgagtatcccgtctaatctcgaagaagtagagacgagaggtcgacttcgacacttactaatggtccaatgataatatagcaaaagtgtgaggaactcatggatttcataaagcaaaatttaattcataaggccgaaaagcaggtaaagaacttctcaattaataaaaggtttcgaaggatttacttttcattatctttattaatttatgtctggcaaggaagggcaattatcaacatttaaaattctctggcaagcaatacaagaatgcgcatatcatgccgaggtcatatggcccgatccaacataaatataaaatgtgcaatgcggagggtcgaacggcacgaaccctagatgaatctattatcccgctcgtgaatcatacatgcgatgcggtcaaatttaaataaacaatcaccttgctcgcgaatcatacatgtgatgtacgtacacatagacttacatgctcaaacaaccaattgagaatttatcggagaaagtttatccaaacaaaaccaattctcttttagcgatttaagaaaatgaagtttaatctttttattaaaaattcatttaccgattcgataggatttaagcaattcaactgccaacaaaattatagatattcctagtatagcatgcttttgggttctagactacccagacttatatataatagtagctacgcatagactctcgtcacctcgtgcgtgcgtagccccccacaaatagaagcacataaccaattattacacccatggggacaattccctcttaaaaagttagaaaggagactcacctcgctccaaagatccacaaccggcattccacgcccttccggagactcgaatcgatgctaaatgctccaaactagccaacaattatgcaaatccattagtatatgctcaattactcattacaatcaaatttataaaaattcccaatcccgatcgaaaagttgacaaaatttccctcgggcccacatgcccggattttaaaatttctcaaagataaagtttacccatgaacttacgaactcaaatatatgattttctcctaatatcatacccaaaatagtggtcaaaatccaagaatatcaattttctaggttttcccttaaccccaagtttctacaaattttcatgctcaaatacctaacaaaaccatgtatttaactcacaaggggtgatattaacttacatcatgtttgatgataaaatacctctctcgaagctctccaaaaatagcccaaacaagagtaaaattataacgacccgaccagtcgttttgagctctaatgcgtcgttcagcagtttgaggccatgagcagcttcacttcaggtattatgatttgtgcgcatggtcgcaattgattttcgggaagttcggagttgatttggaaagtgaattctcatttcagatgttttaagttgaaacaattagctaagattggatttttgagtaaatgaccccgaaattgggattcaaaggtttcagcagcttcctatgatgattcggacttcagcgtatgcccggatcgggttttgtatgacccaggagcgatttggtgcctattgtggaagttagcattttggaagaatttcataagtttgggttgaagtgcatttcggtgtaatcgatgtccgtttgggatttcgagtatgggagtagctccgtatggtgattctggagttgggagcgcgatcggaagtgaattcggaggtccgcgggtcatttttgagacatttggctaaagatagaaatttgaaggttcttgagaagtttgaccgaaagtggacctttttgatatcggggtcgaaattcgattccgaaagttggagtaggtttgtaatgtcgaatatgacttgtgtacaaactttgaagtcaatcggatgtgatttgataggtttaaatatcgaaagtatatgtttgaaattctaaagttcataaagcttggattggtggtcgattcgtggttttagcatggtttatatgatttgaggcctcgagcaagtccataatgtgttttggactgcttggtatgattggttggggtcttgggggcctcaagtggattccgtgtggttaacagaacgaaaatggaatttggagaagtgttgaagcatctgcttctttcataaccgcacctatggttggtcaaccgtaggtgagagaccgcagaagcggtcgtagcctcgtagatgttgcccagagctagccaagccaaactgcagaagcggctccttagcagtagaagtggcttcatgaccgcagaagcggtcccagcccttttagccaattccgcaaatgcggtcccctgaccgcagatgcggaaactgctgaagcagtcaacttcatttaagtcgagccaaccaattttgaccatttggcactcgggtattgagagattttggagcttttgagaagggatttccacatagcattgtgaggtaagttcatcccccttatatctaagtttgacactcgagtttttggtaaattaactcctaaagatttggagaaatcaagggttagagctagacatagggttttaataaaacttagattttaccacgaaattggttatgaaatagattagaaatcatatattatttatccttaggaaccttgcatttagggttgggaaattggtttacaaattagaatatgaatttttgagcatgtattggctagttattaccttatttgaatagttttggattgttcggctccaaattggaggttgagcgcgttctttagtcggaatataggcttcggagcgaggtgagtcttctttctaaccttgtaagagggaattgtccccataggtaatataattggttatgtgctcctatttgtgggggctacgtacgcacgagatgacgagagtccgtgcgtagctactattatgtttaagtccgggtagtctaggacccaaaaacatgctatacttggagtatttgtaatcttattgacaactgaattgcttaaatcaaatcaaattagtaaacaaatttctaaaaggatttaaacttcattttcttaaattgttaaaagagaattgttttttctttggataattgttccatgttgatttcttgattgactgtctgtgtgtgtttatctttggaactgatcgaacgcctcggtagattaaatagatgcatatatggttcgtgttgttcgacccacgacagtgcaccatttaaatattgttggatcgggttgtacgacctcgacatgatatgtaaatgcttgtattgcttgcctgagaatgttatgtgataatatttgtcttccctggctcgacatagttgataagcataatgaaaagtaaatcttggaaattcgtatttatttgagatgttgtttacctgctatctggttttacgagtttataattcctttataaaaatccatgatttcctcacattttcactatattattattggaccactagtaaatgtcaaagtcgaactatcgtctctacttcttcgagattagaagatactcattgagtacacgttgtttttgtagacatactacacttgctgtgcatttttgtttcacaggcgcatgcaactctagtggcctagtaggcatagcgacatagttgatacggagacttaggtgagctgcacttcccgagatgacccacaaccagcagtgtctctttcaaattaccgtatttactttctgtccaatactatatttcgtacggttattgtactacattatttactataaattgctcatgtacttgtgacaccgggttctgggatgatcacgggatttttcagtagttaaattttgtaaagacatcctcatttatctagtagagtttattatttattcgtttaaagaaaatgatttcaaaataattaaaatgagaaatttctagtaaattgtggttggcttgcttggcagtggtgtccggttccatcacgacccttagtagattttggatcgtgacaacatggtatcagagaactcgattcccttaggtctcacgagtcatgatcaagtctagtagagtctcgcggatcagtatggagacgtctgcacttatcttcgggagactacaatgctgttaggagtacttcgcttcttgattcctcatcgtgcgatttgattcattgaggcttgtgccttgtttccttcctactcaatcttacgtgatgcgaaccgcttgttataaatcgagaatcgaagaattttaatggtacaacggatgtggtgcgagatgtttctccctgaatagttgattaggctattgtcgttgccttgtggaagggtatctcatcattttggcttagtaacagtattcctgagagctttgaggctattcacagattgctatgatgctcacgattggttatcgcatagtattgaattgatggtaggatatttgcctatatgttggggcggtgaatgatttgaaaggaagcctactcagtgcatgattcagagataagatatctcatttccggcggaggaaaagcaattggcctatgaatgtccaaatttggggtgatggagtaacgagacttggtaatttcgagcgtgttagaatttttatctacgatgtagtgttgtcgtcctcgattgtatatgttaagttttccggtgttatggtcttctgcaattcgcccttggggaaggatattgtgaaataatattggagaaacgactattagatatcgcggggtgcggtggctcaggattgaatcagtgtttctaatgctgacggctcgagaaagatgatctccggaaaggtttaaagttagtagcgatttgtgggttcaagttctacgaagatagattttgttgaggcaacatctgagcagcaaaggatgaggaaggacatgtggggagtgttaggcggtggttaaaatttctaaaacgccaggtataagaagcaaaggtcgagttgtcgattaaaggggtgagatccgccaaagtgggagagtggcagagttgcataggggcttggtggtaggatgaccgcacaccttaagaagagtgtggaatgatttgggaattttagagattgaagattagggactacgaatttaattgggagtgtgggatattatgcagcaagagatttgatataacggaagggatctgcttgaaatgaagaaggatacaacataactttgaattggaaggatgctgccgcatatttaattaatgtctaggaggggtgaatagacttgtgcaactagagagtgatctcggaattaggatgggttatttatgtcgtagtgattgtaccccgtgcagtagcattggaagatgtcgggaagtgatttccatgggtgtgttattcactgtgagtaggttagcggtcacgtggttggcaaagcttctacgaaggattttactggccattcgggtaagaggtcgaatatgtgcatgttgatggaaattcagggtgttcatgaagtgctaatggaaggatttcaaggaatctagcagtttaattgcgcgaggtcatgtcactaagagataaagaatcttggtgaattccagaggtgtgtaatagtggcttcaagctaagtgagagtgtcccactatctacggttggattgcatggtcttctatttgtaaggtttaggattaccagcatattggtgagttatttcagctaagggaaagagcataagtagtaatttgagtgaaggaattgttaaaggtgtgctatagttggccttattggctcatgctcgggctttgggagtatttgggatttatgcttcatacagagctgatttaaaagcgaagtgattaagtcaggtgcttcgtggagatgggtgttcatgtgaataacggtcttaggggattcaaaggttaaagtgtggtgcctaaggatttctagtccataagtatggttaagaatcaagcttttgtaaaagattatgataagaggcttggaatgttctatgatattttcaacttgcagtgtggcattgggaggaaatgagaaaaagacttcggattcgtagaggaattatcaaaacggttgtatcagttgaagatgcgaatgtgcatgcaaggagggtgtgaaacggttcatgggtttggagataatatggtctcgtggaatggggttactcaagatgagtgcagatttaggttggtgatgtaaggaatgaagctattattatctctaaggcaaattaaggaataattagaagaagttagattgattagccatggttgaattggcataatggtgtcggagatcagttccttcagcgtgattaagttatgcatgtgatttgtggcggtacatgcgaggtttgacggccaccgtaattgattttatttggaagtattcaagtattatggccttgttatgtgtaggcggatcccggaaggttcatgtagaccactacttgaggatttgaatgttctacggttatgagaattcactcgcgtgtagctatggttctcttggaatgagttaggtaaaaagtttctatgtgatgaagtttttaccctaatagtggttcaggagttatgatgaaattcttgtattatcgcatattggcttgttaggtgcagtgagcggtatgaaatttgaaagtgaggataaagtttgcggttctgtatttgacaaggatgtcacgagctcggatgagcaagaagggggtttggatatttggagtaagctgttattgtcttcagcattacctaagatcggtattttgtgtcggaggcttacattttggttacggattcttgatatgctttacaatattagtgtgaccgatggtatagatgtgcaaactctttatctaatgcgaacggtcgtgggagcgtatctcatgggaagattgtataagtgtgacatgtagtcacttgattgattaaatatttaaaccaagtacgaaaatcgtggtaatatcactaatttgagaatttatgcctagaggacactcgacttattgggttatggattgtggaggattgccccggttatgatggtagttcgcatgtgttatgagaaaaagggagttattatgaaccttcgaaatgttattagactagttcagtttgatcagaatcaacttgaggtctgtggatggatttaaatgtgaatatgggctatatatcaggccaaatgtgttcatttcagcaatgcactcctttggacaagtagtcggggtactattttgtcgtcagctatttcatgaaatgatatatggctctgtatgagttgtaagacggcttggtgaatttcttatgtgttgaggttccgcgtagagatgatgttataggagcaggatgtctctcgagatttagatcgtatatggcacctcaattgtgcttgagttttatagcctatggcactatatgtctccccaaggatggtattatgcaattagtgtgcttgtgatcgatattcggtattttgttgtaatgagcaatttagctcgatgtatatctccttatgtgaattctatgtgttgatcgggtgtggtgctgccataggtatgttatttggatcgggttgcatgccgcaatagtgtgatgttgagtacatttttctatatgctatttttgtatgccttgtttcccattttcttaaggaaagtccatattagtacgtgagttgagtagttccttccagatttcgttttccttttgtcatgttcgagttcatagcctattgacatattgtggcattatatgagacttttgatcatgtccggagtggcttattgcctgagtagttcgtactgggtgagacaagatcattggatttaggatcagtgaaatctgattatatgaagtatattaaggagctaagatcattatttggttcagaatgaggtgatggttcttgtcaggagtatagacctaatgatttgttgattcggcagttggttatgaatttatacacatctcttccgtcgtggcggtattgtaagagttagagaaagacctatgtatgtcatgaggtgcaatgggagcatcaggttcgtggaatttcgattattatgcttagagaatgttattgtggttctgtgaataaagcagtgcaaggtgtgaatccagcaaaggtatgtagtcatattctggtacatcgtgcgtgatttatacggttagcgtatgctggaaataagcttggcagagaattctggatgttggaattgggctctaaggcttatttgtctaagtgaaaaagggtatcttcggattgatcgagctagggtgcctagctgagttgtggtagcacgagtaggtgcttgaggtgttacgcagtgattttgggcaaccccaatgtagttcttagcatgtttgaggacgaacgtatgtttaagtatgaaagaatgtaacgacccgaccggtcattttaagctctagtgcgtcgttcagcagtttgaggccataagtagcttcacttcaggtattgtgacttgtgcgcacggtcagaattgatttctggaaagttcggagttaatttggaaagataattctcatttccaaagctttatgttgaaagacttagccaagattggatttttgagtaaacgacctctgcattggtatttgaaggttccagcaggttcgtatgatgatttcggactccggcgtatgtccggatcgagttttggatgacccaagagcgatttggcgactattgtggaagttagcattttggaagaatttcataagtttgggttgaagtgcatttcgatgtaatagatgaccatttgggattcttagtctgggagtagctccgtatggtgattctggagttgggagcgcgatcggaagtgaattcaaaggtccgtgggtcattttggagtcatttggctaaagatagaaatttgaaggttcttgagaagtttgaccggaagtggactttttcgtatcgcggtcggaatccattttcgaaagcttgagtaggtccgtaatgtcgaatatgacttgtgcgcaaaatttgaagtcaatcggacgtgatttggtaggtttaaacatcgaaagtagaagtttgaaattctaaagttcataaagcttggattggaggtcgattcatatttttagcatggtttgatatgatttgatgcctcgagcaatccataatgtgttttgggactggtcggtatgattggttggggtcccgggggcctcaggtggattctcggtggttaatggagagaaaatggaatttggagaagtgctgaagcatctgcttctatcataacagcacctgcggttggtcgaccacaggtgcgagacagcagaagcggtcgtagcctcgcagatgtggcccagagctggccaggccaaaccatagaagctgctccttaggtgcagaagtggcttcgcagatgcatcttcaagaccgcagaagcggtcccaacccttttagccaattccgtagatgcggcctcccttcacagttgcggtcccctaaccgcagatgcgaaaaccgcagaagtagtcagcttcatttaagtcgaaccccagccatttttgaccatttggcactcgggtattgagcgattttggagctcttgagaaagtatttcacatagcattgtgaggtaagttcatcccccttatctctaagtttaacactcgagttttgctagattaacacctaaagatttggagaaatcaaggggttagagctagacctagggttttaataaaacatagattttaccacaaaatttgttatgaaatggattagaaatcatatattattgatccttgggttatagagaacaacttccttggaaaaatttcggaatccgggcatgtgggcccggggatgaactttaggaaccttgcatttagggttgggaaattggtttaataattacactatgaacatttgagcatgtattgactagttcttaccctatttgaatagttttggatcactcggctccaaattcgaggtttgtgcgcgttcttgagtcggaatataggcttcggagcgaggtgagtctcctttctaaccttgtaagagggaattgtccccataggtgatataattggttatgtactcctatttgtgggggctacgtatgcacgaggtgacgagagtccatgcgtagctactattatgtttaagtccgtgtagtctaggacccaaaagcatgctatacttggactatttgtaatcttaatgacagctgaattgcttaaatcacatcgaattagtaaatgaatttctaaaagaatttaatcttcattttcttaaattgttaaaagagaattggcttttctttggataattgttccatgttgacttcttgattgactgtttgtgtgtgtttacctttggaacaggccgaacgcctcggtagattaaaaagatgcatctattgttcgtgtcgttcgaccctcggcagtgcacagtttaaatattggttgattgcgccgtacgacctcggcatgatatgcgcatgcttgtatgacttgcctgagaatgttatgtgataatatttgccttccttggccagacatagttgataagcataatgaaaagtaaaccttggaaatccgtatttatttgagatgttgtttacctgctatctggttttacgagtttataattgctttataaaaatccatgatttcctcacattttcactatattattattggaccactaggaaatgtcaaagtcgacctctcgtctctacttcttcgagattagacgggatactcattaggtacacgttgttttcgtactcatactacacttgctgtgcatttttgttgcacacgcacatgcatctctagtggcctagtgggcgtagcggcacgattgatacggatacctagctgagttgcacttcctgagacgacccgcagccagtaatgtctctttcaaattactgtatttactttttgtccaatattgtattttggacggttgttgtactacattatttcctagaaattgctcatgtacttgtgacatcgggttcagggatgatcacgggatttttcagtagttaaattttgtaaagacatcctcatttatccaacgaagtttattatttattatttatttgtttaaaggaaatgatttcaaaataattaaaatgagaaattgctagtaaattgtggttggcttgccagacagtggtgtccagcgccatcatgacccttagtggattttgggtcgtgacaaaaatggaggaaaatggccaagacccgcgatttttaaagaaccttactgcttccagcaattccgcaccttcggtcatacgactgcttctgcagtttcacaggtgcggaccctctaccactcctgcggtttctctctgggctcccctttgcacttctacgcctcgattcccgtagttgcggtcacgcctctatggcgagatgaccgcatatgcggtccttatacttccatccaaaaatcgcatatacgactctcctagccacttatgcggctctgcacctgcggcccaagcctcgcaggtgcggttacaccagaagacagctgctacacttcctcttccaatttgaaaaattgatctgttaatcattcggaatccacccgaggcccccggaaccccaaccaatcataccaaccagtcctaaaatacattatggactttctcgaggcctcaaatcataccaaacaacgctaaaatcatgaatcgacccccaatccaagctaaaggaactttagaatttcaaacttctacattcgatgacgaaacttatcaaatcatgtccgattgacctcaaattttgaacacaagtcatatttggcattacggacctactccaacttccgaaattggattctgaccccgatatcaaaaagtccacttctggtcaaacttctcaaaaaccttcaaatttctatatttagccaaatgacaccaaaatgacctacggacctccgaattcacttccgatcgcgcccccaataccagaatcaccatacgaagctattcccgaactcagaatctcaaacggacattgataaccctgaaattcacttcaatctaaacttatgagattcttccaaaaatgctaacttccacaataggcgccgaaacgttcccgggtcttgcaaaacccagtccggacatacgcccaagtccgaaatcatcatatgaatcagctggaaccttcgaatcccgattccgaggtcgtttactgaaaaatcctaccttagtcaattctttcaacttaaagctttcgaaatgagaattctctttctaaatcaactctgaacttcccgcaattcaattccaaccgtgcgcacaagtcatagtacctgaagtgaagctgctcatggcctcaaactgctgaacgacgcgctagagctcaaaacaaccggtcaggtcgttacattctctcccacttaaacatacgttcgtcctcgaacatgctaagaactacgctggggttgcccaaaatcactgtttaacacctcgagcacctaccagttctaccacaactcagctgggcaacctagctcgatcaatcttaagataccctttatcacttaggcaaataagccttagagcccaattccaacatctgaaattcactaccaggcctgttccaacatacgcttaccgaatcaataactacacgcagcaccaaaacatgactgcataccttagctgaattcacaccttgcaccattttactcacaggaccacaataacattctctgatcaaattatttgaaattccacgaatttgatgctcctattgcacctcatgacattcaaaggtcttgctctaactcttacaatacttccgcgatggaagagatgtgtagaaattcataaccaattgctaaatctacaaatcattgggtctatactcctaacaagaaccatcatctcattctgaaccaaataatggtcttagctccttaatatacttcatataattagattgcactaatcctaaatccaatgatctcgtctcacccagtacgaaatgctctggaaataagccaccccgtcgtgaccaaaagtctcatataatgccacaatgtgacaatgggctaccagctcgaacgcgatacaaaaggaaagtgaactctgaaaaggaaatccaattaccccgctcgcaactaatacatgcgacgtggtcaacataattaaacaaacaccccgctcgcgaatcatacatgcgacacaggcacacaactaataagagttttcctcagaaagataggaatcaaaacacataaaaacagatatagaaatttgtactcaatatcacactgttgcggcgtgcaacccgatccaaacaacatacccatggtggcgtgccacccaatccacccataaaattcacataaggagatacataccaagccagattgctcattacaacaaaatactgaatgtcggtcacaagcacgctaagtgcattataccatccataaggagacatatagcgctataagctaaaaactcaagcacaactgaggtgtgatatacgatctaaatctcaagagccattctgctcatataacattatctctacgcggaacctcaacacataagaaattcaccaagctgtctcacaacttcacacgtcacaatatatcattacatgaaatagctgacgacaaaataatacccagactactcatccataaggagcgcattgatgaaatgaatacatctggcctgatataaaacccatattcacatttaaatgcatccacaaacctcaagttgattctgatcacgctgaactaagctaataacctttcaaaggtccataataactacccttatctcatatcacacaagaacaaccatcataaccggagtaatcctccacagtccacaacccaataaaccgagtgcccttcaggaattagttctcaaattaacgacatcaccacaatctttatactttgtttaactcttcaatcaatcaagtgactatatgccacacttatacaaccttcccgtggggcacgctcccacaaccttctgtaacagataacaggcttgtgcattcaaaccaatggttgcactaacgctaaagagcgatcaataatccttaaccaggatgcaaagcatctttcacaaaacaccgatctccagtgacgctgaggacattactagcttactttgaacatcccaactcctttcctgctcatccgagctcgtgacatccttgtcaacaccgaactacaaccttgatcctcacttcaaattccataccactcactacacccaacatgccaatatacgatagaacacgatttttcatcataacttcagaaccactaataaattaacactacatcatataaaaactttttacttaactcatttcaggagaaccatcacaacacgcaggtgaattctcataaccgtagaatatgcaaatctccaagtagtggtctaaaccaccctaacccctccgggatcctcctatacataacaatgctataacactcgaatacttccaaataaaatcaattacggcggccgtcaagccttacacgtaccgccacaaatcacatgcataacttaatcacgctgaagaaacagatcaccaccaccattatgctaattcaaccatagccaacaaatctaacttcttctaattcatccttaacttgattagagataataatagctctattccttacattaccaatccaaatctacactcatcttgagtaactccattctacgaggccacattgtctccaaacccatgaaccatctcataacttccttgtgcacatattcacatcctcaactggtatgcccattctgataatccctctacgaatccgaagtcttttctcattttcctcccaaatgtcacactacaagtgaaaacatcatagaacgttctgggcctcttctcataagtttctacaaaagcttgcttcttaaccgtacctataggctcgcaatcattaggcaccacactttacccttttgaatccactaggaccgttgttgagagccacccgctctaacttggccccgaatataatcaactccctgaatcttctagcacatcaataccctctcgacgaagcacccggcagaatcacttcctttaaagcctgcatctataaaaggcataaatccagaatccttccccgcgtctgaacgtgagccaataagtccaaccatagaacacctttaacaattcatttgctcaaatctcctcttatgttactctctcttagctaaaataacccactaatatgctaataaccagaaatctcacatatggacgactatgaaatccaaccataggcgttgggactctcccacatagcttgaatccactatcacacaactctggaattctctaggattcattatctcttattgacataaccttgcgcaatcaaccgccaaaattcaaggaatctttctataaaacccctttttatactctgaatcatcaaccacattcgcacgaccaaattttttgttgtataaccaatagaattctttgcaaaatcttcaccaaccatgcgatcgccaatctgctcactatagataccgcacctatggaatttacgtgccgacatcttccaatgctgctacacgagatacaatcactacgacatccataacccatcctgagtctgagctcactctctagctacacacccttcgtggtcatcaattaaatgtgcggcaacattcatcaaattcaaagttatgttgtatccttcttcattttgagcagctcctttccgttatattaaatctcctgtcgcataatagcccatacttcaatttaaatccgtagaccccgatcaccaatcagtaaaattcccaaatcattccaaactctccttaaggtgcgtagtcatcctaccacaaagcccacaagcaactccgccactctcccactttggcggaactcacacctttaatcgactactcgacctttgcttcttataactggccttctagaaattttaaccaccacctgacacacttcccacatgtcctttctcatccttcgctgctcagttgttgccttaaataatgtctatcttcgcagcacttgaaccctcaaatcgctactaaccttaaactttttcgaagaaaatctttctcgagccatcaacattagaaacacagattcgatctgaaccactgcaccccgcgatatctaacagttgtttctcccatatcatttcataatatcttaccccaaaggtgaatcgtagaagaccataacactggcgaactaaacacatacaatcaaggacgacgacactacatcgcaggtgaaaattccaccacgctcgaaaataccaagtctcgttactccattactccaaatctggacatttataggccaattgcttttcccttgcttggcataaaataccgaacctctagatcatgcactgagtaaacctctcttcaattcatttactgccatgacaagtagacaaacattctaccatcatatcaatactacggaacaattgttaataagtatcatggaaacttgtgcctagcctcagagctctcagaagcactgccactgggctgaaataatagaatatccttccacaaggggatgatattagctcaaacaaccctgcagggagaaacaccctgcgccacactcgtagcactattacaatccttaaattctcgatttgaccagcggtttgcgtcgcgtaacattgagtatgaaggaaacaagagcataagcctcaaagaatcaaatcgcatgatgagtaatcaagaagggaagttctcctaacagccctgtagtctcccgaagatatgtacagacgtctccgtaccaatccgcgagactctactagacttgctcatgacttgtgagacctaagagaacttagtgctctgataccatgttgtcacgacccaaaatccattaagagtcatgatggcaccggacaccgctgtcaggaaagccaactaaaatacttaattaaattctcgtttaaatattttccgaaaatacttctttaacacgtgtaaaacaatacatcgtaaattcctttaaataaataataaaatgtttaacaactcttaaaatttcctgaataaacccaaagacatcccagaacccggtgtcacaagtacatgagcaatttttaagaaataatttactacaacaaccgttcggaatacaatattggacagaaaataaatacagaaaactaaaagagactctgctggctgcgggtcgcctcgagaagtgcagcttacctaagtctccatgtcaaccatcctgtcatgctcagtaggccactagagacgcatgtgcctatgcaacaaaaatgcacagaagtataatatgagtatgaaaacaacgtgtacccaatgagtatcccgtctaatctcgaagaattagagatgagatggttgacttcgacacttactaattgtccaaataatgatatataattaatgcaaataatcatggatttattaagaatgatagaaatttaaagtatgtcacgaacaggtgaaagttcctttttatattaaaagtctccggattcaaaatccattagtttttaaatatctcaagtcggggagagcaaatatcaatatcaataagtctcaaggaaaacactacaagcatgcgcaaatcttgccaaggtcgtatgacccgatccaacagaaatgtaaaatgtgcactgccgagggtcgaatggcgtgaaccatagacgcatctattaccccgctcgcgcatcatacctgcgatgcggtcaacataaataaacaaataccctgctcgtgattcctacatgcgatgcatgtacacatagaaatacatgctcaagcagtcaattaagaatatataacatttatccaaataaaagtcagttctcttttaacaatttaagaaaatgaagtttattccttttagaaattcacttactaattcgatgtgatttaagcaattcataccgtcaataggattacaaatttttccaggtaaatcatgcttttgggtcctagactacccggacaatagcatgatagtaggtaaacacagactctcgtcacctcatgcgtacgtagcccccacaaataggagcacgtaaccaattatttcacctatggggacaattccttcttacaaggttagaaaggagactcaccttgctccgaagatccataacctgcattctacgctcttctgaagactcgaattgatgcacaatgctccaaaactagccaataattatgcatatccattaaaatatgttcaattactcattacaatccaattcataacaattcctaaccccgatcgaaaagttgacaaatgaccacgtgcccggattcctaaatggttcgaagataaactttacccatatccccacgaactcaaatatataatttactctcaatttcatacccaaaatcgtggtcaaattccatgaatatcaattttctagattttccctcaaaccccgaaatttctaccaatttacatgctaaaatccatacataattaaaatatatttaagtcaagaaaggtggggttatcttaccttaacgttgatgaagaaaatcccctcttgaaactctccaaaaatcgcccaagccaagaaaatatgaggaaaatggccaaaaccccgattttaaaacatcctctacctccagcactttccgcacatgcggtctcttgacttctttagcggttccgcaggtgcggttcaaataccgcttctgcggttcctcactaagctgccctttttcgcttttgcatcttctccaccgctggtgcggtcccgcatctgcggtcctagctctcatcagccaatgcatttgcggctcttctggatgcttttgcggctttgcacctgcggcccatttctcgcaggtgtggttatgacagcaacctcagccttccaaaaattccgtctttaatccgttaaccacccataatccacctgaggccctcgggaccccaaccaatcatactaactagtcccaaaacacgtgacggactcgctcgaggcctcaaatcatatcaaatagtgctaaaaccatgaatcgacctccaatccaagctttatgaactttagaacttcaaacttctactctcgatgtttaaacctataaaatcacgtccgattgaccccaaattttgcacacaagtcacatttggcattgcggacctactccaactctggaatcggattccgaccccgatattaaaaagtctacttccggtcaaacttctcaaaaaccttcaaatttctatctttagccaaatgactttaaaatgacctacatacctccaaattcaattccgatcgcgctcccaactccagaatcaccatacggagctactcccagactcagaatcccaagcggacaccgataacactgaaattcacttcaagacaaacttatgaaatttctttcaaattgttaacttccaaaatatgcgtcaaaacgctcccgggtcatccaaaccccgatccgggcatacgcccaagtatgaaatcatcatacaaacttgctggaacctttagatcccgattctaaggttgtttactcttaaatccaatcttagttaattcttccaacttaaagcttccgaaatgagaattctctttccaaatcaactccggacttcctggaattcaattccgactacgtgaaaaaatcataatacctgaagtgaagctgctcatggcctcaaactactgaatggcgtactataactcaaaacgatcggtcgggtcgttacaattcatccggccgccgcgaagatgtattaggatttgcggtagcattattggtggagaaggatgaagaaggatattgttgcatatgtatctaggtgtttgaattgttagcaggttaagtatgagcatcagaggcctggtggtttgtttaagaggattgagcttcccaagtagaagtgggagtggatcattatggatttcattgttggactcccatagactcggagcaagttcgatatagtctaagttattattgaatggctaaccaagtcatcgcatttcattcctgtggtagtctcctatttttccaagaggttagctgagatctatatccgagagattgttcgtcttcatggtgtgcccgtgtctatcatttcggatcgaggtacgcagtttacctcacatttctggagggcagtttagcgagagttaggcatacaggttgagttgaccatagcatttcatccttagacggatgggcagtccgagcgtgctattcagattttggaggatatgctccaagcttgtgtcattgactttggaggctcgtgggatcagtttttgcctttagcagagtttgcctacaacaacaactaccagtcaagtatctagatggctccttgtgaggctttgtatggtaggtggtgtcggtcaccggttggatggtttgagtcgggagaggctcggttgttgggtacggatctagtacaggatgccttggacaaggtcaggatcattcaggataggattcgtacagctcagtccaggcaaaagtgttatgccgaccgtaaggttcgtgatttggcattcatggtctgtgagcaggtattgcttcgggtgtcgcctatgaagggcgtgatgagatttgggaagaggggcaagcttagcctaggtttattggcccgtttgagattcttgatggagtgggggaggtggcttacagacttgcattgccgccgaacttatcagccgtgcatccagtgtttcatgtgtccatgctttggaagtatcacggcaatccatcccatttgttagacttcagcactgtccagttggacaaggacttgtcctatgaggaggagctggtaactattctagaccggcaggttcatcagttgagattgaagagtttcccttctgttcttgttcagtggagaggtcatccagatgaggcatcgacctgggagtccgagtcctatatatggatctattatccccatcttatccccgactcaggtactttcttcatatattcgttcgaggacaaacgattgttttagagggggagaatgtgataacccaaaaagtcatcacctgttttagaaataaactctgtgtctcgaggccttaaaaaccactttctatctcacctcgacttacgtgcgtggtctggatctatatccggaagccttctttgtgaaaatatgagaaatagaaatttctagagttaaaatttgattatggttgactttggtaaacattttgagcaaacggacccggatgcatgttccgacgatcctgggaggtccgtagtaaaatatgggacttgggtgtatgcccgaaaatgaattccgaggtcccacaccttagaaattaatttttgaaagaaactatttactgaattatctaagaaatgaagaaaagaattaatatttgaaaccattggtattgggcccgtattttggttttggagcccggtacaaacttgatatagtatttaaaagataactgtgatatttggtgaaaaacggagtttatttgacgtgagttggacttccggttgaagagttatgaactttgagtgtttttgatgaaaaaagttgagttttgaggtttaattcatggtttgcatgttattttgatgatgtgatcgcacgagtaggtccatatgatgtttttgagttagtatgcatgtttggtttgaagtcccgaggtctcgggtgagttttgggtaggttccaagatgttttaggcttaaaacatagctgttgcaggtttagagaagttgcagatctcagaacccgccagtgtggtccgcaatgtttttgttctgccgcggaagggcctttgcggccacaaaggattttgtgctgaccgcggtggcgggctttgcagccgcactcgattttgtgcggtccgcggtgaggaagaatctgcaggttatctggtctgatttcggaagcccatatcttttgatctacaaggaattttgagatgattcataaacgaaagttgtatcccttcgtgtccagtttccaaggtatatttaaacgggattttcagttatttttcatttttcaaaactccaaaaacataagaggcaatttttcaaacaacctttcttctccaaaatattagtaagtgatttctaactcattttctttactccttgacgtctttttacaagatctcatcctagaatcaatggtttttatgggcgaaattgggtgttttgggtagaacctaggtttttcaaattttggggatttggacctcgatttgaggtctgatttcaaaccaaattatatatttgggttcgcgggggaatagataatcgggttttggtttgaacctcgggttttaaccatgtgggcatgggggcgatttttgactttctggagaaaactttagaaaacttatttccatgcattagaatttactcaattagtatttattgatgtaataaagtaacttgtggctagatacgagcgaattggtggtggaatcaagaggtaaagtgatagttgagacttgaagtgtgttcgtggcatcgaggtaaatatttggtctaaccttagcttgagggattaggagtcgagtcctatgtgctatgtgatatttgttgagtacgacgtataggcatggcgacaagtgtctatgcattggtgtcaagcatgcccctgggtcttgtattatgattattatgactccgtttctattattcatgccttttatgatgatttctattgttgagtagagtttgtggaggaaatagtggtatttgagtatgaagagcgttggctcaagtggtacaatgaatttgtggaagtataattggcatttgaactttatagatcattggctcaagtcgtgaagtgagttgtgaattaaaattcaaaaaaaaaagagaattattatattgtctcccttgccgggatattgttgcttttaatgctatctccctttccggaatgttgatgcttttgaaactgttcccttgtcgggatttgattgttgaactattattcccttgtcaggatttcatttcaatcttacttatttcattgccttattgtttgtgattgttgtttgggtgaggaagagtgtttaagcacgaagggtgataccatgtataattttgtaaggaagagtgtaaatcacgaagggtgatgctgtgccacacgatgtacaattccgtgccaattatattgattatatggtgaggacgagagtaaaagcacgaagggtgatgccgtgaaatttatattgattcttttgatgaggacgagagtaaaagcacgaagggtgataacgtgcacttgtttgatccctgattcttgctgataattgagatagggtgttccttgtatttaactgctgtctttctattcttaattaatgtttccccgtagcatgttaccccctcccatacttaactgtacattgctgttcttcttttccgctgtatatgatttaactacacgggtttatttggtagtctggtcttagcctcgtcactacttcgccgaggttaggctaggcacttactagcacatggggtcagttgtgatgatactacactctgcactgtgtgcagattccggagcagcaacattcagaccttatcttgggtggttgccttcagtccagttagagatttcgaggtagtcctgcaggcgtctccctttatcccttcatcctgtttcatatacttatttcagaaacagtgtattagctatctttcaaaccttgtttgtaaattctagactgtctataaagcctgacaccaattctgggtagattttgcttaagatgttgtatcgtatatttaatcaaatgttttatcgttttcttccgctcgctttaaatttccattgtttataactgtcgattcacacttgttaaagaaattaaaaatgggaaaatggtaattggtgtaagtggtccgcttgcctagcttttactagtacgcgccatcacgacccccgagggtgaaaaatccgggtcgcgacaaaatttgttatcatcttttattttttgtttttagatctttctaacattttttttcaatatttattttattttatcttattttctgatgtcattatttctttttttacaaaaaaaaataatttatttcactaaaaaaggatgagttttaataaaaattgtctacataaactttaataaatatttttagtctttggttgaaattatttcatatttttctgttggctttatctgatcagcctaaataggtgttatcggtatatcatctatttatattagctataaaaagtaaacaataaatatggtcggaaatcatgtaaatattccataagatttcatttttttgagtttatccatgatataacttctattataataattttaaaactctctactaatgttcaaaaatatcttatctttttattatctttgaaataaaaaaaataaagagttttttcgaaataatttgtttacatttaaaaaaaatcacgttatatcaatttttgttttatatatactctttgttacacttaaaaacctctataaaaactatcaattagaaaccaatttctctcttgttgagtttgaaaaaaaaaacctttcacataatctaatgattcaaaactaatattcttcaacgaaaaaatattatacccttacaatattggcctgactatagctaaatgaaggggtttcatcttatacccttcaattccttgaatgtgctaaattgaaattaatgatagcaaatgtatagacaaaattttgttatttatgtctatttatgcaaattgactcttcaaataaatattcttcaagaaatttttttttaatattgattgattttgtgatgtttctttctccagtatgtatgtttactttataatatatgtaagtgtcacgacccaaattccattacgagtcgtgatggcaccagatactgctgtcaggcaagccaaccaatacttaattaaattctcgttttaataattttgaaaactatgattttccttcaattttaccactaaaagataatcgtttcaaatcaagtatgaatgttaagaagttaatacaagatacccataatcatcctagaacccggtgtcacaagagcatgagcatttactagggaatggaataaaatacagtaactgtccggaatacaaagtgggcagaaatgaaaaacacagaaaaatactctgaaggggactctgccgggtcgtctcgataaatgcagctcacctaagtctctgtatcaaccatgccgctatgccactaagccactagccacatatgaacctgtgcaacaacaatgcatagcaagtgtagtatgagtacgaatacaacatatacccaatgagtatcccgtctaatctcgaagaagtagagacgagaggtcaacttcgacacttactaatggtccaatgataatatagcaaaagtgtgaggaactcatggatttcataaagcaaaatttaattcataaggccggaaagtaggtaaagaacttctcaattaataaaaggtttcgaaggatttacttttcattatctttattaatttatgtctgccaaggaagggcaattatcaacatttaaaattctctggcaagcaatacaagcatgcgcatatcatgccaaggtcatattgcccgatccaacataaatgtaaaatgtgcaatgcggagggtcgaacggcatgaaccctagatgaatctattatcccgctcgtgagtcatacatgcgatgcggtcaaatttaaataaacaatcaccttgctcgcgaatcatacatgtgatgcacgtacacatagacttacatgctcaaacaaccaattaagaatttatcggggaaagtttatccaaataaaaccaattctcttttagcgatttaagaaaatgaagtttaatctttttttaaaaaattcatttaccgatttgataggatttaagcaattcaactgccaacaaaattacagatattcctagtatagcatgcttttgggttctagactacccagacttatatataatagtagcaacgcacagactctcgtcacctcgtgcgtgcgtagccccccacaaatagaagcacataaccaattattacacccatggggacaattctctcttaaaaagttagaaaggagactcacttcgctccaaagatccacaaccggcattccacgcccttccggagactcgaatcgatgctaaatgctccaaactaaccaacaattatgcaaatccattagtatatgctcaattactcattccaatcaaatttataaaaattcccaatcccgatcgaaaagttgacaaaatttccatcgggcccacatgcccggattttaaaatttctcaaagataaagtttacccatgaactcacgaactgaaatatatgattttctcctaatatcatacccaaaatagtggtcaaaatccaagaatatcaattttctaggttttcccttaaccccaagtttctaccaattttcttgctcaaatccctaacaaaaccatgtatttaactcacaaggggtgaaattctcatgtttgatgataaaatccctctctcgaagatctccaaaaatcgcccaaacaagagtaaaattataacgacccgaccagtcgttttgagctctaatgcgttgttcagcagtttgaggccatgagcagcttcacttcaggtattatgacttgtgcgcacggtcgaaattgatttttgggaagttcggagttgatttggaatgtgaattctcatttcagatgttttaagttgaaacaattagctaatattggatttttgagtaaatgaccccgaaattgggattcaaaggtttcagcaggttcctatgatgattcggacttcagcgtatgcccggatcgggttttgtatgacccgggagcgatttggcgcctattgtggaagttagcattttggaagaatttcataagtttgggttgaagtgcatttcggtgtaatcgatgtccgtttgggatttcgagtatgagagtagctccatatgatgattctggagttgggagcgcgatcggaagtgaattcggaggtccgcgggtcatttttgagacatttggctaaagatagaaattttaaggttcttgagaagtttgaccgaaagtggacctttttgatatcggtgtcgaaattcgattccgaaagttggagtaggtttgtaatgtcgaatatgacttgtgtacaaaatttgaagtcaatcggatgtgatttgataggtttaaatattgaaagtatatgtttgaaattctaaagttcataaagcttggattggtggtcgattcgtggttttagcatggtttgatatgatttgaggcctcgagcaagtccataatgtgttttggactggttggtatgattggttggggtcttgggggcctcaagtggattccgtgtggttaacggaacgaaaatggaatttggagaagtgttgaagcatctgcttctttcataaccgcgcctatggttggtcaaccgtaggtgagagaccgcagaagcagtcgtagcctcgtagatgttgcccagagctggccaggccaaaccgcagaagcggctccttagcagcagaagtggcttcatgaccgcagaagtggtcccagcccttttagccaattccgcaaatgcggtcccctaaccgcagatgcggaaactgctgaagcagtcaacttcatttaagtcgagccaaccaattttgaccatttggcactcgggtattgagagattttggagcttttgagaagggatttccacatagcattgtgaggtaagttcatcccccttatctctaagtttgacactcgagtttttggtagattaactcctaaagatttggagaaatcaaggggttagagctagacatagggttttaataaaacttagattttaccacgaaattggttataaaatagattagaaatcatatattattgatccttaggaaccttgcgattagggttgggaaattggtttaaaaattataatatgaatttttgagcatttattggctagttattaccttatttgaatagttttggattgttcggctccaaattggaggtttgagcgcgttctttagtcggaatataggcttcagagcgaggtgagtcttctttctaaccttgtaagagggaattgtccccataggtgatataattggttatgtgctcctatttgtgggggctacgtacgcacgagatgacgagagtccatgcgtagctactattatgtttaagtccaggtagtctaggacccaaaaacatgttatacttggagtatttgtaatcttattgacaactgaattgcttaaatcacatcgaattagtaaacaaatttctaaaaggatttaaacttcattttcttaaattgttaaaagagaattgtcttttctttggataattgttccatgttgatttcttgattgactgtctgtgtgtgtttatctttggaactgatcgaacgcctcggtagattaaatagatgcatatatggttcgtgttgttcgaccctcggcagtgcaccatttaaatattgttggatcgggttgtacgacctcgacatgatatgcacatgcttgtattgcttgcctgagaatgttatgtgataatatttgtcttccctggctcgacatagttgataagcataatgaaaagtaaatcttggaaatccgtatttatttgagaagttgtttacctgctatctggttttacgagtttataattcctttataaaaatccatgatttcctcacattttcactatattattattggaccactagtaaatgtcaaagtcgacctatcgtctctacttcttcgagattagacgggatactcattgagtacacgttgtttttgtagacatactacacttgctgtgcatttttgtagcacaggcacatgcaactctagtggcctagtaggcatagcgacatagttgatacggagactaaggtgagctgcacttcccgagatgacccacaaccagcagtgtctttttcaaattaccgtatttactttctgtccaatactatatttcgtacggttattgtactacattatttactataaattgctcatgtacttgtgacaccgggttctgggatgatcacgggatttttcagtagttaaattttgtaaagacatcctcatttatctagtagagtttattatttattatttatttgtttaaaggaaatgatttcaaaataattaaaatgagaaatttctagtaaattgtggttgtcttgcttgggagtggtgtccggttccatcacgacccttagtggattttggatcgtgacaacatggtatcagagaactcgattcccttaggtctcacgagtcatgatcaagtctagtagagtctcgcgaatcagtacggagacgtctgtacttatcttcgggagactacaacgctgttaggagtacttctcttcttgattcctcatcgtgcgatttgattcattgaggcttatgccttgtttccttcctactcaatattacgtgacgcgaactgcttgttataaatcgagaattgaagaattttaatggtacaacgaatgtggtacgagatgtttctccctgaatagttgattaggctattgtcgttgccttgtggaaggatatctcgtcattttggctcagtaacagtattcctgagagctttgaggctattcacagattgctatgatgctcacgattggttattgcatagtattgaattgatggtaggatatttgcctatgtgttggggcggtgaatgatttgaaaggaagcctactcagtgcatgattcagagattagatatctcatttcgggcagaggaaaagcaattggcctatgaatgtccaaatttggggtgatggagtaacgagacttggtaatttcgagcgtgttagaatttttatctacgatgtagtgttgtcgtcctcgattgtatatgttatgtttgccggtgttatggtcttctgcaattcgcccttggggaaagatattgtgaaataataatggagaaacgactattggatatcgcggggtgcggtggttcaggattgaaccagtgtttctaatgctgacggctcgagaaagatgatctccagaaaggtttaaagttagtagcgatttgtgggttcaagttctacgaagatagattttgttgaggcaacatctgagcagcaaaggatgaggaagaacatgtggggagtgttaggcggtggttaaaatttctaaaacgccaggtataagaagcaaaggtcgagttgtcgattaaaggggtgagatccgccaaagtgggagagtggcagagttgcataggggcttggtggtaggatgaccgcacactttaagaagagtttggaatgatttgggaattttagagattgaagattggggcctacgaatttaattgggagtgtgggatattatgcagcaagagatttgatataacggaagggatctgcttgaaatgaagaaggatacaacataacattgaattgaaaggatgctgccgcatatttaattaatgtccaggaggggtgaatagacttgtgcaactagagagtgagctcagaattaggatgggttatttatgtcgtagtgattgtaccccgtgcagcaacattggaagatgtcgggaagtgatttccatgggtgtgttattccctgtgagtaggttagcggtcacgtggttggcaaagcttctacgaaggattttactggccattcgggtaagaggtcgaatatgtgcatgttgatggaaatttagggtgttcatgaagggctaatggaaggatttcaaggaatctagcagtttaattgcgcgaggtcatgtcactaagagataaagaatcttggtgaattccagaggtgtgtaatagtggcttcaagctaagtgggagtgtcccactgtctacggttggattgcatggtcttctatttgtaaggtttaggattaccaacatattggtgagttatttcagctaagggaaagaacataagtattaatttgagtgaaggaattgttaaaggtgtgctatagttggccttattggctcatgttcgggctttgggaagatttggaatttatgcttcatacagagctgatttacaagggaagtgattcagtcaggtgcttcgtggagatgggtgttcatgtgaataacggtcttaggggattcaaaggttaaagtgtggtgcctaaggatttcgagtccataagtatggttaagaatcaagcttttgtaaaagattatgataagaggcttggaatgttctatgatattttcaacttgcagtgtggcattgggaggaaatgagaaaaagacttcggattcgtagaggaattatcaaaacggttgtatcagttaaagatgcgaatgtgcatgcaaggagggtatgaaacggttcatgggtttggagataatatggtctcgtggaatggggttactcaagatgagtgcagatttaggttggtgatgtaaggaatgaagctattattatctctaaggcaaattaaggaagaattagaagaagttagattgattagccatggttgaattggcataatggtgtcggtgatcagttccttcagcgtgattaagttatgcatgtgatttgtggcggtacatgcgaggtttgacggccgccataattgattttatttggaagtattcaagtattatggccttgttatgtgtaggcggatcccggaagggtcatggtggtttagaccactacttgaggatttgaatgttctacggttatgcgaattcactcgcgtgtagctatggttctcttggaatgagttaggtaaaaagtttctatgtgatgaagtttttaccctaatagtggttcaggagttatgatgaaatttttgtattatcgcatattggcttgttaggtgcagtgagcggtatgaaatttgaaagtgaggatcaagtttgcggttctgtatttgacaaggatgtcacgagctcggatgagcaagaagggggtttggatatttggagtaagctgttattgtcttcagcattacctaagatcggtattttgtgtcggaggcttacattttggttacggattcttgatatgctttacaatattagtgtgaccggtggtatagatgtgcaaactctttatctagtgcggaaggtcgtgggagcgtatctcatgggaagattgtataagtgtgacatgtagtcacttgattgattaaatatttaaaccaagtacgaaaatatgactaatttgagaatttatgcctagaggacactcgacttattgggttatggattgtggaggattgccccggttatgatggtagttcgcatgtgttatgagaaaaagggagttattatgaaccttcgaaaggttattagactagttcagtttgatcagaatcaacttgaggtctgtggatggatttaaatgtgaatatgggatatatatcaggccagatgtgctcatttcagaaatgcgctcctttggacaagtagtcggggtactatttcgtcgtcagctatttcatgaaatgatatatggcgctgtatgagttgtaagacggcttggtgaatttcttatgtgttgaggttccgcgtagagatgatgttataggagcaggatgtgtctcgagatttagatcgtatatggcacctcaattgttcttgagttttgtagcctatggcactatatgtctccccagggatggtattatgcaattagcatgcttgtgatcgatattcggtattttgttgtaatgagcaatttagatcgatgtatatctccttatgtgaattctatgtgttgatcgggtgtggcgctgccatgggtatgttatttggatcgggttgcatgccgcaatagtgtgatgttgagtacagttttctatatgctatttttgtatgccttgtttcccattttcttaaggaaagtccatattagtacgtgagttgagtaggtccttccagatttcgttttccttttgtcatgttcgagttcatagcctattgacatattgtggcatcatatgagacttttgatcatgtccggagtggcttattgcctgagtagttcgtactgggtgagacgagatcattggatttaggatcagtgaaatctgactatatgaagtatattaaatagctaagaccattatttggttcagaatgaggtgatggttcttgtcaggagtatagacctaatgatttgttgattcggcagttggttatgaatttatacacatctcttccgtcgtggcggtattgtaagagttagagaaagacctatgtatgtcatgaggtgcaatgggagcatcaggttcgtggaatttcgattattatgcttagagaatgttattgtggttctgtgaataaagcagtacaaggtgtgaatccagcaaaggtatgcagtcatattctggtacatcgtgcgtgatttatacagttagcgtatgctggaaataagcctggcagagaattctggattttggaattgggctctaaggcttatttgcctaagtgaaaaagggtatcttcggattgatcgagctagggtgcctagctaagttgtggtagcacgagtaggtgctcgaggtgttacgcagtgatttcgggcaaccccaatgtagttcttagcacgtttgaggacgaacgtatgtttaagtatgaaagaatgtaacgacccgaccggtcattttgagctatagtgcgtcgttcagcagtttgaagccataagcagcttcacttcaggtattgtgacttgtgcgcacggtcagaattgatttctgggaagttcggagttgatttggaaagataattctcattttcgaagctttaagttgaaagacttagccaagattggatttttgagtaaacaacctctacattggtatttgaaggttccagcaggttcgtatgatgatttcggactccggcgtatgtccggatcgagttttggatgacccaagagtgatttggcgattattgtggaagttagcattttggaagaatttcataagtttgggttgaagtgcatttcgatgtaatagatgaccatttgggattctgagtctgggagtagctccgtatggtgattctggagttgggagcgcgatcagaagtgaattcaaaggtccgtgggtcattttggagtcatttggctaaagatagaaatttgaaggttcttgagaagtttgaccggaagtggactttttagtatcgcggtcggaatccattttcaaaagcttgagtaggtccgtaatgtcgaatatgacttgtgcgcaaaatttgaagtcaatcggacgtgatttgataggtttaaacatcgaaagtagaagtttgaaattctaaagttcataaagcttagattggaggtcaattcatatttttagcgtggtttgatatgatttgatgcctcgagcaatcaataatgtgttttgggactggtcggtatgattggttggggtcccgggggcctcgggtggattctgggtggttaatggagagaaaatggaatttggagaagtgctgaagcatctgcttctatcataacagcacttggggttggtcgaccacaggtgcgagaccgcagaagcggtcgtagcctcgcagatgtggcccagagatggccaggccaaaccatagaagctgctccttagctgcagaagtggcttcgcagatgcgtcttcaagaccgcagaagcggtcccaaccattttagccaattccgtagatgcggcctcccttcacagttgcggtcccctaaccgcagatgcggaaactgcagaagtagtcagcttcatttaagtcgaaccccagctatttttgaccatttggcactcgggtattgagcgattttggagctcttgagaaagtatttcacatagcattgtgaggtaagttcatcccccttatctctaagtttaacactcgagttttgctagattaacaactaaagatttggagaaatcaaggggttagagctagacctagggttttaataaaacttagattttaccacaaaatttgttatgaaatggattagaaatcatatattattgatccttgggttatagagaacaacttccttggaaaaatttcggaatccgggcacgtgggcccggggatgaactttaggaaccttgcatttagggttgggaaattggtttaataattacactatgaacttttgagcatgtattgactagttcttaccctatttgaatagttttggatcactcggctccaaattcgaggtttgagcgcgttcttgagtcggaatataggcttcagagcgaagtgagtctcctttctaaccttgtaagagggaattgtccacataggtgataataattggttatgtactcctatttgtgggggctacgtatgcacgaggtgacgagagtccatgcgtagctactattatgtttaattccgtgtagtctaggacccaaaagcatgctatacttggactatttgtaatcttaatgacagctgaattgcttaaatcacatcgaattagtaaatgaatttctaaaagaatttaaacttcattttcttaaattgttaaaagagaattggcttttctttggataattgttccatgttgacttcttgattgactgtttgtgtatgtttacctttggaacaggccgaatgcctcggtagattaaatagatgcatctattgttcgtgccgttcgaccctcggcagtgcacagtataaatattgttggattgcgctgtacgacctcggcatgatatgcgcatacttgtattacttgcctgagaatgttatgtgataatatttgccttccttggccagacatagttgataagcataatgaaaagtaaaccttggaaatccgtatttatttgagatgttgtttacctgctatctagttttacgagtttataattgctttataaaaatccatgatttcctcacattttcactatattattattggaccactaggaaatgtcaaagtcgacctctcgtctctacttcttcgaaattagacgggttacccattaggtacacgttgttttcgtactcatactacacttgctatgcatttttgttgcacacgcacatgcatctctagtggcctagtgggcgtagcggcacgattgatacggatacctagctgagttgcacttcttgagacgacccgcagccagtagtgtctctttcaaattactgtatttactttctgtccaatattgtattttggacggttgttgtactacattatttcctagaaattgctcaagtacttgtgaaatcgggttctgggatgatcacgggatttttcagtagttaaattttgtaaagacatcctcatttatccaacgaagtttattatttattatttatttgtttaaaggaaatgatttcaaaataattaaaatgagaaattgctagtaaattgtggttggcttgccagacagtggtgtccagcgccatcacgacccttagtggattttgggtcgtgacaaaaatggaggaaaatggccaagacacggatttttaaagaaccttactgcttccagcaattccgcacctgcggtcacacgactgcttctgcagtttcacaggtgcggcccctctaccactcctgcggtttctctctgggctcccctttgcacttctacgcctcgattcccgtagctgcggtcacgcctctacggtgagatgactgcatctgcggtccttatacttccatccaaaaattgcatatacggctctcctagccacttatgcggctccgcacctgcggcccaagcctcgcaggtgcggttacaccagaagacagctgctacacttcctcttccaatttgaaaaattgatctgttaatcattcggaatccacccgaggcttccggaaccccaaccaatcatgccaaccagtcctaaaatacattatggactttctcgaagcctcaaatcataccaaacaatgctaaaatcatgaatcgacccccaatctaagcttaaggaactttagaatttcaaacttctacattcaatgacgaaacttatcaaatcatgtccgattgacctcaaattttgcacacaagtcatatttggcattacggacctactccaacttccgaaattggattccgaccccgatatcaaaaagtccacttctggtcaaacttctcaaaaaccttcaaatttctatatttagccaaatgacaccaaaatgacctacggacctccgaattcacttccgatcgcgcccccaataccaaaatcaccatacgaagctattcccgaactcggaatctcaaacggacattgataaccctgaaattcacttcaatacaaacttatgagatgcttccaaaaatgctaatttccacaataggcagcgaaacgttcccgggtcttgcaaaacccagtccggacatacgcccaagtccgaaatcatcatatgaatcagctggaaccttcaaatcccgattccgaggtcgtttactcaaaaatccaaccttagtcaattctttcaacttaaagcattcgaaatgagaattctctttctaaatcaactctgaacttcccgcaattcaattccgaccgtgcgcacaagtcatagtacctgaagtgaagctgctcatggcctcaaactgctgaacgacgtgctagagctcaaaacaaccggtcgggtcattacattctctcccacttaaacatacgttcgtcctcgaacatgctaagaactacgctggggttgcccaaaatcattgtttaacacctcgagcacctaccagtgctaccacaactcagctgggcaacctagctcaatcaatcttaagataccctttatcacttaggcaaataagccttagagcccaattccaacatctgaaattcactacaaggcctgttccaacatacgctcaccgaatcaataactacacgcagcaccaaaacatgactgcataccttagctgaattcacaccttgcaccattttactcacaggaccacaataacattctctgatcaaattatttgaaattccatgaatctgatgctcctattgcacctcatgacattcaaaggtcttgctctaactcttacaatactgccgcgatggaagagatgtgtagaaattcataaccaattgctaaatctacaaatcattgggtctatactcctaacaagaaccatcatctcattctgaacaaaataatggtcttagctccttaatatacttcatataatcagattgcactaatcctaaatccaatgatctcgtctcacccagtacgaaatgctctggaaataagccaccccgtcgtgaccaaaagtcttatataatgccacaatgtgccaatgggctaccagctcgaacgcgatacaaaaggaaagtgaactctgaaaaggaaatccaattaccccggtcgcaactaatacatgcgacgtggtcaacataattaaacaaacaccccgctcgcgaatcatacatgcgacacgggcacacaactaataagagttttcctcagaaagataggaatcaaaacacataaaaatagatatagaaatctgtactcaatatcacactgttgcggcgtgcaacccgatccaaacaacatacccatggcggcgtaccacccagtccacccataaaattcacataatgagatacataccgagccagattgctcattacaacaaaatactgaatgtcggtcacaagcacgctaagtgcattataccatccataaggagacatatagcgctataagctaaaaactcaagcacaactgaggtgtgatatacgatctaaatctcaagagccattctgctcatataacattatctctacgcggaacctcaacacataagaaattcaccaagctgtctcacaacttcacacgtcacaatatttacatgaaatagctgacgacaaaataacacccagactactcatccataaggagcgcattgctgaaatgaatacatatggcctgatataaaacccatattcacatttaaatgcatccacaaacctcaagttgattctgatcacgctgaactaagctaataacctttcaaaggtccataataactacccttttctcataacacacaagaacaaccatcataaccggagtaatcctccacagtccacaacccaataaaccgagtgcccttcaggaatcagttctcagtttaacgacatcaccacaatctttatacttggtttaactcttcaaacaatcaagtgactacatgccacacttatacaaccttcccgtggggcacgctcccacaaccttccgtaacagataacaggcttgtgcatccaaaccaatggctgcactaacgctgaagagcgatcaataatccttaaccaggatgcaaagcctctttcacaaaacaccgatctccggtgacgctgaggacattactagcttactttgaacatcccaactcctttcctgctcatccaagctcgtgacatccttgtcaacactgaactacaaccttgatcctcacttcaaattccataccactcactgcacccaacatgccaatatacgatagaacacgatttttcatcataacttcggaaccactaataaattaacactacatcatataaaaactttttacttaactcatttcaggagaaccatcacaacacgcaggtgaattctcataaccgtagaatatgcaaatctccaagtagtggtctaaaccaccctaacccctccgggatcctcctatacataacaatgctataacactcgaatacttccaaataaaatcaattacggcggccgtcaagcctcacacgtacagccacaaatcacatgcataacttaatcacgctgaagaaacttatcaccactaccattatgctaattcaaccatagccaacaaatctaacttcttctaattcatccttaacttgcttagagataataatagctccattccttacattaccaatccaaatctgcactcatcttgagtaactctattccacgaggccacattgtctccaaacccatgaaccatctcataacttccttgtgcacatattcacatcctcaactggtatacccattctgataatccctctacgaatccgaagtcttttctcattttcctcccaaatgtcacactacaagtgaaaacatcatagaacgttctgggcctcttatcataagtttctacaaaagcttgcttcttaactgtacctataggctcgcaatcattaggcaccacactttacccctttgaatccactaggaccgttgttgagagccacccgctctgacttggccccgaatataatcaactccctgaatcttttatcacatcaataccctctcgacgaagcacccggcataatcacttcccttgaatcctgcatctataaaaggcataaatccagaatccttccccgcgtctgaacatgagccaataaggccaaccatagaacacctttaacaattcatttgctcaaatctcctcttatgttactctctcttagctaaaataacccactaatatgctaataaccagaaatgtcacaaatggacgaccatgaaatccaaccataggcgttgggacactcccacatagcttgaatccactatcacacaactctggaattctgtaggattcattatctcttattgacataaccttgcgcaatcaaccgccaaaattcaagtaatctttctataaaacccctttttatactctgaatcatcaaccacattcgcacgaccaatttttttgttgtataaccaatagaattctttgcagaatcttcgccaaccatgcgatcgccaatctgctcactagagataccgcacctatggaatttacttgccgacatcttccaatgctgctacacgagatacaatcactacgacatccataatccatcctgagtctgagctcactctctagctacacacccttcgtggtcatcaattaaatgtgcggcaacatctatccaattcaaagttatgttgtatccttcttcattttgagcagctcctttccgttatattaaatctcctgtcgcataatagcccatacttcaatttaaattcgtagaccccgatcaccaatcagtaaaattcccaaatcattcaaaactctccttaaggtgcgtagtcatcctaccgcaatgtccatatgcaactccgcaactctcccactttagcggaaatcacccctttaatcgactactcgacctttgcttcctatacctggcattctagaagttttgagcactgcctgacactccccacatgtccttcctcatcctttgatgcttagttgttacattaaataaaatccatcttcgtagcgcttgaaccaatgaactgctaccaactttaaatctccccgaggtcatgtttcttgggccatcaacactagatatactgattcaatcctgaaccaccgcacatcgcaatctctgatagtcgcctctccattattattttacaatatcctgccccaaaggcaaattgaagaaaaccataacaccggcgaactaaaatattcaatcgaggacgacgataccacgtcacagatgaaatttccaccatgctcaaaaataccaagtctcattactccatcaaaccaaacttgatcatttatagcccgattgcctctcttccgccgggaaataaaattctgaatctctgaatcttgcattgagtagacatccttccaagtcattcattgcttaaatgtatagataaacactctaccattatatcaatattttccgataacaatgcacgaatcgccataacaattaatggcaaatcttaaaaccttaggtaatactgaaactaagctaaaacgacagaacgaccttccgcaaggcaacgacaatagcacgatcaaatacgcaaggaggaacatcccgcaccacatctatagtaccattacattttctcagtccccgatttttaataagcgcttcacatcacataagtttgagtaggaaagaatcaaaggcataagcctcaaaggaatcaaaccgcgcgatgaggaatcaagaagggaggtgcttctaacagtcctacagcctctcaaagataagtacaaacgtttccgtaccgatctgagagactctactaaacttgctcatgacttgtgagacttaagggaacctagtgctctgataccatgttgtcacgacacaaattcaacaatgggtcatgctggcgccgaacaccgctgtcaggcaagccaaccaaaatacttaattaaattctcgttataataattttgaaaactatgattttccttcaattttataagtaaaagataatcatttcaaaacaagtatgaatgttaagaagttaatacaagataccccataatcatcccaaaacccggtgtgacaagtgcatgagcatttactagggaatggaataaaatacagtaactgtccggaatacaaagtggacacaaatgaaaaacacagaaaaatactttgaaggggactctgctggatgtgggtcatttcgataaatgcagctcacctatgtctccatatcaaccatggcgctatgccactaaaccactagacacatatgaacctgtgcaacaaaaatgcacaacaagtgtagtatgagtatgaaaacaacgtgtgcccaatgagtatcccatctaatctcgaagaagtagagacgagaggtcgactttgacatttaataatagtccaatgataatatagtaaaagtgtgagtaactcatggatttcataaagcaaaatttaactcgtaaggccggagagcaggtaaacaacttctcaattaataaaggatttccaaggatttacttttcattatctttattaatttatctcttgccaggaagggcaattatcaacatttaaaattctcaggcaagcaatacaagcatgcgcatatcatgtcgaggtcgtacagcccgatctaacataaatgtaaaatgtacattgccaagggtcgaacgacaagaaacatagatgcatctattaccccgatcgtgaatcatacatgcgacactgtcaaatttaaataaacaatcaccatgctcgcgaatcatacatgcgacgcaagtacacatagacatacatgctcaaacaacaaattaagaatttatcggagaacgtttatccaaataaaagccaattctcttttagcattttaagaaaatgaagtttaatcttttttttttgaaattcatttaccgattcgataggatttaatcaattcaactgccaacaagattacagatattccaagtatagcatacttttgggtcctagactacctggacttacatataatagtagctgtgcacagactctcatcacctcgtgcatacgtagcccccccacaaatagaagcacttaactaattatttcacctatggggataattcccttttacaagttagaaaggagactcacctcgctccaaagatccacaaccagcattccacgacctttcggagacttgaatcgatgctaaatgctccaaaactagccaacagatatgcaaatccattagtatattctcaattactcattacaatctaatttataaaaaatcctaatcccgatcgaaaggttgccaagattgccctcgggcccacatgcccgaattccgaaatttctcgaagataaagtttacccatgaactcacgaactcaaatatatgattttctcctaatttcatacccaaaatcatggacaaaatccaagaatatcaattttctaggttttccctcaaccccaagtttctaccaatttcatgctaaaatacctaacaaaaccatgtatttaacttacaaggggtgaaattaaattacctaatgtttgatgacgaaatccctctctccaatctctccaaaaatttcccaaacaagattaaatggaggaaaatggtcaagacacccgatttttaaagaacattactgcttccagcaatttcgcacctgcggtcacatgaccgcttctgcggttccgcaggtgcagcccctctaccgcacctacggtttctctccgggctcccctttccacttctgtgcctcgactcccgcaggtgtagtacctcttctgcggcgagatgactgcatttgtggcccttacacttccaacccaaaatcgcatctgcggctctcctagtcgcttctgcggctccgcacctgcggcccaggccttgcaggtgcggctacaccagaagacaactgttgcacttcctcttccaatttccaaaattgatctgttaaccatccggattccacgcgaggccctcggattgtcacgacccggattttctaccctcgggagtcgtgatggcgcctactaatgtgatctaggcaagccagctgtttgaataaattacctttttacccatgttatattctttaacaattataaagaaataacgtgtagacagcggaaattacactaagcggaacaaatacccaaactatctgaaatatgtatctaatacaactatttaggcctcgaccacccagaactggtgtcacagtttcacagatgatctaagaatactacatacaaagtctgaaagataaaatatacattgtttctgaactaagtaaatgaaacaagagtaaatggatagagagagatgtcagggcttgcggacgcctgtaggactaccttggatctccgcgtggactgaaggtagccacccaatctatggtccaaaagttgctgccgcgggatctgcagacagtggagagtgtagtatcagcacaacctaccccatgtgttggtaagtgcctagcctaacctcgacgaagtagtgatgaggctaggaccagactaccaaataaacttgtgtaatttaactaaatacaatggaaaagaagaacagtaatatacagtcacgtatgggaggggtaacatgctgcagggaactatcaatttagaatagaaagacaacgggtaattaaaagaaacaacatatcttagatatcaacgaagaatcaggaatcaataagtgcacgtcatcacctttcgtgcctttactctcgtcctcacagaaacaatcaaataatggaaatgtgcacggcatcatccttcgtgcctttactctcgtcctcacagaaacaatcaaataatggaaatatgcacggcatcacccttcgtgcttttactctcgtcctcaccatataatcaatataatcggcacggaatggtacatcgtgcggcacgacatcacccttcatgattttcactctttcctcacaaatcatacacggtatcgcccttcgtgctttaacgctctctcactaaaacaatacacggcatcacccttcttgttttaacactctctcaccaaaacaatacacggcatcacccttcgtagtttaacactcttcctcacccaaacaacaatcacaaacaatagggcaagggaataaatgaaattgcaataagaatcccggcaagggaacaatatctcaacaatcaagtcccggcaagggatcaacatcaaaagaaacatcaacatcccgacaaggaagataacatcaaaagcaacaatatcccagcaaggaggccaggtaataattctcttttttttctcacttttacttcacaactcacttcacaacttgagacaatgctttaaaagattcaattaccacttatactttcatatttcattgtacaacttgagccaacactcctcaatgttcaaatgtcacaattacttccacaaactttgcccaacaatagaaatcataatcaaagcatgaataatacaacgaagtcataataatcacaatataagactcatgggcatgcttgacaccaacgtttagatactcgtcactatgcctatatgtctaactcgacaaataccgcatagaaaataggactcgacttctaattcctcaagctaaggttagaccaaacacttacctcgatgccgcgaacacaattcaagtctcaacaatcgatttcccttttgattccaccaccatatcgctcatatctagccacaagttacttaattacgtcaataaatgctaaatgaatcaattctaatgcatgaaaatgaattttccaaagttttacccaaaaagtcaaaaattgccccaggcccacatggtcaaaacctgaggttcgaaccaaaacctgactacacattcccccacgaactcaaatatataatttgttttgaaatcggacctcaaatcgaggtccaaatcccaaatttttgaaaaaaaataagttctacccaagacacccaattttccccatgaaaatcattgattttgagttgaaatcatgtgaaaagatgttaaagagtgaagaaaactagttagaaataacttacaattgatttggagaagaaattgcctttgaaaaatggccctagagtgttttggttttgaaagagtgtgaaaaatggttgaaatgcatctaagtcatgaatttacaggtctctgatgttgcaattgcaatcagggttcacaattgtgaacccttcagaattctgagactttcacatttgcgaaaaaatttatcgcatttacgaccaccccttatttctgaggggttcgcatttgcgaagcaggcgtcgcatttgcgactggggccttccgcatttgcgagccaaatggttgcatttgcgatcaggcctgaccaggcatttgttcgcatttgtgatgaaattctcgcatttgcgagccaggcttcgcaacctgatcataccagctaaaaacctaaaattttcctatgtccaaataccacaccgtgacctatccaaaactcacccgagccctcggggatcgaaaccaaacatgcacaccaacctaaaaacatcatacggactcgctcgtgcattcaaatcactaaaataacatcaacaactatgaatttagcatcaaaatcatgaaattcttaagaactttaaatttcccaatttcctcaaataaggtccgattcatatcatttaatgtctgtttcataccaaaattcacagacttatcttaaatcacacataagacctgtaccagattccgaaaccaaaatatgggcccgaaacgttcccaggtctttcaaaacatagtccggacgtacgcccaagcccgaaatcatcatacgaacatgctggaaccttcgaatcccgatttcgagagcgtttacccaaaaatccaaccttagtcaattctttcaacttaaagcttccgaaatgagaattctctttctaaatcatctttgaacttcccagaattcaattccgaccgtgcgcacaagtcataatacctgaagtgaagttgctcatttcctcaaactgttgaacgacgtgctagagctcaaaatgaccagtcgggtcgttagagtaagtaaacttttatttgattttgtaaactcttttttgttatttagataaacatagacgtgtaccatatatattacatttattttaaaagaatttcgttttattcaaatctagataccgtgtttcaaagaactatacttataggattttaaatatgaaagagttttatagttatatgaagtagttttttttgttgctagaggcgaagtagtatttaaataattagaaaaaataaaataaagttcctaacatgattgcatatgaaaacatgataaaataattatttttaatttaaattcgaattttagaactttatctataaattaaaaattatcttttaattcaaattcatttataaatatatatttgtgatgacccggccagtcgtatcatgaattaccgctctgtttcccccatttctacttcatatgcttcattatccgtgttttatgtgagcgagttgggtagtttgcgttcggagtggatttggtaagaaatgagacacttagtctcttttaagaaggtttaagttggaaaagtcaaccgggcgttgacttatgtgttagagagctcagatgtgagttatgatggttcagttagcttcggaaggtgagttatgacttaggagtgtgatcagaattggttttggaggtccggtgtagaattaggtttgaattggcaaatttagtattttggtgatttccggttgataggcgagattttgatacgagggtcggaatggaattacgagagttgttatagcttcattatgtcatttgttataaatgtgtaaaatttcaggtcattaggacgtggtttggttgggtttttgatcgaaagcgtatgtcggaagtttttagaaaacttaggcttgaattcaatgtgaattgatggatttggtgttgtttgaggtgttttgatgattggaacaagtttgaatgaggttttcggatgtattgggcttttggttgaggtttcgggggcctcgggtgagtttcagatggtcaatcggaccattttggaatttaaaagttggagaaaaatctgcccagctgttgcagagaattatctcttcacgttcgtgaacggagccttgcgttcgcgttgaagaatttgaggaaggccagaattaagccttcgcgttcgcgagaggcgcctcgcgttcgcggaaggctaggagtttgtgcttcgcatttgcatgaggctctccgcgttcgcgtataaggatttggggtccagtggaatttgcacttcacgttcgcatcaggtatctcgtgttcgcgaaggtcaaggcggaagaggcatcgtgttcgcgactggcatgacgcgttcacgtaaggtaaaagttggtcaacataaatttgtgctacgcgaacgcgagaggttgaccgcgttcgcgtaaaaggaaagtcagacctggggagaaagtttataagttctttcatccgcgattttgagtcatttttcctccatagttgagcattttgagagcttttttagggtgattaaagaaggattcaaggagaactgattgaaggtatgatttttgaacctaaaacgtgattctattgtgaaatcaacttagaaattcttggaacttaagctaaaaatgtaagaactagggtttgggattttgaacttttaaattgggatttgaaggaccatttgaggtcggattggagaacttttgatatgtatgaactcgtggggtgataaggaatctaatgatgtgaaaatttctgagttttgagaagtgggcccggggctcggcttttgctaatttcgggatttttttatatttttcgattgttttcgcttgggctttgttcccttagcatattgtgatgtattcgttctgattttggttagatttgacccgcgtggaggccaattcgagaggcaaaggcatcgcgagctagagttgtagccggttcgaggtgagtaattattgtaaatgatgtcctaagggtttgaaaccccggattgcatatcgtaatgctataatgtagtgagacacgtgcttgatgatgagcgtggggtcgtttactattggggattgtgatttggtccgtcccgattgatgattttaccgcgtatttgactaaaacttgtttgttatcattataatttgggctgattgccatatttgggcttcgtgccaactatttgaaccctccggggatttttatcactatttcctcactatattgatttatcacttgaactcagtcctgttgatatttattgtttacaaactcaaccacttttactcatatttgaaacttaaatgatgtttctaaaagatgttttgggctgagaactactgatttactaatgcccgaggggcttgtgatgattttcggactgagtgtggacgaggtccatatttgaggatatgctgagcgatatgaagccgagggcctaatatacttttatacgccataagatggcttgagtgatgtgaggccgagtgccgagagatgatgccacaaggtagcttgatatagcacttgggctgtaaggggtccctctggagtctgcacacccacagtgtgtgcgggtacccatcatgatttgagagtgagcccgaggggctgatattgtattgagagtgagcccgatgggctgatactgtactgagagtgagctcgagtggctgatattattttgagtgattgttactgtgcctgaggggcgtatttctacttgttatctacctgctaaattacctgttttacttggtttgaaggaatttcatttgatttcctcactgatttactgctttaagtgttttttactgcttgatatagaattgctttgtgcctttacgtgttttttttgctttcagtcattatttatgattattactcactgagttggggtactcacattactccctgcaccgtgtgtgcagattcaggtatcgtagagtccgctcctgagtgctgatcctcctagtccagacagtgttttcagagactacgaggtagttgttggcatccgtagcccccgtgcctcccttatattactattttcatgtccttcaacttctgtatcggatttcatatctagtagactggtatccggatttattagtttctcatgacttgtgacaccccggtttaggatgtgtcgggatggtttctactgttgttatcgttatttctgcaaattatggttattatatcatgttttataactatttatggtatttaactatttaaataagttgttctgttttggtctggctggccttgtcttcacgagtcatgagcaggtttagtagagtctcacggattggtacggagacgtctgtatttatcctcgagaggctgcagaacctttaggaaaaaacttcatatttttgacattcttgtggtgcgaacttgtggtccgagtactaaacgtctgttatcctattctctcacaaatggtaaggacgcgagcaccggatgaggtggacaaccaccagtaccacaagttgagaccactagaggccgtagacatggtcgtagttgtggcagaggcagagcagcgagggcagcacctgtagatccaccagctgccctagctccggatcaggctccagctatggatgctccagcatcaccaattcaggccctagttgtggccatcatgattctgagtcttcaggaggccttggcacagatcttatcagtttgcactagcctggctcaagcagttcagccactacagcaacaactatttcacaagccaggggaggcaatcatacccttactgcttgcacacctgagtaggaagtacagggacttcagatgccgggggcacctccagcccagccgggtgcaccagctcaagagtttgcggtgccagttatgccggcgtcatcttgggaggattggtagactccatcctccatcattcaatggtattgagggtgaggatacccaaagctttctagataagtgtcagcggatgctccatacagtagggattcttgagtctagtggtttggaatttactacttttcagctttctggggcctccttcacttggtgggaggcatatgagaggataggccggttggtgcggcgccccttacttggcaacagttctccactatcttcttggagaagtatttaccgcagtcccgtagagaggagatgcgtagacagtttgagtggttgcgacagggggatatgactgtgtcacaatatgagtcgaggttttctgagttggctcatcgtgccgtttggatggttccgacagatcatgagaggatcaggagatttgttgatggccttaactatcatctccatattcttatgactcgagagagggtgttgggtgctacgttcgaggaggtggttgatatcgctcgcgagattgagacagttcgccgtcaggattgagaggagagggaggccaagaggcctcgaagatcaggaagttatggtggtgctccttcgaggggggcagtttcagcatggtagaggtcgttctttcaggactgctcagtcagcacgcctagagtatcgtggggcatcttcaggtcgtggttctcatgggtctcagcagggcctgctttcactcagctccctcccagcttagagttcatctcgtgccgcgtcggctcagggttcttctatgccgagtgcatcagctagtcactccggtgcggggggttcccttcagtccccttctccagcaactgggagttattttgagtgtggagagtttgggcatgtgtggaggcagtgtcctcgtcatgttgcttgttctccgagtagaagggtcagccctcgacttctgccccagttacttcactacccgcccaaccagttagaggtagaggtcaggcagccaagggtcgccccagagggggaggtcgatcggggggcggtcaggcctgttgttatgcacttccaggcaagccatataccatagcttcagatgttatcattacaggtattgtttcaatctgccacagagattccactatattatttgatctcggttccaccttttcttatgtgtcatcatactttgctcgttatttgggtacgcctcttgagtttcttactttacctgtttatgtatctacaccggtgggcgatactgttgttgtagaccgtgtgtaccggtcatgtgtggtgactattgggggtctggaaaccccagtggatatattgctattgagcatagttgattttgatgtcattttgggcatggattggttatctctgtgttgtgctatttctggactgtcatgctaagacagtcactttggctatgctgtgtgtaccgcagatcgagtggcgtggtatgactgattatgttcctagtagagtgatatctttcttgaaggcccagcatatgattgggaagggttgcctttcatatctagcgtttgtgagggatgttagagctgagactcccagtatttattctgtcccaattgtgagggattttcccgatgtgtttcctgcagacctgtcgggcgagccactagacatggatattgattttggtattgacctgttgccggacacttagcccatttctcttccgccacattgtatggcaccagcaaagttgaaagaattgaaagaacaacttcaagaactcctagataaggggttcactcggcctagtgtgttgccttggggcgcgccagtcctgtttgtgaagaagaaggatggcaccatgagaatgttcattgattatatgcaattgaacaaggcaacaattaagaacaagtatcattttccttgcattgatgatttatttgaccagcttcagggagcgagggtgttctccaagattgatctttattcaggttatcaccagttgaaacatcagggattcaaatattcttaagacaacttacaggactagatatggtcattacaagttccttgtgatgtctttcgagctaaccaatgccctaacaacattcatgcatttgatgaacagtgtatttcagccttatctggactcgttcattattgtattcattgatgatattctagtgtactcgcatagttaggaggagcacatggatcatttgagagttatattacagagtttcgagaagtgtgagttttggctcagttcagtggctttattggggcacacggtatccagtgagggtattcaggttgatccaaagaagatagaggcagttcagagttggcccagaccatcttcagccacagagattcgtagctttcttggtttggcaggctaatatcgccggtttgtttagggattctcatctatcgcatctcccttaaccaagttgactcagaagggtgtttcatttgtatggtcggacgagtgtgaggagaggtttcagaagctcaagacaactttgaccacaactctagtattggttttggtatcagcttcaggctcatataccgtgtattgtgatgcttcgagagttggtgttggttatgtattaatgtaggagggtagagttattgcttatgcttctcgttagttgaagccccatgagaagaactacctcgttcataatttggagttgactgccatagttcatgcattgaatatttggaggcattatttgtatggtgtatcttgtgaggtattcaccgatcatcgcagtcttcagcatttgtttaagcaaaaggatcttaatttgaggcagtggaggtggttggagttgcttaaggattatgatatcactatattgtaccatccgggaaaggccaatgtggtggccgatactttgagccgaaaagtagtgagtatggggagtttggcatatattccagttggggagagacctcttgtagttgatcttcaggacttggccaatcagttcgtgaggttggatatttcggagtctaatcgggtgttggcgtgtgtggtttctcggtcttccttatatgattgcatcagagagcgtctatatgatcatccgcatttgcttgtccttaaggacagggtgcatcatgataatgctagagacgtgaccattggtgatgatggggtgttgaggatgcaggtccagatttgtgtgcccaatgtggatgggctgagagagttgattctggaggaggcccatagcttgcggtattctattcatctaggtgtcgtgaagatgtaccagaatttgaggtagcactattggtggagaagaatgaagaaagatattgtgggatttgtagctcggtgtctcaattgtcaacaagtgaaatatgagcatcagagaccggttgtcttacttcagcagatggttattcctgagtggaagtgggagaggatcattatggactttgttgttggatttccagggactttgaagaagtttgatgctatttgggtgattgtggatcggtttaccaagtccgcacacttctttcgtactacttattattcatagcgattggaagagatatatattcgggagattgttcgattgcatggtgtcccagtttccataatttcagatcggggcactcagtttacttcccagttttggaagtctgttcagcgagagttgggtactcaggtggagttgagcacagcttttcatccttagacggacgggcagtctgagcgtactattcagattttggaggacatgttgcgtgcttgtgttatggaattcggaggttcaagggacagatttctatcgcttgcagagtttgcttataacaacatctaccagtcgagtattatgatggatccatatgaggctttgtatgggaggcggtgtagatctccaatcagttggttcgagcccggcaaggctaggctattggggacagatttggttcaatatgccttagagaaggtgaaggtgattcaggagaggcttcgtacaacgcagtcgtgacagaagagttatgcggatcggaaggtacgagatgtgtcctacatggttggtgataaggtcttgctgaaggtttcgcccatgaagggtgttatgagatttgggaagaaaggaaagttgagtctgcgggttcattgggccttttgaggtacttcggaggatcggggaggtggcatatgagcttgcattgccagccaacttgtcaagagtgcatccagtattttatgtttctatgctccggaagtatattggggacctgtctcatgttttggacttacacacggtttagttggatgatgatttgacctttgatgtggagccaatagctatttttgaaagttgaggtcaaatgatatagcttcagtaaaggtgcagtggagatgtcagcccgtggaggaggctacctgggatactgagcgggagatgtagagcagatatccttacctatttgaggcttcaggtatgtttcttaactcgttcgaggacaaacgtctatttaagttggggaggatgtgatgaccaggccagtcgtctcatgaattacctctctgtttcccccatttctacttcattatgcttcattatccgtgttttatgtgagcgagttgggtagtttgcgttcagagtggatttggtaagaaatgagacacttattctcttttaagaaggtttaagttggaaaagtcaactgcgtattgaattatgtgttagagggctcggatgtgagttccgatggttcggttagcttcgggaggtgagttatgacttaggagtgtgatcggaattggttttggaggtccgatgtagaattaggcttgaattggtgaagttagtattttggcgatttccggttaataggctagattttgatccaagggtcggaatggaattttgagagttgttgtagcttcgttatgtcatttgcgatgtgtgtgcaaattttcaggtcattcagacgtggtttggttgggtttttgatcgaaagcgtatttcggacgtttttagaaaatttaggcttgaattcaatgtgaattgatggatttggtgttgtttgaggtgttttgatgattgaaacaagtttgaatgaggttttaggatgtgttggtgcttttggttgaggtcccgagggcttcgggtgagtttcggatggtcaatcgaaccattttggagtttgaaagttgtagaaaaatttgcccagctgttgcagagaaatatctcttcgcatttgcgagcggagcctcgcgttcacatagaagaatttgaggaaggccagaattaagacttcgcattcgctgaaggctaggagtttgtgcttccattcgcatgaggctctcggcattcgcgtataaagatttggggtccaatggaatttgctcttcgcgttcgcatctgatgtctcgcattcgcgaaggtcaaggcggaagaggcatcgtgttcgcgactggtatgtcgcgttcgcgtaaggtaaaagtaggtcaacgtaaatttgtgttacgcgaatgcgagaggttgaccgcgttcgcgtagaaggaaagtatgaccatgtcacgacccaattcccgaacctggtcgtgatggcgcctttcatgaagacaaggccatccattgaacccaattcatccttttaagacaattaattaacaccattatagtataaacatggtttaataatatccaatagcagaaagtatagataaaatacggaaatccaacccaactcagccctaaccggggtgtcacaagtcatgagctattatagagtttactaaaattctacaaagtatggaattaggaacaaagtctaaagatatcataaataacagaagataagggagaaaacgggtctgcgaacatcatgcagctacctcgataactccaatgaaaactgaacagcagaaaactcgttctatgcctcaggaatacctgtacctgcacacatggtgcagggagtattgtgagtactccgacccagtgagtaataaatataaataatgactgaaggtaagaaaacacgttaaggcacacaacattctatacagaagcactgaaatcacttaaaataacaattcagtgaaatatcatgtgaaaattcttttaaactagtaaaacagggaatttggcagtaaaatgacaagtagaaatctgcccctcgagctcaatatcaaaacaacaagtagaaatctgcctctcaggctcagtatcaaaataacaagtagaaatctatccctcgggctcaatatcaaaataataattagaaatctacccctcgggctcggtatcaaaataataagtagaaatttgcccctcgggctcaatatctcagaacagtatcagcccctcaggctcagaatagtgtgaagcaaccagtcaatgaaataagagcacataattattatggcagataatacagataaggaataaatgcatgagtgtaatgcaatgcatatgacggtaccctccggtacccactgcggagtgcagcccgagccatccatatttatttatcgtcgatggcgctcactgggctgtgtacagactccggaggggctcctacagcccaagcgcaatatcaagccatctgtggcatcaaatctaggccctcggcctcatatcaatatcagtataatcacccaggctctcggcctcaatatcaatataatcaaccaatctctcggcctcaatatcaatgtaatcaactaggctctgcctcaatatcaatgtaacactgctgcggcgcgcaacccgatccatgctcagtccaaaaatcatcataagccccttgggcattcgtaaaacaatagttctcagcccgaaatatcatttagaaatatcatttaagttttcaaatcgtagaaagatggttgagtttgcaaaacaatatttaaaaccttggactgagatcaaatgatatgcaaaatatgcgaaaacagtgatatcaatccccaatggtgctctaccccacgcccattatccggcgtgcaagtcacctcaatatagtgttacaatgtgaaattccggtgtttcaaacactcaggacatcatttacatcaattactcacctcaagacggtcaaagtctagctcgctatgcccttgcctctcaaattaccctcctcgtgcgacgaatctgcccaaaatcacaacgaatatgtcgcattatgctaaagagacaatacccaatcgaaagcaatcgaaaaatatcaaaattcacgaatttgacaaaaacccgagccccgggcccacgtctcgaaaaatcagaaaattaacatcaccggatttcttgtgtcgccacgagtctaaccatacaaattttaccaaaatccgacatcggattggctttcaaatcttaaaaattcatctttaggaaattttagaaaatcatccatttctcttcaaatatcaataatctaaagccaaaaatgaagattaattcatggaatataatcataagagagtcaagaacacttaccccaagaattcccttaacttctcactcatgcccagaatccgatcttgaaagtccaaaaaatgaaagaaaatcggactgctctttttctacactgtccagaattttcggctactgttcacgcgtgtactgtacacggggtactgttcacggtactgttcacggggtactatttctgcaattttcctaagtccgaaatcactctgagacacctacaaaacactcccaagccctcggggctcctaaccaaacacatacactaactcaacaacatcctacgaacttaaccgtgcgatcaaatcgccaaaataacgtcatataccacgaattaagctttaaaatccaagaattctttcaaatttcataaaacatcaaattttccattttaagtccgaaacacgtcaaatgacgtccgttttcaaccaaactttacagaaagtgcttaaaccatatataagacctgtaccgggcgccgaaaccaaaatacgggctcgatacgatcactttctaatcaaatttcatttccattttccttaaatattttctgaaagcaattttactcaaaaattcatatttcgggcctgggacctcggaattcgatgatttttgttcctataataatatgaacatagcccttcagtcgaaactcaattcagagctcatttgcgtagttcaataccatttcgctcgttaaacaattaactcatgatgaaattagaccaaacgttccagatcactcctataattcattatcaaaattctggaagtctcaaaatcaaatttcaatctttagaactaaaaatggacctttggatcattacatgctcttaatcgaaacgccaaaatcttccaaaaactcttccaaaacatatccgagcctcatgggaccccgaccaaacatgccaacataactcataacatcattcaaacttgttccaatcattaaaacacctcaaacaacatcaaattacccaaaactcatcgaattcaagcctaagtttccaaaaacttccgaaatacactttcgatcaaaatctcacctatcaaccggaattcgccaaaatactgacttcgccaattcaagcctaattctacaccgaacctccaaaaccacttccgatcacactcataagtcacaaatcacctcccggagctaaccaaaggataaaaattcacatccgatacctctaactcataagtcaacatccggttgacttttccaacttaagccttcttaaaagagactaagtgtttcatttcttatcaaaaccactccaaactaactcgatcacataagatacggataataaagcataaagaagctgagaatgagaaaaatggagcggtaacctatgagacgatgggtcgggtcgtcacagaccagggcagaaagtttataagttatttcatccacgattttgagtcatttttcctccatagttgagcattttgaaagtgttttgagggtgattaaaaaaggattcaaggagaattgattggaggtaatatgtttgaacctaaaacgtgattctattgtgaaataaacctagaaattcttggaacttaagctaaaaatggaagaactagggcttaaaattttgaacttttgaattgggatttgaaggaccatttgaggtcgtattggagaacttttgatatgtatgaaatcgtggggttataaggaatctaacaatgtgaaaagttccgagttttgagaagtgggctcggggctcgggttttgctaattttgggatttttaaatatttttcgattgttttcgcttgggctttgttcccttagcatattgtgacgtattcgttctgcttttggtcagatacgacgcgcgtggaggccaatttgaggggcaaaggcgtcgcgagctagagttgtagccggttcgaggtaagtaatgattgtaaatgatgtcttgagggtttgaaacctcggattgcacatcgtagtgctatattgaggtgagacacgcgcttgatgatgagcgtggtgttgtttactattggggattgtgatttggtccgtcccgatagatgattttaccacgtatttgactaaaacttgtttgttatcatcattatttgggctgatagccatatttgggcttcgtgccaactatttgaaccctccggggatttttatctctatttcctcactatattgatttatcacttgaaatcagtcctgttgatatttactgtttacaaattcaaccacttttactcatatttgaaacttaaatgatgtttctaaaagatgttttgggctgagaacaactgatttactaatgccgaggggcttgtaatgattttcggactgagtgtggccgagggccatatgtgaggatatgctgagcgatatgaggccaagggcctgagatacttttatacgccacgaggtggcttgagtgatgtgaggccaagtgtcgagtgatgtaaggccgagtgccgagagatgatgccacgaggtcacttgatatagcgcttgggccgtaaggggtccctccggagtctgcacacccatagtgagcgcaggtacccatcatgatttgagagtgagcccgaggggctgatattgtactgagagtgagaccggggggctgatactatactgagagtgagcctgagggcctgatactgttctaagcgattattactttgtccgaggagcgtatttctacttgttatctacccgctaaattacatgttttacttggtttaaaggaatttcatttgacttcctcactgatttactgatttaagtgatttttactgtttgatatagaattgctttttgcctttacgtgttttctttctttcagccattatttatgattattactcgctgagtcggagtactcacattactccctgcaccatgtgtgcagattcaggcatcgcagagtctgctcttgagtgctgatcctcctaatccaggcagtgttttcagattacgaggtagctgttggcgtccgcagcccctgtgcctcccttatcttactattttcatgcacttgaacttatttattggatttcatatctagtagactggtattcggatttattagttgctcaaattatggttattatatcatgttttagaaatatttatggtatttaactatttaaatgaggtgttatgctttggtctggtaggccttgtcttcacgagaggtgccatcacgaccgtgttcgaggttagggccgtgacaatatttaactaaaatagtgaaatttagaataaagttatcatatactattgacatttattagcttgccacttaggttaaccataatgccaattatatatggtaactttcttgatttaatatatactagtattagtacccgcgcggatgcgcaaacactaatcatgtaaaatatttaagttatttgaattgtatgtaaataatcttaaactttacactttcttagtaaatatagatgatcattggatattaactacgtgaaaaaattaaccatttcttctatttttcttttttggtaccattcttgccggtgtcattgaatcctaaatatagtcaggaagcaaaataacaactcatatttatggcaaaacaattaaatgttgagacaatgaatgactctttggataagacttaactcttttactactacttgaactcttatttagtgtattgctatctcttaaaaaatatttctttcttaaaatttcagtttctaaaacattatttttcaatatttattgtttttataataatgtaattgaaaatattattctttattcaaaagtcattttagttggctatgtaaaaatataaaaaattctttagctagtgaattgtttttactccattttgatatttaacattaaccatgttaaatatttgagttatttgaattatatgtaaataactttaatatttaaaccttataaataattatagataatcgtaagatattaattaaaaaagactaacattttttcaattctcgtagtaaaaatttatttttgcactattctcataggtgtcattgaaacctaaaattagccacaaagtgaaataataactcatatttatgtcaaggcacaaagtttgatacgatataaatgattctttgattacgacgtgactcttatactacgacttgaactcttatttgatatgattttatctttaaaaaaaatatttcttttttgaaatttcaatttctaaaactttatatatattataataatgattatctttataataatgctagtgaagatattatccttaatttcaaattcactttaatcggctatctaaaattttaaatgattctttgaccaaatttatttcagtatgactccactttaagtttatcgatatctctagccccagaatttgaatttttaataccctatatatacaaaaagaaatctttgaatcattaaaagtttaattagttgattattattattataaaatattgcatatattatcttaaaattgtcaagtagtttattttcgacatcatacttgtcttaaccttaatgcaaactattcaaattgcattccaattcaaattcgaatatcatattagtttgttagtaatagtgatttttaaaaaatgacatataatgtaaattaaaaaaatattctaagatatccttatcttataatctatgtatttgagttgaaaaaaataatatttaaaatcgatgagattaactttcaaattttttatactgaacaaagatgaaacatacgaagaaatttgttttcatcttttatttctcgtttttagatcttctaacatttttatcaatgattattttcttttatcttacttcttatgtcattatttcttttgttacaaaaaaataatttatttcactataaaaggatgagttttaataaaaattatctacatttgaattttcattatatttttagtctttgattgaagttatttcatatttttcttttggctttatctaatcaacctaaattggtgctcacccaaccacttaaattaaaaaattgaatgatgtataatttatatataatccatatataatatgtgtataatcgtgtattgtcggtatatcatctattttatattatctataaaaagtaaacaataaatatggccgaatattatgtaaatattccataagatttcggtttttagagtttatccttgatataacttttattataataattttaaaactctttactaatgttcaaaaatatcttatatttttattatctttgaattaaaaaaattaaagagtttttttgaaataatttgtttacatttaaaaaaaatatttcacgtcataccaattttttctatatatactctttgttacacttaaaagtcgctatagaaactatcaattagaaatcaatttctctctagttgagtttgaaaaaaaacctttcacataatctaatgattcaaaactaatattcttcaacgaaaaaatattataccctagcaatattggcttgactacatctaaatgaaggggtttcagcttatactttcacgacccgaattttccaacctcgggagtcgtgatggtgcctactaatgtgagctaggcaagccaatcagttaactacttattgctttaaaaacaatataagacgataatatgacaacagcggaactttaaataattaagtggaagataacaattaaatatctaaaatttgcatctattacaactcttaaaatctaaagtacccaaaacctggtgtcacggtgtcacagacggtctaagatttactacatacaaagtttgaagaaaatgacaatatattgtttctgaataaaaggaaaatgaaacaggaaataggagtagaggagacgccaggccggcggatgcctgcaggtctaccttggatctccgcgtggactgaaggtaacctccacactacggtccaaaagcttctctgggatctacacatagtgcagagtgtagtatcagcacaatcgaccccatgtgctggtaagtatctagcctaacctcggcgaaatagtgacgaggctaggaccagattatcaaataacctgtgcagttcaaatatatagatcgaaaagaaataaagaaataaccactaaatatgggagggggagcaagttgtgggggagataacagttccgaatagaaagacatcaagtaatgaaagaaacaatataacttggatatcaacaaagaatcaaaaatcaacaaatgcacggcttcatccttcgtgtttttactctaatcctcacaaaacaaataacgcacggcatcacccttcatgctttaactttcttcctcacccaaacaataatcacaaataatagggcaaggaaataaacgaaattgcaataagaatcccagcaagggaacaacatcaataacatccatatcccggcaagggagataacaaataaatcaacaatagcccggtaagggtgacaatataatgatctcttctctttctcacttttacttcacaattcacttcacaactcgagccaatgctctagaggtccaattatcacttataccttcacaattcatttcacaactcgagccaatgctttaaaagttcaattgtcacttatactttcacaattcgttatacaacttgagccaacgcttctcaaggttcataggaaacaattctttccacaaactttatacaacagttagaaaccatcaccaaggcatgaaagatacaacaaagtcatgataatcacaatataaagattcgcaagcatgcgagacaccaacgtatagatactcgtcaccatgcctatacgtcgtactcaacaattaccacatagcaaataggactcaactcctaatccctcaagctaaggttagaccaaacacttacctcgataccaccaacacaattcacgattcaattatagctttaccccttgattccgccaccaattcgctcgtatctagtcacaagttacttaattacatcaatgaacgctaaatgaatcaaccccaatgtatcaaaatgagttttctaaagttttacccaaaaagccaaaaatctcccccgggcccacatggtcaaaacccaaggttcgaaccaaaactcgattacccattcccccacgaacccaaatatataatttgttttgaaatcggacctgaaatcggggtccaaatccccaatttttttaaaacctaggttctaaccaaaacacccaatttcccccatgaaaatcatttatttgagttgaaatcatgttaaaagatattaaggagtgaagaaaatgagttagaaatcacttaccaatgttttggagaagaaaggttgtttgaaaaatcgcctcttatgtttttggggttttgaaaaatgaaaaataattgaaaatcccgtctaaatatactactctcaaatgccctgtgcggaccgcacaaaatcaactgtagccgcacagcccctgtgtggactgcagtgacatgctttagtattttggccacaactttctctacagatgtccaaattgtgatttctttacctttctggacgctagacacgaagggctacaactttcggttttgaatcatctcaatatttcatgtagatcaaaagatataggcttccgaagtcagaccagtaaacctgtgcggaccgcacaaaatcaactgcggccgcacagtcaccactgcggacaacacaaaaactagtgcgaactacactagcaggttcagagatttgtacttctctgaacctccagtagccatgttttaagcctaagacaccctggaacctacccaaaactcacccgagccatcgggactccaaaccaaatgtgcagactgactcaaaaacatcatatggacctactcgtgcgatcacatcatcaaaataacatgtaaaatcatgaattaaacctcaaaactcaacatttttatcaagaactctcaatgttcataactcttcaatcggaagtccaactcacgtcaaataaactccgttttcaccaaatttcacagttatctttcaaattgtataacaagtttgtatcaggctccggaaccaaaataagggccagataacaatactttcaaacattaattcttttcgttatttcttagacaattcagtaaaacaatttctttcaaaaattaatttataaggcttgggacctcggaatttattttcgggcatatgcctaagtcccatattttactacggacctcccgggatcatcagaacatggttccgggttcgtttgctcaaaatgttgaccaaagtcaaccataatcaagtttttagctctaaaatttctatttctcatatttttacatagaaggctttccggatataggtccggaccacgcacgtaaatcagggtggggaaaaggaggtttttatgcctcgaaacactgaattcacttgcaacacaaaggtcttcacattctccacctctaaaacaactattcttcctcgaatggacataagaaagaagtacctgagtcgggaaaaagatggggataacggctccgcatatcggactcggactcccaggtcgatgcctcaggaggctgacctctccattaaacacaaacagaaggaaaactcttcgatctcaattgactaacctgctggtctagaataactactggctcctcctcataagacaagtccttgtccaactcgacaatgctgaaatctaacacgtgggatggatcgccgtgatatttctgaagcatggacacatgaaacactggatgcacggttgataagcttggcggcaatgcaagtctataagccacctctcccactcgatcaagaatctcaaatgggctaataaacctagggctaagctttcccttcttcccaaaatctcatcacgcccttcataggcgacactcaaagcaatacatgctcaccgatcatgaatgccaaatcccaaaccttgcggtcgtcataactcttttgcctggactaagctgtacgaagcctatcctgaatgatcctgacctattccaaggcatcctgaacttgatctatacccaccaatcgagcctctcccggctcaaaccatcaaactaaagaccgacaccgcctaccatataaagcctcatacggagccatctaaatactcgattggtatctgttgttgttggcaaactttgctaaaggcaaaaactattcccacaagcctccaaagtcaatgacacaagctcagagcatatcctccaatatctgaatggtccgctcgaactgcccgtccgtttgaggatgaaacgttatgctcaactaaatccgtatgcccaactctcgctgaactgctctccagaaatgggaggtaaactgcgtacctcaatccgaaatgatagactcgggcacaccatgaagacgaacaatctcccggatatagatctcagctgatctctcggaagaataatagactgccacaggaataaaatgcactgacttggtcagcctatcaaaaataacccacactgtattgaacttcctctgagtccgtgggagacaaaaacaaagtccatggtgatacgctcccttttccactgaggaatctcaatcttttgaaatgaacagtcgggcctctgatgctcgtacttaacctgctgacaattcaaactttgagccacatatgcaacgatatcctccttcattctccgccaccaataatgctgccgcaaatcctgatacatcttcacggagctcggattaatagagtaccaggaactatgggcctcctctaaaatcaactctcgaatcttatccacattaggcacacaaactcgaccctgcaatctcaaaacttcatcatcacctatggtaaccttcttggcacctctgtgttgcaccgtgtctctaaagacgcacaaatggttatcataatactaccgatctcggatatgatccaataatgaagagcgagcgattgtgcaagctaacacatgactatgctcagaaacatccaacctcataagaaagactgcctatactggctgacttcctactcaaagcatcagccaccacattatcctttcctgggtgatataagatagtgatatcataatctttcaacaactccaaccacctcatctacgtcaaattcaactacttttccttgaataaatatcgaagactcttgtgatccgtgaacacctcacatgccacgccatacagatagtgcctccaaatcttaaacgcgtgaacaatggctgccaactccaaatcatgaaccggatagttcttctcatgaatcttcaactgccgcgaagcataggcaatgaccttgtcatcgtgcatcaacactgcaccaagtccaatacgagatgcatcacaatagactgtataaggcccctgaacctatgggcaatactaataccggtgccgtagccagagctgtcttgagcttctgaaagctcgccacacactcctatgaccatctgaactaggcacccttctgggtcaacctggtcttcagggctgcgatagatgacaaactctccacgaaccgactatagtagcatgccaattctaagaaactccaaatctttgtagatgacgctggtctaggcctgttcatgactacctcaatcttcttcggatcaacttgaataccctctactgatacaacatgacccaagaatgcaactgaactcaaaaggaattcacactttgagaacttagtatataactgactatccctcaaggtctgaagaaccactctaagatgttgtttgtgctcctcccggctgcgggaataaatcaaaatatgatcaatgaagactatcatgaacgaatccaaataaggcctaaacactcggttcatcaaatccataaaagctgctagagcatttgtcaacccgaatgacatcaccaggaactcataatttccgtaccgagtgcgaaaagctttcttagggacatcagatgccctaatactcaactaatggtagccagatctcaagtcaatctttaaaaatattttggcaccctgaagctgatcaaacaaatcatcaatcctcggcaacaaatacttatttttgattgtaaccttgttcaactactggtaataaatacacatcctcatcgatccgtccttcttcttaacaaacaacaccggtgcaccccaaggcgaaatattaggtctaataaaacctttctcaagcaagtcttgcaactgttctttcaactccagtggggccatacgatacggtgggatagaaatgggctgagtgcccggagccagatcaatacaaaagtcaatatccttgtcgggcggcacaccagtcagttctgaagggaaaacctccgaaaacccacgaacaacgggcatagaatcaatagaaggaacctcgacactagaatcatgaacatatgccaaataggccaaacaccccttctcaaccatatgccgagccttcacatacgagataacattacgggtagaatgactaagagtccctctccactctaaacgaggcaaacccggcaaggctaaggtcacagttttggcatgacagtccaagatagtgtggtaaggtgataaccaatccatccccaatataacatagaaatcgatcatgtctacaagcaataaatctacacgagtctcaagacccccaatcacaactatacatgaacgacggactcgatctaccacaatagaattacccactggtgtagacacataaacatgatcactcaaggaatcactatgcataaccagatacggtacaaaataagataacacatacgagtacgtagaccctggatcaaataacactgaagcatctctatcacaaaccagaaccgtacctataataactgcatctgaagcctcaacctcgagcctggttggaaaagcataacatcagggctgggccccactaccctgaactacatctctaggacgacctgctgctggctagcctccacctctagtgacctgaactccacctctagtacatctacctcaacctctagcacctctacccccacctctagctggctggtgggctgtgggacactaggtgcctaaaccatggcacaggaaccctgatgcggagagctactcggtgctcgagggcaatacctagcaatgtgacccatatcaccacaagtgtatcaagccctcggctgctgagactgctggtcctgacacctgaatgaccaccccgaaaactctgaagcggcggtgcactgataggagcaggtggtgtattgtaagactgctgatcagaatactacatttgaggaccacgaccacctaacgtaccgtgagaaacttgaagtgctgattgaaaaggcctaggaggatgacctataccatatgaatccctacctccaaacgaggtaccattgaatcggcctgaatgacgaggtgtcatgtctgacacatgaacacctccctgcgacagaactatctctactctcctggccacattggtcgcctcttggaaagatatctcactccctgcctccctagccatctgaagacaaatcgactgaataagtccatcaatgacctcctcaccctttccctcttggtgggaagtatgataagagcatgatgagccaagtcgatgaatctggtctcatactgggtaacagtcatagaaccttgttggaggcgctcaaactgcctccgataggcctctctttgagtgatggggagaaaattctctagaaatagttgtgtaaactactcacaagtcaagactggcgatccggctagactagataagcaataatctctccaccaagtcttggcggattcagataagcgaaaagtaggaaaatcaaccccattggtctcaactatccccatgttcctaagaacctcgtgacagctgtctagataatcctggggatcctcagtagatgcatcgctgaaagtagtagtgaagagcttggtgaacctatccaacctccacaaagcatcggcagacatagctgctccatcgtcaatctgagctaccacacccagctgaactgctccaactagctggaccgctggagtctgaaactggggaggtacctgctctggagtgctagtagcaggagtctgggctcctcctccatcctgagagacgactggtgctacaggaagcaagcttgcttgggtgacactctccatgaggcccacaagacgcaccagagcatcctgaagaactggggtagcaataaacccctttaggacctaagttaggcccaccgaaactgctggggccggaacctcattatcaaagtcaacctaaggctctgtcgctggtgttgctgcttgaggctaagctttgcccctacctcggcctctagcacggcctcggactcgccctctgaccctcctgggagctactgctaggggctcgggttgctagtcagtgtatgaggaagcgcgtgttctcaccatctgcgaaagaatagagtagaaattcaattagcattaagaaaccaaaccgcacgacaggagagaataaatgtgaagttgttcctaactctatagcctttgggggataaatacaaacgtctctgtaccgatccctcagactctactaagcttgtctatgaactatgagacccacgtaacctagagctctaataccaacttgtcatgacccagattcccaccctcgggagtcgtgatggcacctactaatgtgagctaggcaagccaatcatttaactacttatttcattactcaattattgttttaaaaccaatataagacgataatatgaaaacaacggaactttaaataattaagcggaagataacaattaaatatctaaaatctgcatctattataactcttaaaacctaaagcaccgaaaacctggtgtcatagtgtcacagacggtctaatatttactacatacaaagtctgaagaaaatgacaatacactatttctgaataaaaggaaaatgaaacaggaaataggagtggaggagaccccagggcctgcgaatgcctgcatgtctaccttgaatctctgcgtggactgaaggtagcctcgacactatagtccaaaagctactctgggatctacacatagtgcagagtgtagtatcagcacaaccgtccccatgtgctggtaagtgtctagcctaacctcggcgaagtagtgacgatgctaggacacgactaccaaataacttgtgcagttcaaatatgtatacagtggaaagaaatacacaaataaccagtcaatatgggagagggagcatgctgtggggagatgataattacgaatagaaagacatcaagtaatgaaagaaacaatataactcggatatcaacaaagaatcagaaattaacaaatgcacagtatcaccattcgtgcttttactctcgttctcaccatagcaatcatataataaaaatatacacgacatcacccttcatgcttttactctctttcctcaccatataatcaatataattggcacataatggtacaacgtgtggcacggcatcacccttcgtgctttacaatatttcctcacaaaacaaataatgcacggcatcacccttcgtgctttaactctcttcctcgcccaaacaacaatcacaaacaatagggaaaaataaaggaaattgcaataagaatcccgacaagggaacaacatcaataacatccacatcccggtaagggagataacaaataaatcaacaatagcccggcaagggtgacaacataatgatctcttctctttctcacttttacttcacaattcacttcacaactcgagccaatgctctagaggttcaattatcacttataccttcacaattcaattcacaactcgagccaatgctttaaaagttcaattgtcacttatactttcacaattcattatacaacttgatccaacgctcctcaaggttcataggacacaattctttccacaaactttatacaacagttagaaaccatcaccaaggcatgaaagatacaacaaagtcatgataatcacaatataaagactcgcgggcatgctgtacaccaacgtatagatattcttcaccatgcctatacgtcatactcaacaattaccacatagaaaataggactcaactcctaatccctcaagctaaggttaaaccaaacacttacctcgataccacgaacataattcacgattcaataatagctttaccccttgattccgccaccaatttgctcgtatctagtcataagttacttaattacatcaatagatgctaaatgaatcatccccaatgcatgaaaatgagttttctaaagttttacccaaaaagtcaaaaatcgcccccaggcccacatgctcaaaacccgacgttcgaaccaaaaatcaattacacattcccccacaaacccaaatatataatttgttttgaaatcggacctcaaatcgaggtccaaattcctagtttttgaaaaacctaggttctacccaaaacaactaatttaccctatgtaaatcattcatttgagttgaaatcatgttaaaagatatgaaggagtgaagaaaatgagttagtaatcactttccaacgttttggagaagaaaggttgttagaaaaatcgcctcttatattttttaggttttgaaaaatgaaaaataactgaaaatcccatctaaatatactactctcagacgccctgtgcggaccgcacaaaatcaactgtggacgcataacccccgtgcagactgcagtgacatgctttagtattttgtccataactttctctacagatgtccaaattgtgatttcttttcctttctggaaactagccacgaagtcgtttttgaatcatctcaaaattccttgtagatcaaaagatataggctttcgaagttggaccagtgaacctgtgcgaaccgcacaaaatcaactgtgtgcggatagcacaaaaactagtgcggaccgcactagtaggttcagagatttgtacttctctaaacctccagtagccatgttttaagcctaagacaccccggaacctacccgaaactcacccgagcccttgggactccaaaccaaatatgcatactaactcaaaaatcatatggacctactcgtgcgataacatcatcaaaataacatgtaaaatcatgaattaaacctcaaaactcaacattttcatcaagaatactcaaagttcataactcttcaatcggaagtccaactcatgtcaaataaactttgttttccaccaaatttcaaagttatctttcaaatactataacaagtttgtacctggatcggaaccaaaatatgggcccgataataatattttcaaacattaattcatttctttatttcttagataattcatgtaactacccgaccggccgttttgagattttgcacttttctctccagttttcaggcatgacttgccccgtgtggtatattatgacttatgtaaatcgttggtgttgggtttcaggttaatcgaatgaatttggaagaactgtctcagttgaaagcttaaaatttgaaaggtttgaccaagatttgacttgtttgtatttgatctcggattttaatttttatgatttggttagctccgttaggttatttggaacttaggagcgtgataggaatgcatgttggaaatccgtagaaaatttaggcttgaattagcgaaattgagatttctctctttcctgattgataggtgagatttcgatatagaggttggaatggaattctgatagttgcagtagcttcattttatcatttgagatttgtgtgcaaaatttcaggtcatttggactagatttgatagactttttgatcgaaaacataatttaaaagttcttggagttcttcagcttgaatcccatattaaatttgtgatttgatgttgttgtaagtgtcccaaagttttgaaaaagttttaatgatgtcatggaatgtgttggtacaattgatttgatgttccgggagttccggggtgttttaggccgaaaatcatagttgtagcaggtccagaagggttgcaggcctcggaacccactcgcgcggttcacacaaaaagaagtgcggccacggtatgtgatgtgcggaccacacaaaatgaagtgcggccgtggtaggtgttgtgcggatcgcataaaatggtgtgcggccgcggtgaagaacattccgctggtcctacttcggaagctcatatcttttgatatacaaggaattttgagataactcaaaaacgaaagttgtagcccttcgtgtctagtttcaagaaaggtaaagatatcacaatttggacatttgtaacaaaagttataatcatcatctccaagtattttccctcaaatccgttctaaacccctcgaatcttaaatcccaaatccgagttccaagagccaaacctaaaactcgaggttgatgtgattttatcacaaaataatgttactcacttgttttgacaaagaacaagtgactaacattatttggcgatgaaatcggaaagtcagggtaccaagttgatttctagcttagtcggtgagtttcccggtatcatttctttttattttaatgcctattccaccactgcctcttcttcttcttcttctttgtcattcaacaatttaattaagttttgaattaggtttaaaattgtgaattgtccatccgttttctttagttcatattcatgtatgtcgttaatcaatctaacaactgattttgatttttcaatccagttgaaggttttagtcttttgtttaccgtttattataattgtgataatttaaaacttacgaagcttctcaatagtggtagggtagaaattgcattaatgaattaattaaaagcactaaactagtggataattatgaaatgaaaagttgaattgatagtggtgaatgcactaagttgaacaattatttatagacactaagagacacactgaaaaatggactggatattcaagaatacagagagatagagtacaaagatagagaaaggagagctcagagactttaagagatagaaaatccaaaaaaccaaaaacgactgaagttctgaaactgcactgatttccagcacttttccttgataataattgatcaaattctgtattaagtgggtctttttaatctttttcatgagctaaaatctctgaaagcttcacattctgcactttagttgagaaatggtttgaatttgggggttctaaaagctctgttctaaatttagctgtttggttattgtttgattggttctcggcactgttttatagttgtgactactgctgcttggctactgatctcacatttcttacttcctctcattttccaggtatgcttcagcatttaagtagcatatgagatgtaaagggaagccatgtagttgatttagatagtgaataaaatggcctctattttttaaatgatttgttcgtgtattttcttgtctaaattagcctgattacctggatattattgtattcagtcatgacttatgccgtatattttaggaagatgcttgaactttggttttgttattttaattctaaattagaagaactccttgtcaaatacttgtgtgttgggactattatgattggaatttagtgagtgttgttgttattcgagctaatagtttgagtcttgcatctttcatttatgtttagggttgatcacatgaattgctcgttggaattgttgctagaaactctgtggttcattattaaaattaagtaatgtttggttgattgtgaaatgcatctggttttatcatcagtagggtgggttgttaatgccaaaattaacatgtgttaaagaatagtctgggtccttgttcacctcgacatttcttgtagtcaggcataaggctttgagttctcaatatggttagtgttgaataatggataaagtttcctagctaatacatatagtgtgttaatattgattaattcaaattttaattgtagtttatcttgaactgtaattcattttagcataaaatatgtgttgttgaaaattggcattaattcaatgttggtcgtgcctgcgtgagttcgatccgcgagcccagtataggcgtgatttcattgaggcctgggctcctctcatgggcttgaatctaaagagacttgtaaaaattaaaatatcatattttgggcttgctgagtttcgctagcccaattccctcgtttgtttggttgttaatagcaaattcagttcgggctttaacattgagtatatgttgaactcctggggtttattttctttcgtaattaattaagttctctaaattaattggaggcgagccacattagacgaatcataatttgtagccctcatgggttaattcttaaactcttggttaaaataaatcaaggtgcaccatgccggacaaaaatatcaattgcatggccctctttaattaatattgtttatccttagaaatcgaggcatgccgtttagcgactttttatggcccttgcaaagttgcaaacgcctagttgctttaggcgcgttactttaataatttaccttcctaaactcgggtgcgcatttatgtaacccaaatccaaatctcaacaatattaaataaaacgtgtctcagattgtgggtgcatttcatatggaatggtccaaaaacgcattttatatgacgttgaattttttcaaatgaaagaggtttaaagttaagattgcacataggttcaaaatgttttaagtcagataattaagccgaatacaacagttgagtgaccgtgctagaaccacggaactcgagaatgcctaacaccttctcccgggttaacaaaattccttacccagatttctggttcgtgtactgttaaacagagtcaatatttttcctagattcgggattcgaaccggtgacttgggacaccataaatctcccaagtggcgactctaaatttcttaatataaataaatcctgtttcgattgttctttaattggaaaaacacccttatataccaccgagtgtaggaaaaaggaggtgtgacagtagagacttgaattttgttcatggcatcgaggtaagtgtttggtctaaccttagcttgagggattaggagtcgagtcttatctactatgtggtatttgttgagtacgacatataggcatggtgacgagtatctttacgttggtgtcaagcatgcccatgagttttatattgtgattattatgacttcgttgtattattcatgctttgataatgatttctattgttgggcaaagtttgtggaagtaattgtgacatttgaacattgaggagcgttggctcaagttgtataataaaatgtgaaagtataaatggtaattgatcccttctagagcattggctcaagtgtgaagtgagttgtgaagtaaaagtgagaaagagaagagaatcattatgtttcctcccttgccgagatactgttgcttttagtgttatctcccttgctgggatgtttatgtttcttttgatgttgataccttgccgggacttgattgttgaactattgttcccttaccgggatttttatcgtaattttatttacttctttgaccttatttcttgtgattgttgtttgggtgaggaagagtgataaagcacgaagggtgatgttgtatatgattttgtgaggaagagtgtaaagcatgaaggataatgccgtgccgcatgatgtaaaattctatgtcgattatattaattcttggtgaggatgagagtaaaagcacgaagggtgatgccgtgcagtttatattggttcttatggtgaggactagagtaaaagcacgtagggtgatgccgtgtacttgtccttgattttcctgattcttgttgataataaagttatgttgtcctttacgtttatttatgaattttctgttgttacttgattttttttatgttatagattcccttaccctatttgctttgtgatttatgcttgggtgaggaagagtgtaaaacatgaagggtgatgccatgtattgttttggtgggagagtgttaaagcacgaagggtgatgccatgtattgttttggtgagagagtgttaaagcacgaagggcgatgccgtgcaattatctttgatttcctgattttatggataactgagttacggtttctctacatttaattgctggtttctattgatacttgttgtaccccgcaacataattcccccttcctactttcaattgaactatagtgatactcatatttatttgttgttcttctgttattagtcgatgtccgcgcagcatgttatccccttcccataattaactgtacattactgttattcttttctgctgtatatgatttaactgcacaggtttaattggtagtctggtactaaccttgtcactacttcgccgaggttaggctaggcacttactagcacatggggtcggttgtactgatactacactctgcactcttttgtgcagatcctagtgctgtagatttcgaaccgcaataagattgctttttcttgttcatcaggtgatctgaagtagtcctgcaggcgtccccgggccttggtgtctccttctatctactatccccatttctttcatgtatttccagagacagtgttgtatttatttctttcatacctttgtttgtagtacccctagacagtttgtgaaattgtgacaccagccttgggtagatttgttatggattggtattggcagtattattaaatttttgcaatgcagtcttcacgagtaggtgccatcatgactcctaagggtgggaaattcgggtcgtgacaagttggtatcagagctctaggttacataggtatcacaattcacagacaagcttagtagagtctgagggattggtatggagacgtctgtacttatcccccaaaggctacaaagttaggaaaagtttcacttccatccttctctgtcatgtgattttgttctctcactgctaatttgaaacctctactcttgtcctttcacgaatggcgaagtcacatacggcttcttcagcagaacagcatcacataccgatgatagatcaactacgtcttcggaggctttgcggaggttggataggtttagattaactacatctttggaggctttgcagagattggatatgtttcaccaagatcttcactactactttcagtggtgcatcttctaaggatccccgagattatctgtgcagttgtcatgaggttctcaggaacatagggatagtagagaccaatggggtcaattttgctacttttcgcttgtctggatccgccaagacttggtggagagattattgtttggctagaccagccgaatcgccagctttgacttaggagcagtttactcagctatttctggagatgtttctccccatcacttagagagagatctatctgaggcagtttgagcttctctagcagggttctataattgttactcagtatgagaccggattcatcgacttggctcgtcatgcttttatcatactttccaccgagagagagagagagagagagagagagagtaaggaggtttattgagggactcgttcagccagctcagtcagctagaggtggaggtaaaggtactagaggtggaggtagaggtattagaggtggaggtagaggtgctagaagtggaggtataggtattagaggtggatgtacaggaactgttctggtttgtagtagagatgcttcggttttatttgatccaggatctacatactcctatgtttcgtcatattttgcaccgtatctagtcatgcctagtgattctttgagtgctcctgtttatgtgtctacaccggtgggtgattctattatggtagatcatgtccatcatttatgtatagttgtgattaggagtcttaagactcgtgtagatttgcttcttttggacatggtcgacttcgatgtcatattagggatggactggttatcaccttatcacgctatcttggactgtcatgccaagactgtgaccttagccttgccgggtttacctcgtttagagtggagagggactcctagtcattctaccagtagtgttatctcatatatgaaggctgacgtatggtcgagaatgtgtgtttggcctatttgtcctatgttcctgattctagtgctaaggttccttctactgattttgtgcccgttgttcgtgagtttcctgaggtattcccttcagacctgtcgggtatgtcgcctgacagggatatggacttttgcattgatttggctctaggaactcagcccatttctatcccgccgtatcgtatggccctgccggagttaaaagagttgaaggagcagttgcaagacttgcttgagaaaggtttcattaaaccgagtgtttcgccttggggtgcaccgatgttgtttgttaagaagaaggatggatcgatgaggatgtgtattgattaccggtagttgaacaaggttacaatcaagaataagtatccattgccgaggattgatgatttgtttgatcagcgtcagggctaccaaggtaatttcgaagattgacttgagatctggctactataagttgaagattagggcatttgatgtccctaagatagctttccgcactcggtacgggtattatgagttcttggtgatgtcattcgggttgacaaataccatagcaacctttatggatttgatgaactgagtgttcacgccttaattggattcatttgtgatactcttcattgatgatttttgatctattccaatagccgggaggagcatgaacaacatgttagagtggttcttcagactatggttacggcttcagttgctaccccacctgctcagtaaactagaggtggaggtcgaggtcgccctagaagggcaggttaggcccgatacaatgcccttcttgcccgtacaaaggttgttgcttctcattctgtcatcacaagtattatactggtttgtcacagagatgcatcgattctattcgatccaggctacacttattcttatgtgtcttcttattttgttctgcatttgggagtatctcgggattctttgagttcccctatttatgtttctactcctgtgggagattctcttgttgtggaccgcatttatcggtcatgtttggttgctcttagtggtttcgagaccagagccgatttattgttgctcaacatggtagatttcgatattatcttgggcatggactggttgtcaccccattatgctattcttgattgtcacaccaaaatcgtgaagctggatgtgccatgtgtactgtgtgttgagtgtaggggtactttagatcacactcccagtagagttatttcttttcttaaagctcagcgtgtggttaagaaggggtgtgatgcgtatttatcttatgtaagagatgtcagtattaataccccttcagttgattcagtcctagtagtacgagattttcccaatgtgtttccagttgatcttccaagcatgccgcctgatagagatattgattttggcattgatctgttgccgggcactcagcccatttctattgccccgtatcgtatggctcctcctaagttgaaggagctgaaggattagttacaggaattgcttgataagggttttattcggcccagtgtatcaccttggggtgctcctatcttgtttgtgaagaaaaaggatggtttgatgcgtatgtgtattgattatcgccagttgaacaaggttatagtgaataaccgttattctttgtctcgtattaatgatctgtttgaccagcttcagggtacacaagtgttttctaagatttatttacgctcaggttaccatcagttgaagatttgagagccagatatcacgaaaactcctttcaggactcggtatggtaactacgagttccttgttatgtcatttgggctgaccaatgccctagtagcctttatgcatttgatgcatagtgtgttctggccgtatcttgactcgttcgtcattgtctttattgatgatattctggtgtattcccggattcggaaagatcatgagtagcacttgaggactgtacttcagactctgagagagaaaaagttatatgctaagttctcgaaatgtgagttttggttggattcagtgccattcttaggccacatggtatcgagtgagggcattcaagtgtatccgaggaaaatagagtccgtgcagagttggcccaaaccatcctcagctacagagattcgcagtttccttggtttggcaggttactactgtcgttttgtggaggtgttttcatcgattgcagccccatgaccaggttgaccaagaagggtgctctgttccaatagacggagtagtgtgaggcgagctttcggaagctcaagcagctttgaccacagccccaattttgatattgcctacaggtttgacgtcttatacggtctattgttatgcctcgagggttggcctaggagcaatatcgatgaagaatgctagggtgattacctacacatccaaacagttgaagatacatgagaagaactaccctgttcacgaccttgagttagctgccatagttcattcctgaacatttggcgccattatttatacggggttccttgtgagatttatactgaccattggagcttgcgacacttgttctagcaaaatgatctaaatttgctctaaaggaggtggttagagttgctgaaggactatgatatcactattttgtatcacccgggcaaggccaatgtagtggctgatgccttaagtcaccggatggagagtttggggagtttgacatatttactagcatcggagaggcatatgacgatggatgttcaggccttagccagctagtttttgatattggacctttcagagcccagtcgggttctagcttgcgtggtttctcggtcttccttatttgatcgtatcagggagcagcagtatgatgacccccatttgcttgtcctcggagacaagggtcagcatggtgatgcaagcgatgtaactattggtgatgatggggtattgaggatgcagggtcggatttgtgtactcaatgttgatgggcttcgagagttgattctagaggaggcccaaagctcatggtattccatccatccgggtgtcatgaagatgtatcaagatttgagacaacactattggtggaggcggataaagaaagatatagttggattcgtagcttggtgtctcaactgtcaacaggtgaagtatgagcaccatataccgagtgggttgcttcagcagatagggattctggagtggaagtgggagtggatcaccatggactttgtatttgggctcccacggactttgaggaagtttgatgctatttgggtgattgtggatcggctgaccaaatccactcatttcattcctgtgcgtactacttactttttggagcggttggcggagatttatatccgggagattgttcgtctgcatggtattcgagtgtccatcattttagatagaggtactcagttcacatcacggttctcgagggtcgttcagtatgagttaggtactcgggtggagttgagtacaacatttcaccctcagacggatggacagtctgagtgcactattcagattcttgaggatatgctccgcgtgtgtgtgattgagtttggagggtcttgggatcagttcttgatattggaagattttgcttacaacaatagttatcggtccagcattcagatggcaccgtattaggctttatatggtaggcagtgtagatctccggtggggtggtttgagtcgggtgaggctagactattgggcccggacatggttaaggttgctttggagaaggttaaggtgattcaggatagactccatacagcccactccagacagaagagttacgcggaccagaaagttcgtgatgtttcctatatggttggagagcgggttctgcttcgtatttcgtctatgaaggtcgttatgagatttgggaagaaaatgaagttaagtctgaggtttattggcccttttgagatattgagacatgtagaggttgcttatgagcttgccttacctcccagcttggcaggagttcacccggtatttcatgtttcgatgctccgggggtatcatggtgattcgtcgcacgtgttggatttcagttcagtcaagttggacaaggatctatcctatgttgaggagctagtggaaatattggacaagtaagttagaaagctgaggtcaaagaacattgcatcagtgaaggttcagtggcggggctagccggtcgaggaggcgacctgggagaccgagcaggatatgcgcagccgttaccctcatcttttcactacttcaggtatgtctctatgctcgtttgaggacgaacgaatgtttaagtgtacgaggatgtgacgagccggccgatcgtcttaagaattaatgccctgatcccctattaactgctttccccaagtttaattatgctattttaattttccgggatgttcggtgttgagtttcggagagttttggtacacttactccctaaatgagagcttaagtgttggaaaattgacgtgttcggtaattttgttagctccgttaagtaatttcgagcttaggggcgtgttcggattgtgttttggaggtccgtagttaaattaggcttgaaatgccaaaaattgaatttttgaagtttcggtccgatagtgagattttgatccgagggtcggaatggaattccgaaagttggagtagtttcgtatgttgaatgtgacatgtgtgcaaaatttcaggtcattcggacgtggtttgatagactttttgatcgaaagcatattttgagaattttggagtttttaggcttgaattcatggttaattcgaggtttcgatgttgttttaaggattggtacaagtttgggtagtgatttgtgacttgttagtcccttttgttgaggtcccggaggcctcaggatgatttcggatggttgacggaaagattttggaatttaagttccagcttcagttgctggttctgtcataaccgcacttgcagtttggtttccgtaggtgcggcgtagcagaagcgtctaacaggccacaaaaaagaaattgacctcccgcagatgcgggagattttctgcataagcggaactgcatctgcgagttggagaccgcaggtgcgaaaattggccattaaatgaaaagtcgtagatgtgaccttggctccgtagaagcgggaccgcagatgcggtcccagggccacaaatgcggaaatcgctgggcagaacatataagttcatgccttcgcgaaatttagccattttttatcttttcaaaagaggaagaatcttggggagcacttttcaagagagattttcagaggagttcattggggtaaggtctttggtccctaaactcgttattggaatgatttttatcaacttaaacatgaaaaattaaggaaaatcagtggtaattgggggtttagggcttgtcaaattggaggcgtttgagtgatgatttaagggaccatttgaagtccgattttgatgtttttggtatgactgaactcgtgagagtccgaggattctagaaatataaattttacccgattccaagacgtgggcccgagggtcattttatataatttcgcatattagcttagaatttaattgtagaatcagttacttgaagtgttatttacattatgcaattgggttaaatagatttgggctattcggagtggagtacccgtggcaagagcgtggtttcgggttaattttgagccggttcgaggtaagtggcttgtctaaccttgtgtgggagaccttccccttaggatatgatatatttgattgaaatgccttgtacatgaggtgacgaatgtgtacttgagctaaatgttgaaaattcggtttttccttaagtatttcaattgagttctttttctgtttttttctacttacgaatttagcatgttgctagtttagaaaagcatgtttagttgacttaattgcctatttgcttaaaatgccttaattgcattacgtgaagcatgttaggctagaataaattgtttacttggtacaaaattctgcttgattgggtattcttgtatagttgtgtattttttattttgggactacggggcggcatcccgggagatcccctgtacgtatttatgatctgaactgaggtgcaggataccaagagatccttggcatgtatattgaggataccaagagatcctcgggataccgagagatccctagcatatattgaggataccaagagatcctcaggataccaagagatctgtagcatttattgtggataccaagagatcctcgggataccaagagattcctagcctatattgaggataccaagagatcctcgggatacaaagagatccccagctatcatccttgttatgagtggtacttcctggtgtttgcctttatttctattatgttattgtactccttgttatcatgtgtagattcttactatagattcttaattgtactatttatcttatcctgtcatcttagtatttatttaacctcaatagggtcctaaccttcctcgccactattcgaccgaggttaggcttggcatttactgagtaccactgtggtgtactcatgccctgtctgtgcatgtttttcatgtgcaaatccaggtaccgctattcaggcctaccatccttaaggaggcgaccgctctagagacttcgaggtacatctgccgtgtccgcgaaccgtgaagtccctttctattcctgcttttagtatttagctcttctgtatttttctgtttttattagacattccggagtttgagctatgtagtattgatcttagcttgtgattcatgggtcttcgggtcttgaattttttttttggtattgagagttgaatatggtgtatgttgagtagcacatttaaatagtgttattactttattactgtttaaagttgttttactttccgcaaattttggttttgttccgcaatttaggcttacctagtcgtagagactaggtgtcgtcatgatggttcacggagggcgaatccaggtcgtgacacgaacgcgaacgcgaaggtcacctaggcctgacccatcgcgaacgcgatacaggcctgcccaatgatttttaaacagtaacagaacactcgggatttcaccaaaatgtcataacttcttcctccaaactccaaattgggcaatttttgtaagataacttcgccacaaattcataggtatgtaatcttagactcattttcttcaatttccattaacacccattagatttctaggcctaaatcatgtttttaagggtagaaaattagggatttgggtagagttagggctttttgtataattggaatttagacctcattttggggtaggatttcaaaactaattacatattcaggctcgtgggtgaatgagtgatcgggttttggtctgaacctcgtgttttgaccaagcagtcctgaggtggatttttgactttttgggaagaatgatgggaaatctataattaaacattggaattgaattgtgtagcatttattgatgttattaagtcgattatgtctagatacaattgatttggagccaaataaaaaatggaaagtggtgtttgaggcttgagttggacgtgttagttcgaggtaagtgtttggtctaaccttaacttgatggattaggagttgtgtcctatttgctacatgttacttgtttagtacgacgtataggcatggtgacgagtatctatacgttggtgtcaagcgtgactgtgagtcttaaattgaaatcgttgttttctaaataaatactatgaatgtctatgtctttgattctttgtgttgaacaaggattatgattatcctcgtggaaattacttatgattgagtatttgtgctggttgaggtagttagatgttggaacaagtttggttatagttgattttcccttgccgggacgtatttacttatactgtcgattcccttattgggatagtgttgtttctttattaatcccttgacgggactcttgttgggaatggtgtcgaactgtatatatggatcgagttgcgcaccgcaacaatattatatttggattgggttgcacaacccaataatattatatttggatcgggttgcatgccgcaacaatgatataattgggtcgggttgcacgctgcaactataatataattggatcaggttgcacaccgcaatagtgataaatgatatggatcgggtttgcacaccacaacagtgttattatgtgttgggattgggttgcccgccacaacaattgataatacgaatgtttatggattcattacgagttctttattgttttgctgtaaattctaaattgcctttatgactttctcttaatttaatgttgatattgatattcccccgcagcatgtaccccctcccatctttacttgtttatttatattttattttccgctgcacattatataactggacaggtttatttagtagtctggtcctagcctcgtctctactttatcggggttaggctagtcacttaccagcatatgcggtcggttgtgctgatactacactttgcactatgtgcagatcctggagtggcaacttttggaccgtagcattgggtggctgccttctgtccagttagagttcgcgaggtagtcctgcatgcgtctgcaggtccgtcgttctcttctatatttctatgtattatgttttcatttacttcagagactgattgtacttttctttccagacatttgtatgtagtatttgtagttggtctgtgaaattgtgacaccagattcctggtagagatgtatgttggtattgtcgtattggtttggctaagttatcagattaagtcttctgcatgtatttatttatcattaatattttactattgatcgcatgttaatttaaattgttaaaagggctaaataaaagggttagtgattctatattacgcggcttgcctagctttcactagtaggcgctatcacgactcccgagggtgggaaatccaggccgtgacaacttagtatcagagctctaggttacataggtctcacaattcacggacaagcttagtagagtctgagggattggtacggagacgtctgtatttatcccctagaggctacagagttaggaaaaacttcacatttattctttcctatcatgcggtttggtttcccaatgctaattgaatttatactcggttattttgcagatggcgagaacacacacttcatcatccaccaatcagtagctcgagcctccaccagtagctcatacgaggggccaaaggcaagggaacgaccatactaggggtcgaggtaggggcaaagctcatcccagagtagcagcaccggcggtggagccttaggttgactttgatgatgaggttccggcccagatcgttctggtggacccagcttaggtcctagatgggtttattgctaccccagcactctaggatgctctggtccatctagtgggccacatggagagtgtcacccgggcagacttgcttcctgtagccccagccgtctctcaggatagaggaggatcctagactccttatactcgcactacggagcagatggctccctagtttcaaactccagcagctcatccagttagagtagttcagccgggtgtggtagcttagaccggtgatggagtagctatgtctgccgatgctttgtggagattggacaagtttaccaagctcttcactactactttcagcggtgcatcttcttaggatccccaagattatctatatagttgtcatgaggttcttaggaatatggggatagtggagaccaatagggtcaactttgctacctttcgcttgtctggatccgccaagacatgatagagagattattgcttggctagaccagtcggatcaccaactttgacttgggagaactttactcagctatttctggagaagtttctccccatcacttagagaaagatctatcggaggcagtctgagcatgtccagcagggttctatgactgttactcagtctgagatcagattcatcgacttggaccgtcatgctcttatcatacttcccaccgagatagagagggtaaaaaggtttattaagggacttattcagccgattcaccttcagatggctaaggagtcaggaagtgagatttctttccaggagccggccaatgtggccaggagagtggagatggttctgtcgcaaggaggtggtcaggggtctgacaagaggcctcgttattcgggcaaatttagtggtgccttgtctggaggcagggattcgtatggtagaggccatcttcctaggcccgttcagtcatcacttcaggtttctcacggcgcttcaggtggccatggttctcatatgcaatattcggatcaacagccctacagtgcaccaccagctcctatcagtacacctccgctccagagttttcagggtggtcattcaggtctctagggtcagtctcagttttcttagccgcaacactcaggtggatgctttgagtgtggtgagtatgttcatatctaaaggtcttgtccgagattggtgggtactcagtcgtagcaacagggttcccgtgctatggttcaggcaccaggtgttccgccgcctgctccgccagctagggatgggggtagaggtgctagaggtggaggtaaaggtgctagaggtagagctcagaccgctagaggtagaggccagccagctgcaggccgtcccagagatgtagtctagggtggtggggcctaagccccgatgttatgctcttctagccaggcttgaggcttccgatgcatttatcacaggtactgttctggtttgtggcagagatgcttcagttttatttgatccagggtctacatactcctatgtgtcatcttattttacaccgtatatggtcatgcctagtgaatccttgagtgtccctgtatatgtgtctacaccgatgggttattctattatggtatatcgagtccatcgctcatgtatagttgtgattgggggtcttgagactcgtgtggatttattactcctggatatggttgattttgatgtcatattgcgaatggaccggttatcaccttaccacactatcttgaactgtcatgccaagactgtgaccttagccttgtcgggtttacctcatttagagtggagagggactccttgtcattctacttttagtgttatctcttatatgaaggcatctcgtatggtcgagaaggggtgtttggcctatttggcatatgttcataattctagtgccgaggttccttatattgattctaggcatgttgttcgtgagttccctaaggtatttccttcagacctaccgggtattccacctgacagggatattgacttctgcattgatttggctacgggcactcagcccatttctatcccgccttatcgtatggccccacctgagttgaaagagttgaagcagcagttgcaagactttcttgaaaaaggtttcatcagacctagtgtttcaccttggggtgcgccgatgttgtttgctaagaagaaggacatatcgatgagaatgtatattgattatcggcagttgaacaaggttacaattaagaataagtatctgttgccgatgttgatacccaatttttccctatatattttccaatatgcaaataccttcaaaatagcatatgtatgcatatataagtatgtccaaatgttttagtattttttccttaatttttaaaggtttttaaatcaatttatttccctattttatccataaaaccccaataattatttctaatattttatttttggtaattcatttattggactttcacatttaggctaaaatatagctaagacaatttttgcatatttttacaaatgtatttagtatttttaaaggctaaattgcataattgcaattttagcctcttttaatatttaattgggtttatattcatgaaaatgaagtcccgtatttttaaattgataataatatgtcatcaatcattttagtacttttaatttatttccagaaatcaatttactatttttttaattttaaataggaaaaagtggctatttaaatcatagcccaatttcatttcaattatagcctgaaattgagcccaaaccagacccaatttcccaacccaattgcaacccgaacccgcccccctaacccaattttaatgaccttactcggactccccacctaatccctttaatcctagttgttgatcatttagatcaacgactcccgttccccctttcctttttaaccccaaacaacccctaaacctatctcatttctcacctactgccgcccttgaatccctcttctctctcaactctctctgaaactcctacaaaccctagccgccgccatcaaaccaaaccctaatccaccctgataccttcctaatccatggccttccgtggtcatttaagacctgtaccagccttccatggctcctatgtgtttggttttatggtttcacgaccagacttcgtaggagtttggtccagtccttgcttgactggtgttcatggcctttctccgaccatccacgacttttcctggcccttcatggcctttcaaggcgggtccttgacattttctggttagatcgttaactttcgagatctttctcgttttcttttgggttttactatctttctcactaaacgtttgttgaaaaccctaacttttgaaaaggtttcctcacttgctactttgagacctttgcatgtttctgatactctgttttcttcactattgaattcaatgtgacttggcctacttgattactatgcttcgaatatttgctttactactgaaccctagcttatttctgccactactacatgcttgtgattatctcttttgccaatgtgcttggcctctcatgtctgatgacccttttcacattatttatatactgaagtgcagaagcatgtttttctttgattgatctcaattgtgtgactgatttcaaaaacttttcttgtatgaactctaatttcactcgcctgttaaagttaattgattcctttccttattttgccttactgaatcttttcccaaaataagcatatttctatacttagacttgattacttactcaatgcttttactactccttatatggaaataatcagtttgtctctaaattgatcttcttttcttattttgaaactgtcattacccattaaacagtgactccttaattaaagggagtcacttctgtaattgattctgactgttgattgtttctgtatttgtattaaaactttacttgttatcttactgcttactcgttttcagaagctataaataccctgcactttctcttctttcaaacacacgaaccacttgagttcagaacacacacttcactcaaagctctctctcttttctctattactacttgtgttgctgccttgtctagccggctgaaagccaaggctaggctgtggaaatttgcttacttttctttctgcatttgcctctttactggtatgttctaattaatcttccagcatcaacaacaacaacatgtttctttactatttccttcactcttgcttgtttcctgctttagtttaatccacttacattaccaagcatgttgtaatcttccccttcctctttcgaattaatgtaatttgtcttatgtatgaactttattagtcattaattatgacttatgaatcccaaacccccatatcccctatgtgtttgtgttctttggttggtttgagggcatgtcagcattagacattgctgtgcatgacccaaacctgaccctccctagggtcatatgcttcatatcccctctatgtattgtgttctctggctggtttatgggcatgccagcaccagctattactgtgcatgtccaaacctgacccctcttagcgtcatacgctccctgcaatgtattcccaaacccctgaccactttgtacaaaaatgctgattctgtgtagtgttagctttactattactattttcaaattacccttacaccttactattctcaatccagttttaaacaaaatctctgctcctgctcttccactatactcttagacttaggtactacacctcttgtatgagccttaccttgggacccatgagctccctctgaacttggactaagggtgttaaaagagccaggtcagcccggttccggaccggcctagaccagttaagaccagaaccggcccagactggtagaagggggctgggttgggctgggttaagggcgactggcgggttgcaccgtttacatttgaaataccagttacccgaaattttaaaactaggcccagatctgaccattggcaatggtccatttcagaaaatggcctttgcccaacggttgaattgcacaaatagcccaattttattttatttttaaattaacccctctttgaaacccctccctccccccctcttcctcatttcttcacgcatctctcaattctcatattctctcattcttcaatcttcattcttcacctattaaagtgcaatcaactatttggctccttttttttggaatttaatttatcgtaatatttattattgaagtttgaacaattgaacttcaaaattggaacaaatgacgtttcttcgtggtaacattggagttgcgaaatcatcaagtgctcaatttattgccgagtttggtgcactccctccaactctttctcatatttactattttatttgcatatttatttgttgctagtagttaaatttttacattatgtgtaatgctcaaaaagagtttgtaacaaggttactaatcggggaaataaataaagagctagtacttcagcttcagcatctggtagtaatttaaatacttctccaaatattcctgaaacattacctgataataatatagattataaacaattgcaggaagtttttggtatagacgataatgaattagaaatggaagatgagataccacttacacctagtagtgttggagctgctagcagggatggtggtcgtggtgctagtagtagaccacctgtggcgccgactagtaatcatatttggaaattttttgaggaaatagaaggtactgatagagttaaatgcaaaaattgtaatgatgcttctaagaataagactagaggacaattaggggggactaggacacttagtagacatatgagaattgagcatcctatagaatagggatctgatggagatggaaatcaatcaactctaaaccctactactggaggtcttgtgaaatatgataaactaaaggatcgtgaggagttagcaaaaatgattgctttggattatctaccttttttcttttgcttattcatcatatcttattatgtatattcaaaagatttacaatcctttatttaaaggtatccctagaagtacttgtagatctgatatctttagactttacggacaatatcaaacatacatatgttatttgtttagccaccttccttgtagagtttctttaacttccgatattggccatgctattaatgaaaatgattatttgacaattacatgtcattgtatagatgatactacttgtatgcataaatgtattatcgcttttaaatatgatgaagatcagagtcatactgttgtgtttataagtagtactatttatgaagttgttgaattttataatctcaagtaaaaagtattgggtatgtcttttgataatgcttctaacattaatgccgcaatttaatataaaaactgcatttgcaaccacctcttgatgaaaagtttcatgttaggtgtgcatgtcatgtttataatttaattgttaaagtggccttgatttattttcaactgagattactcatgttagaagagcagttggtgttattcaaggaaataataggcaatctagaataaaggaatttaagaataagtgtgtccagtataaccttaaacccagattcatgccagacgaaattgttacttgatggaattatatatatttatttttaaaatgttgctacaaatatagattcccaataactgaagttgttaatgcgcattgtactaatccaaaccgtatgttaacaactactacttgggaggtcattaatgatgttgttaaatttttacataaatttatatagctactgttgagttttctagagcatattagcctactaatactatggctttagtacatatttcttttctacactttgaatttaagaagaaagaaaaatatagggacgttgaaaaaatgctagcaagattaaaaaaatatttctttccaattcctccgatttacttaattggtgttgttttaaatctctctattaagatgtctgattgtcaccaattaatgaatgctttatatacttatatggagattggaccaatgaaaccccaaatttatatacttgtatgaacaagctaaataaatatttacaataattatataattattatgcaaatgtagtttatgatgatgctcttaatgttggcaatgttaatcccactatgcactgtaccacttctgctactgtggatgatgaagaatgccttgatagttttaatattttttctacattttctaacactcaaaccagtagcaggaatattgatgaacttcaattctacttccagaagcaaaaagagccttgcacaaaggaattttcaccgttgggatggtggcatgaaaatggaaagcaatttcctgttctttttgctatggctcgggacgtgttgaatgtgccaatttcaactgttgcatcagatagtgcatttagccaagcaagacaacaacttagagacacctgtcactcattgggaagcaatgctttggaagttttagtatatttcagagattggattagatcagaacgaagaaatcaaggacgtgaagatgttgatagcctagaagatgaggaacttggagatatattaatatatggtatcccatccgaatttaacactccagaagaaggtcactcagttcatattgattatgaagaacttactaaggcaatgtaaaaacctttgaatttactctttttggttaatttacctgttgttaaatgtaaaccttttaatttataagtttgaattttgaaataattgtagcacttgcaatttataagtgcaatgtttttccatcttccttgtattctttatattaatacaaaatattaatatatcttacaatatttatacaaaaaaaattttaaaaaaaatactaaacccggcccggcccgaccccctcaacccgtaaccctaacggatcaatttttacccagatgaatctgaacccgttaaacccggtatgccccaacccgtaaccagcccggaccataacccgtatgggtactaaaattcactaactagcccggcccggctcgcctgttaaacacccaaaacttggacacataaatactggtccttccatactacactcatatctatctgggtatgcaaactagggtgtaagcactgcccgaggtcccttgagacccttagggaactttgactcactcaagtctgagaaaggctttggaacaaatgacatttgaggtggtttattccataactcagagaggaagtcaagaatcaggcttcctctggttgtaacttcttcttttacacttttctgttgtaattcattattcagcttgtaataaatattggggttggctagtgaaaaagggctgggtaattgtgcatgcttaagggtagatatcatgcctataagatctgttgtcttaaattctacatgtttaactttgcatttagatatcatgcctataagatcttttattttaaattctacatgtttaactctgcatttagatgtcatgcctataagatttgttgttatgcacttttaactctgcatttaaatatcatgcctataagatctattttctttaaaattctgcatgttctatatctagagaatatgcctataggacctgctttctgcatgtttaactctgcatttagataacctgtctataggacttgtttaaattcttcatgtctaactctacatttagatgacatgcttatagggtttgtcttcaattctgcatatttattaccacacttaggcaccatgctcttaggatctaagtggttacaattcgatatcattaaaattagtaccttttatagaaatcatgcctataggaatttcaattaaatattgcgtgccttatttcatgttcaactagatatcatgtctatagaaattaaaattagcaataatagatatcaatgtctataaaatctaaaaccagtctagtttaaaatcagcctaactcgtattgttctaaattagttttaaacaaccttacttctttattcaatgcggtttagaaagcatgtctatagcatctcaaatcgtttgttgtagaactattcctgctatgctttaaatgaccccactcggactgcccaagtaacccctttaatcccagccgttgatcatttaaatcaacggctctcgttccccctttcctttttaaccccaaacgacccctaaacctatctcatttctcacttaccgccacccttgaatccctcctcctctctcaaatctctctgaaactcctacaaaccatagttgctgccattaaaccaaaccctaatccaccctgatacctacctaatccatggccttccgtggtcatttgagacctgtactagcctttcatggctcctatatgtttggttctatggtttcacgaccagacttcgaaggagtttggtccagtccttgctcgactggtgttcatggcctttctcccgaccatccacgactttcctggccattcatggcctttctaggcgggtccttgacttttctggttagatcattaacttttgagatctttctcattttcttttgggttttctgaaaccctaatctctaagatctttcgatttctttcagatctaccttagatctgtgcttaccatgagcttttaagcgtttttcttgaaggttcttcaacgttgttttcaaaacgactcttcattgttctgaatagggttttcctttaagttatttcaaaaaatcttttctctgattctcgatgttgttttatgactttactatgttcgaactatttattatgctttccttctacttgagtcagcatgttgaaaaccctaatttcttttgggtctcattcgaatcctaaagatgtttgtttaaatgtatacttgtttaattaagttcctcgtccttattggatttatttgtgttacaattttaaaactcgattactgtttaaaagccctaggtctttggggctgaagttgtttgtttaagtacttgactcgactgaaagcttttgtttaagactttcttttctttatgtgactcatctgattatgatttttactatctttctaactcaacttttgtcaaaagccctaacttttcaaaaggtttcctcacctgctactgtgagacctttttatgtttctgatactctgttttcatcactattgaattcaatgtcacttgacctacttgattactatgcttcgaatatttgccttactactgaaccctagcttatttctgcaactactgcatgcttgtgattatctcttttgccaatgtgcttggcctcgcatgtctgatgaccctgttcacattatttatatactaaagtgtagaagcgtgtttcttctttgattgatctcaatcgtgtgactgatttcaaaaaaatttcttttataaactctaatttcactcgcctattaaatttaattgattcctttccttattttgctttactgattcttttcccaaaataagcatatttctgtacttagacatgattacttactcaatgcttttactactcattttatggcaataatcagtttgtctctaaattgatcttttttccttattttgaatctgtcattactcgttaaacagtgactccttaattaaagggagtcacttgtgtaattgattccgacagtttattgtttctatatttgtattaaaattttacttgttaccttattgctcactcgttttcaaaagctataaataccctgcactttctcttctttcaaacacacgaaccacttgagttcagaacacacacttcactcaaagctctctctcttttctctattactacttgtgttgctgccttgtctagccggctgaaagccaaggataggctatggaaatttgcttacttttctttctacatttgcctctttactagtatgttctaattaaccttccagcatcaacaataacatgtttctttactatttccttcactctttcatgtttcctacttgtgtttaatccagttacattaccaagcatgttgtaatctgccccttcctctcctgatttaatgtattttttcttatgtatgaactctgtcagtcatttattatgacttatgaatcccaaaccaccatatcccctatgtgtttgtgttctttggttggtttgagggcatgtcaacatgagacattgctgcgcataacccaaacctgaccattcctagggtcatatgcttcatatcccctctatgtgttgtgttctctggatagtttatgggcatgccaacaccaactattactgtgcatgtccaaacttgacccctcttagggtcatacacttcctgcaatgtattcccaaacccctgacccctttgtacaaaattgttgatactatgtagtgttaggtgtactattactgttttcaaattacccttacacattactattttcaacccagttttaaacaaaatctctgcttctacactaccactatactcttagacttaggttctaccgatcttgtgtgagccttgccttaggacccatgagctccctctaaacctggacacataatggctggcccttcgacactgcactcatcactatctgtgtatgcaaacttgggtataagcactgtccggggtcccttgatacccttagggaactctgacacactctagtctgagaaaagctttggaacaaatggcatttaaggtggtttattccataactcatagagaaagtcaagaatcaggcttcctcttgttgtaacttcttcttttacacttttctggtgtaattcattattcagtttgtaataatttgtaataaacatagggttggctagtgaaaaagggctgggtaattgtgcatgcttaaggatagatatcatgactataagatctgttgtcttaaattctacatgtttaacactacatttagatatcatgcctataagatctgttattttaaattctgcatgtttaactctgcatttagatgtcatgcctataagatctgttgttctgcatgtttaactctgcatttagatatcatacctataagatctatattctttaaaattctgcatgttctacatctagataatatgcctttaggacccattttctgcatgtttaactcagcatttagagaacctgtctataggacttgtttaaattctgcatgtctaactctacatttagataacatgcctatagggtttgtcttcaattctgcatgtctattaccacactagacaccatgctcttaggatctaagtggttacaattcgacatctttaatatcagtaactttatagaaatcatgcctataggaatttcaagtatatactggctgcctcatttcacgttcgactagatatcatgtcaataggaatttaaagtagaaataatagatatcaacgtctataaaatctgaaaccagtctagtttaaaatcagcctaactcgtattgttctgaattagttttaaacagccttactccttttattcaacgcaatttagaaagcatgtctataggatctcaaatcgtttgttgtagaactgttactgctttgctaccttctgaatcagcaatagatatcatgtttttaggatctcacccaaatacttaggtaagccttatccaatagttagaataaaaacctgaaccggcctttgttaatcaataattgctacgaccagcaggccggcctgattcagacttcttatctgagttatgtaataaactagtctgcatcaacaattaaaattctccttgccttagcactttaaattcagaccctaattgtgtttgagtcatgcaatttatgtgctttgtttgaggaggtatacatgagccttttagttgtttacatgtttcccctaatatgcagtcctatatgtttttttgtatgtaaccttagctttttcaccttttgaaacctaaaagtcagcctaatatccctcccctatagaaatagtagtcctaagttcctctgggattgataggagtgggacgggtaatagcatgcaacagtggtcgaggccaatccacgctttaataccttgacagggtgggacaggtagatatggatatgatgatcagtacgctaataccacgtgtatcccctcttttgaggagtgtcataccgggtatcgcattgatgtgatccatataataaataaacctaggacaccctccctttttatattctcaagtatttgtggagttgtaacttcattttcaaaatacgccttttaatagttgcttttcttttcaaattcttatatgtttaaactaaatcccctactatttaagcctatacttgtttatttgctaaattgcacaaattcacaaaaaactgtctggccgggaaccacactagtggatcccgaggggtgcctaacaccttccgcatgggataatttcaagtccttaccctatctttggtcatcaaacaaacttagaagtgaaccttatatgtgtcctaatgcaccttaaatcattaggtggcgattcttcaaatgcaaaactcagttcccaaaaggaatgagttgtcttaaaccctaaatgtcataaacctgattttacgatgcgaagaggaaaaaagggggcacgacaaccgaggaatgatgatttgtttgatcagcttcagggtgccaaggtattttcgaagattgacttgagatttgagtaccgtcagttgaggattagggcatccgatatctctaagacagctttccgcactcggtacgggcattatgaattcttggtaatgtaattcgggttgacaaatgccccagcagcttttacggatttgttgaactgagttttcaggccttatttggattctttcatgatagtcttcattgatgatattttgatctattccacaaccgagaggagcacaagcaacatcttaaagtggttattcagactttgcgggatagttagttgtatgccaagttttcgaagtgtgagttttggttaagttcggttgcattattgggtcatgttgtatcagcggagggtattcaggttgatccgaagaagatataggtagttaagaactggcctagacccacatcagctacagatattcgaagtttcttggggttggcaggttactatcgtcggtttgtgaaggggttttcgtctattgcagcctcgatgaccaggttgacctagaagggtgcccagttcaggtggtcggacgagtgtgaggcgagctttcaaaagctcaagacagctttgaccatggcaccaatgttggttttgcccacatcttcagggccttacacagtttattgtgatgcatctcgtattaaacttggtgtggtgttgatgcaggatggcaaggtcattgcctatgattcgcgacagttgaagattcataagaagaactatctggttcatgatttggagttggtagccattattcacgcgttgaagatttggaggcattatttgtatggtctggcatgtgaggtgttcacggatcacaaaagtctgccatacttgttcaagaagatggagttgaatttgaggcagagaaggtggttggagttgttaaaagactatgatatcaccctcttatatcatccggaaaaagccaatgtggtggtcgatgctttgagtaggatgtcagctagtatggcagtcctgcttatattccagtcggtgagaggccgcttgctttggatgttcgggctttggccaatcagttcatgagtttggatatttctgagcctagtcacgtgttagcttgcacgatcgctcattcatctttattggagcgtatccgagatcagcaatatgatgatccctatttgtgtatccttagagacacggtgcatcacagaggaaccaagcaggttaccttaggagatgatggagttttgagattgaagggtcgagtttgtgtgcctaatgtggatggactccgggagttgattttaggggagggccatagttcccggtactctattcatccgggcgctgctaagatttatcaagatttgcggcagcattattggtggcggaggatgaagaaggacattgttgcttatgtggctcggtgtttaaacttccagcatgttaagtacgagcattagagacctggtggtttgttccaaaaaattgagattcctaagtggaagtgggagcatatcactatggacttcgttgttgtactcccacgaactcagaggaagttcgatgtagtgtgggttattgttgataggatgaccagttagcacatttcattcctgtggcagtttcctactcttcggagaggttagctgatatctatatccaggagattgtttgtcttcatggtgtgcccgagtctatcattttggaacgaggtatgtagtttatctccactttatcgagagcagtttagcgagagttgggcacacaggttgagttgagcataacgtttcatccttagacggacgagtagtccgagcggactattcagattttggaggatatgctccgagcttgtgtcattgacttttgaggctcgtgggatcaatttttgcttctagcagagttttcccataacaacaactaccagttgagtatccagatggttccttatgagacattgtatggtaggcggtatcggtcaacgattggatggtttgagccgagggaggctcggttgtttgatacggatctggtttagggtgccttagacaaggtcaagattattcaggatagacttcgtacagcagtccaagaaaaagagttatgccgaccgtaagattcgatatttggcattcatggtcgtgtctcgtctatgaagggcgtaatgagatttgaatagaagggcaagcttagccctaggttcatcggctcgtttgagattcttgatcgagtggcagaggtggcttacagacttacgttgccgccgagcttattagttgtgcatctagtgtttcatgtgtccatgcttcggaagtatcatggtgatccatcccacgtgttagatttcagcattgtccagttggacaaggacttgtcttatgaggaggagccgatagttattctagaccagcaggttcgtcagttgagatcgaagacctttccttctgttcgtgttcagtggagaggtcagcctgctgaggcattgacctaggagtcatagtccgatatgcggagccgttatccccatcttttccccgactcaagtacttactttttatgtatgtccgaggacgaatggttgttttagaggtggagaatgtgatgacccaaaagttcatcacttgagttaaaatgaattttgcatttcgaggccttaaaaacctctttcagcaccaccttcatttgtgtgcgcagtccgggcacgtagccagaaagccattatgtgtactctaagaaaaatgatgaattttgactttaaaatgaatttaagttgattttggttaacattttgggtaaacagacccggacacgtgatttgacgatcccagagggtcggtaggaaaataagggacttgggcgtatgcccgggatcgaattccaatgtcccaagcccgagaaaagcatttttaaagataattattttctcgaattgtgatgaccgtcatcacttgttttaaaagaaaattctgcgttctgaggccttaaaacctcttttagcatcaccttgatttgcatgcgcagtccggtgcatagccggaaagctattatgtgaaaatctgtgaaaaatgataaattttgactatacaatgaattatcttgacttcagtcaacattttgggaatatagacccggacccgtagtttgacggtcccgtagggtccgtaggaaaatatgggacttgggcgtatgcctgaaatcggattccgaggtcccaagtccgagaaatgaatttttaaaagaaattattttctaaaaaatataaaggttttgaatgtgaaatattatgtgaaacttgtggtatcgggcccgtattatggctctgaagcccggtataggttcaatatgatttatatgtgttgtcggtgaagtttggtaagaaacggaatccatttgacgtgatttggaccttaaatgcaaaatttgatgtttaaagaagttttgagaaatttcattgattttgatgtgtaattcgatgttcatgatgttattttcttgattttattacacggataaatccgtaggatgtttttgaggttgtgtgtatatttgatttggatccccgacggctcaggtgacttttggataggtcacagagtgtattttggacttggaaatattgcaggtttcagctgttgtgcataggtctgcaggtttcacaaatgcaaaccatggcttgcaaatgcgagacctccaacgcaaatgcgaaaagaggacctgggcaggccttatcgcaaatgcgaccacttggctcgcaaatgtggaaggcccagtcgcaaatgcgaagttctcctttggtgcctgaggtcgcaaatgcagcccaacctttgcatttcccatctcacaattgcaatattcctttcgcatttcccaacttagcagaggtcagggtttgcaattcccatatctgcgacctgcaacttttatacttagacgaatttttaacccattttcatatcctctcaaaacataaacactatagggagatttttgaaaggcttcttcttccaaatcaattgtaagtcgtttttaactagttttcttcaatccttaacatcttctaacatgatttcaactcaaaatcaatgatatttgtgggggaaattgggtgttttgggtagaacctatgttttttcaaaaaatggggattcggacctcgatttgagatctaatttcaagaaaattatatttttgggtttgtgggggaatgggtaatcggggtttggttcgaacctcgggttttgaccatgcggacccgggggcgatttttgactttttgggtaaaactttggaaaatgcattttcatgcattggggttgattcatttagcgtttattgatgtaattaagtaacttgtggctagattcgagcgaattggtggtataatcaaggggtaaagctataattgaaacgtgaattgtgttcgtggtatcgaggtaagtgtttggtctaaccttagcttgagggattaggagtcgtgtcttatttgttacgtgttaattgtggagtacgatatataggcatggtgacgagtatctatacgtcggtgtcaagcatgcctgtgagtcttgtattataattgttatgactccgttgtggtttattacgcttcacatgttattattatcattgttcccttgccgggatatttgtttgatatcattgttcccttgctgggatgtttgtttgatattattgttcccttgccgggatgttgttgaaatattattgtcccttgccgggatgttgtcgaaatattaatgttcccttgcggggaagtcgttatattgctcttgtttccttgccgggattctttgtgattgttgttgatttgtaactgggatctggtgttacgccttccacaagataaatgaaatgggagcgggtggcacgcctgccacaagataaatgaaatgggagcaggtggtacccttgccacaagataaccaaaataggagtgggtggcacgcttgccacaagataaatgaaatgggagcgggtggtattcctgccacaagataaatgaaatgggagtgggtggattgcctgccacaagataactaaaatgggagcggatggcacgtctgccataagataaatgaaatgggagtgggtggcacgcctgccacgagatacatgaaatgggagcaggtggcacacctgccacaagataactgaaatgggagcaggtggcacgcctgccacaagataaataaaatggaagcgggtggcacgcctgccacaagataaatgaaatgggagctggtggcacgcctgccacgaaataaatgaaatgggaggaggtggcacgcctgccacgagatacataaaatgggagcaggtggcacgcctgccatgagatacatgaaataggatcgggttgcacgccttcaacaagatgtggaatgaaagtgaaatctgcctttgttttccttatccttgttagtagttggttttttggttactttataattctcttgatattctacttttacttgttattccccgaagcatgttttcccccccttatctttacttgtttatttttgctttactttccactgtatattatataactacccatgattatttggtaatctggtcctagcatcgtcactacttcgccgaggttaggctatgcacttaccagcacatgggatcggttgtgctaatactacactatgcactatgtgcagacctcggagtagctcttggaccgtggttggagggtacctttagtccacgcaggtatccaaggtagacctgcagtcgtccgcaggctctgacgtctcctctatcttttatttcctgtttcatcttttgcttcagaaacactgtgtattttactctcagaccatgtatttagcagtcttagacggtctgtggtactatgacaccaggttttgggtgattaaggcttccgtagttgtaatagatacagatttaagatattttattatttccttccgcttaatttaaatttcagttgtttatgcgttatcgcttatgtttgtaaaaaaaagaaataaatgggtaatgaagtaattagtttaaaggattggctttcctagctcacactagtaggtgccatcacgactcccaagtgtgaaaaatctaggtcgtgacaagttggtctcagagctctaggttacatgggtctcacaattcacaaacaagcttagtagagtctgagtgatcggtacggagacgtctgcatttatcacccagaggctacaaagttaggaaaaaacttcacatttattctttcctatcgtgcagtttggcttctcaatgctaattgaatttctactctgttctttcgcaaatggcgagaacatgcgcttcctcatccagtgaccagcagcccgagaccccagcaacaactcccacgatgggaagagggcgaggctgaggccgggctagaggctgaggtaggggcatagctcagccccgagcagcaacaccaacatcggagcctcaggttaattttgatgatgaggttccagccctagcagttccggtgggtccagcccatgtcctagaggggtttattgctacccagtacttcaggatgctttggttcgtctagtgggccttatggagagtatcgcctaggcaggcttgcttcctgtagcaccacccatctctcaggatggaggaggagcccaaactcttgctactcgcactccagagcaggtagctccccagtttcaaactccagtagttcagccagttggagcagttcaaccgggtttggtatctcagaccgatgatagagcagcgatgtttgccgatactttgtgaaagttggacaggttcaccaagctcttcactactacattcagtggtgcatcttctgaggatacccaagattttctagaaagatgtcatgaggttcttaggaacatggggatagttgagaccaatggggtcgattttgctacttttcgcttgtctggatctaccaagacttggtggagagattactgtttggctagactagccggatcaccagctttgacttgggagcaatttactcagctatttctgtagaagtttctccccattacttatagagaggtctatcggagacaatttgagcatctccagcagggttccatgactgttacccagtataagaccagattcatcgacctagctcttcatgctcttgtcatacttcccactgagagagagagagagagggtgaggaggttcattaatggacttattcagccgattcgtcttcagatggctattgcgactgggagtgagatatctttcccgggagcggccaatgtggccaggaaagtggagatggttttgtcgtagggaggtggtcaggggtctgacaagaggcctcgtcattcaggctgattcagtggtaactcatctggaggtagggattcgtatggtagaggccatcctcctaggccttttcagtcagcacttcaggtttctcacggtacttcaggtggctttgtcctcagatgtagtattttgatcaacagtcctatattgcaccaccagctcctatcagtgcaccaccacttcatagtttccagggttgtcagccttagcagccgagggcttgttttacttgtggcgacatgaggcacattgctagttattgccttctagcatcgagcacctcagcatcagggttctcgttccatagtttaggcactgagtggtccgcaacctgcccaaccatctagaggtgggggtagaggtgctagaggtggaggtagaggtattataggttgagctcaggctgcttgaggtggaggccagccaacaacagtccgtcctagagatgtagttcagagtggggggcctagccccgatgttatgctcttctagctaggcccgaggctgagactttcgatgtagttatcacaggtatgatttttgtttgtgatagatgtcatacctcctttttcactacacctcgtaaagggtataaatacaaaggagtttttccaattaaaggacaatcgaaacgggatgtgtttgtttaaagattcagagtcgccacttgggataatttatggtgtctcaagtcaccgatattgaaacccaaatcgaggaaaaattgactctatttgacagtccgcgaaccagaaatccgattaaggaattctattaacccgggagaaggtgttaggcattcccgagttccgtggttctagcacggtcgctcatctattataatcggattaactatctgattttaatcaattatgaacctatgtgccgattttcactttttaacctcttttaattaatttttaaagaagattgcacgtcgtttaaaacatgtctttggatcttgacacatgaaatgcatccgcaatcctaaacatattttattcaatgttttaagacttgatttgggtcacatgaaatgcacacccgagttttaggaaggtaaattattaaaattgcgtgcctaaagcaactacgcgttttaactttgcgagggccatggaaaatttgctaaatggtgcgcttcgattctaatttcaaaggatgtttggactactcttttgagggccataaaatgtatgtttggttaatatagcacacctcaactatttaatgagcgtaattaattgattaaaagatataaatgaatttctacttattataagccactgttttagttaaactttaataactaatgagctagtaatagacaaaaccaatggttgattgttgaaaggcctagtctggccgtaagcccaacgactggccgcccattactgcatgcccagcacgagagacaactgggctcactcatgaagcccagactgataatctaattgcagaaggggaaattgatcacaactgggccaacgatggcagcccaatttcaagatttaaaactaatatttgaagtaaactacattcttatggagatttagagtttgaacaaacaccaacaaccttgagccaatgcaaaacacattcttgatgctaacacacttgctgaaatgaagttatagttcctgattatcaacaactcatatgtatgtcgtttcatcattgaaagtcactaattcaaatttccagcaagaagaaaacaatttaaagtttcaaaaagacttcatttattaacaatggacttggaattgcctaactctaaaccttgaaaaaaaagcaaacacaagctgatttcacctaaatcaaataagagattttcctgtattgcaacataacacacttcatgttcaaagaacaaccaatcttatgcatcttaaagttagaacttctactaagaacattgaaactaaacagtggcttcaatagagtaatacagccattcgaatcagctatcaaaatacaataacatgcaatgaatttgtttaaatgcctaaaccaaaatctggaagaggtaaataaccacaagttaattaacaaaactacatgattacagaaccaaataatcaaaaatagactaccgtaaaacatggtttcatcaacattctcatttccatttcaacatgtcatttgaggtcgaatgagtacctggttacagcaaagataaacaaagagctttgagaatcagcttaaagcaacaccaaggtagcaggcatagcagcagaggtcagcagtaaaaccaaatcaaacagtttccaaaaatccagcaatttcacctctttaaacaatttttaccttgataaaaccaaagttatttgaagcttttttaaattccagctgaaacccaagattagggagcagattcagatctaattcctaccccaaaagatgcagaaatttcaatgtattttcagaataacttctctcagtcgtttttgcttttcagtatttttggagtgttaaaaagctgcccggaaatgaagggaaagagatcatatataggcatgcctaaggaagacctagtacagttgaccaattccctctctaccccttctttcttagttgtttttaccctttttaaccttttagaaaaaatatctgaaaccctcagctctcatataatcctctagaaccttctatgctaacagaaaatgattccctcaaacctcaaatccctaaattaacccttgacccatgtattaccctcaggcaaccaaaattgggtcaagttatcccaagacccagcccaaacccatgggtatgtatactacagcccaaacttacaacttcagaccatcaattaaagagcattgaagctcaaatgatctgggatgttcaggacaaacgaaagaaaaatgcagggagggaaaagaaatgagtctcagagaactcaaatgatttaaaccaaaaagaaagagaaaaaaatatttaatcaatttagcaataattcgaaccttataaaccaaaatcgggtaaagccaaacaaatgaatcaagcaaaataaatattaaacaggcgacttaagagcatttaatcacaattatattctcaatgaactatgttaacgagaattcaaccgaaataagaaaaaaaatgatataaagaaggagaaacacatactaaagctatcagagacaggcatcatttaacaaacttgctggtttttggtcttgcatgaggccgatgagattcaaaacgaatcgaagtctatgctagtcactcgttctcaaggagaaaatttgggtggcataaacttcgaaccattatcggcccagaaatgcttgaactctgacatggggagcaagattagggtttatagaactttggtctttgatatgagatttgacgatctaggctatgattcgaaggtaacgggctagagatttgggatgaggggacgaagggggttccaaggtgttattttggggtcggaccgaggtggcactgccaccggagaacataagggcggcgctagggttttctttcaatctaagattcgagacatcctgggcttgttcgatggaaggtgctcgtagatttggactgagggagttgaggagggtatatggtgttaatttgggtggtgtttggaggtggcactgccaccggaggccggggatttgggggcggcttatctagggtttcggggtgtttgtggtgaaagtggtgagccgaagggattcttagggggggagaagggttttcggacagttaaatatccctggcgcttcagttctgagccgtttgatcaatgggagatcaacggctcagattgatacttattaaaacgacgtcgtttagtttgggggggggggaaaccgaccggatcaaggcgtaggtttgggccgggtattgggtaatttcgtttgggctggggacaattaaatgggttttagcccacatttggattttctttcacttctttcttttcttttttcaacttcaaaattcttttctttgcaaaattaaaataaaacctaaattaattaataataatttttaaactaaattaacctatccaattagattaatcactcatcatggtatttataataattaattaaatcctaaattaaaataaaaattatacaattgaaaattaaaacgtaaaaatgcaaaatgaattatttttttgtgattttcattttttataaacaaactaatttactaattaatctaaaaatataaaattaaatcctaaatgcagatgcaacatatgtttttttttcaagaattaaataaattaaacatgcacaggcaaatgcaaataattaacagataatgccacgaaatccaacaaaattgcaaacactgaaagaaattattttattttgaatttgttggagtaatacatataaggaaaaaatcacgtgatcacagctgcccctctttgcccggaaatacgaagagtttttgtgcaaagataagtgagcgaatacgagcgatttttgcccgtttgaatactccgcaggaagcattttttgaaagatttgaccgcaccctgcttccgaggtttcctacatatccttggctaaaagggaatcaggtcagtgtagttcgggaatgtctgttagttgggactaccatagagctgtgatttcactgttgctgtggctgctgctgctcactgaacacctcattacaccatgtcaaaaataaaagaagctaaactagactatgatctatgctttacaaaatcctatatagatattcaaacttgatcttgtgtctcttgttgccttattcccttgtattctctcggtaaaattccttcattgccgccttgaattgtaaattgagatgtttccctttctccaggtagatgtctgactgctgaactcgatgtgtaatcccatgctatccaggtgggttcctgacttcgaaacatgaatatattcccatgctatccaggcggactcctgacttcaaaacatgagtgtattcccatgctatctaggcgggctcctgactgctaaactcgaaagtattccctgctttccaggcgggctcctgacttcaacttgaaagtactccctgctctccaggcgggcttctgacttcaaaataaacatagcaaagaatttgaaagctaaaacgtaaatggtactcccttgttctccaggcgggctcctaactgctacgcttgaaagtatttcttgatctccaggcggtttcctgacttcaaattgaaatgcattcactgctctttaggcgggcttctgactgctgcatttgaaactatttcctactctccaggcgggcttctgacttcaacaaaatagacaaaacaaagaaacttttctaccccagttggtggttgggcacaggtgtaagtgttaaactgaatcatattacccaatattactaagaatttgaaagctaggtcctattatgcaagggggtcttgacaactcttaactaaacgacaattttaaatctaagttatatcttctacaggtgtgacttctgctaaatcttgctatctaagagaatctttaaactactactcattatctaggagggtcctgaaatcaaaagtcaagttttatcataagagtgacaactttcatggctgaattatactaccctacagcagaacctacgctaaatgttattgtccaatcgaaatcttaaagctaagttccattattcagtagggtcctggaaacgcctaactgaatcctatctcgaacaagcaaacttctaagccaacttatatcaccttgggatacatttatgctagattatactatttctgaactttaaactaggtcctattttccaggagggtcctgaaagtttacgggcaaacctgttttgatgcttgctctttcccctgcggagagtttctccgaaacaaacgaattatctgcccatgtttcaatcaaagaaaatttggtcagtttaaaatggtggttagctgatggcattctttttggagatctttccactgcattgttttgttccgaatggctttcccgaactggccttgaaccgctttgactttccgactgactttcaaatcccatggtctttgatgaaccgagtgttctatacccgtgttgttgtttcacacctctgaccccttaatctgaacctttgcatctcccatgacattactaaatcattccaccgatgaaacttccggtgattccttgtaccccaccctacatcatgttgtctttagtatgctctgaccacattgtgatttgcaattttgggagttggtagtgagctttgaaacttttttccacttacttgggacaacactgacattaaaacctcttagaaaaataaactcaaaagaaaatgaaatgtaatgactttacgggttaagtataagaagaatccaaaaccagataacttctacaaagggaaaaagaaaaagaaacttatctgagtggaccagctggtacaaatgatcatgacatgcatttcggattaattggcccaatctgtccaaccaatcaactttcagttgccgtactttgtcgcctcagaatttccatgacctgattactttacccaaaccttgaccttgttcatcctgcactgccttgaaacagttttccaccaacagtcctttctcacttgttgacttttcaactaactttcaccaaggtgcccgtgagggttttcaccaataagactctctcattttatttctctcaactctcgtcgccttatggtgcttgtgaaggttttcactaataagactctctcatttatttttcctgcttgaaccagagtgttgcccctgacatgaattacctttacctgctcgacttggcatttctcaaagactgatcagaaggtctttctttggaccgtaatgtgggattttggacaaggttagaaagaaaaggcataaaaggctcaaaataattcaaatgggttaaaattacaactttcagaatcagacttctcataacgaccacgacttttgccccagttttcttccttggggacttttgaatttttattttgatgagaccgaaccgtgaggctacctatgtatccttaaaagaaatcaggtcgaatgtagttcatgtcatagaaattacttgttgtgattttctcttttctctttcttttctttctctttttttgctttctttttctctttttgttgtttttcttcttttcttttttttttcttttcattcttttctttctgttttttcttttattatcttttttttcatttcatttttcttctctcccttttcattcttttcttttctccttttcctttacttatcttttacacttctgtttctgatcttttctactaattccgaaagaggggtaagaaaaaaaataaataaggctcaaaaggggtgacgagggatcaagtgtttagatagcagaacaaaacgcctttgctatttcaatcttcaaaatatgccaaatacaaacaagtacaatcaaacaaaaaaatcatacatagtatctcttgactgcatcggaattgatagccattttcacacatttcccttctacatctgtcaaatataacgcgccattgaacaacactctagttacgacaaatggcccctgacccacttcgaacttccgtggatgtaccttcttgttatatgctctcgccattctctattggtacaattggccgtgacatactgctgccaatctctttttatcaatcagacttaattactccagtcgggttttgacccattcaacgtcatcaatttctgcctcaacgacaatccgaagggatgggatttcaatttctgcgggtattactgcctccatgcaatacaccaacaaataaggagtggcccctactaaagtgcgaacagtagtgtgataacccaacaatgtgaaaggtaacttctcatgccactatctagaaccttccaccattttttgaagtatcttctttatattcttgttggctgcctcgactgctcaatttgccttagggcggtattaggtggaattgcgatgtataatcttaaactgctgacatgtctctgtcatcagatgactgttgagattagtgccattgtccgtgatgataaccttcggaatcccaaaccgacagatgatatttgaatgcacaaaatagactactgctttcttggtcacagatttgaaagttttcgcttctacccacttggtaaaataatcaacggctaccagaataaacttgtgtccatttgatgctgctagctcgattgtcccaatgacatccatgccccaagcaacaaagggccatggtgccgacattgtatgcaattcagatggcggggaatgaatcaaatcttcgtgcacctggcattgatggcacttgcgcacaaaactaatgcaatctcgctccatagtgagccagtaataacctgctcggagaatcttctttgccagaacgtacccactcatatgtggtccacaaactctagagtgtacctcagtcatgataactgtggcctgtttggcatctatgcatttgagcaatcccaaatctggagtttttttttatacaatacacctccactgaagaaaaatccacttgccaatcgtcgaattgttcttttctgatcacctatatcctgtaccggatatacccccatcctgaggtactctttgatatcatggaaccatggatccccatcaagttctttttccaccatattacagtaaacatgttgatcacggacctgaatctacaaagggtccacataagccttatctggatgatgtaacattgacgccagagtagccaaagcatcagcgacttcattatgtattcttgggatatgcctgaattctattgattgaaaccgttgatagagatcatgcaaacattgtctgtatggtatgagtgtcaaatcccgtgtttcccattctcccggaatttggtgcaccaggaggtccgagtcacccaagaccaagacttcctagacacccatatccacagctaacctcaaacctagaatacatgcctcgtactcagccatgttgttggtacagtaaaaacaaagctgagccgtaacagggtagtgcttccctgtttcagcaataagtactgctcctatccccacgcccttcatgtttgcagccccatcaaagaaaagtttccatcccgacttctcaacttgctccaactcatcaatgtacatcacctcttcatcggggaaataagtttccaaaggttcataatcttcatcaaccgggttctcggccaaatggtccgccaagtcctgtgcctttattgcagttcgattcacatagacaatatcaaactctgtgagcaggatatgccactttgcaagcctccctgtgcgcataggcttctgaaagatatattttaatggatccaagcaagatatgagttaagtagtatacgatgacaaataatgtttcagcttctgtgccacccaggttagggcgcaacatgtcctttcaagatgagtatacttaacctcgtatgacgtgaattttttgctgaggtaatagatggcctgctccttcctgccagtgatatcatgttcacccaatacacaaccgaatgaattgtccaaaactgtcaaatatagaatcaaaagtcgccctggttttggcgggaccaacatgggtggatttgacaaatacccatttaacttatcaaatgcctcctgacattcatctatccatttgaccgcatcgtctttctttaatagcttgaagattggctcgcatgttgtcgtgagctaagcgatgaacctgctgatataattcaatctccccaacaaactaatcacctcggtcttgttcctcggaggtggcaattcctggatggccttgactttcgatggatccaattcgatgccccggcggctgactacgaaccccaacaactttctatacggcaccccaaatgcacactttacaagattaagcttgagattgtacctacgaagccttcgcaagaacttcttcagatccctgacatggtcagactgctttctagacttcacgatcacatcatccaagtacacctcaatttcctggtgtatcatatcatggaatattgatgtcaatgccctcatgtaggtttccctagcatttttcaagctaaatggcatgacccgatagcagtatgtttcccacggcatgatgaatgccatcttttttgcatcttcctcatccattaagatctgatgataacccgtgtaacaatccacaaaacaaccaatctcatgtttggcacaattatcgatcaagatatggatattcagtaatgggaaattttcttttgaactcgccttgttgagatcccgatagtcaacacacaccctggtcttgccatacttctttggtagaggcacaacattggctaaccaggtgggatactggggtgacccgaatgactttggcatcgaactgcttggtgacctcttccttgatctttacactcatatctgttttgaactttctcagcttctgtttgacaggagggaatgccaggtcagtgggcaacttgtgaaccactaaattagtgctcagactcagcatgtcatcgtaggactatgcaaaaacatctttgtattcgaatagtgctttaattatctcctccttgagtagaggttcaagatatacacttattgtagtttcatagacattatcttggtcccctagattaactgcttctgtatcgttcaaattaggtttgggattttcctcaaaatgacttagttccttactaatttcttcataggcctcattatcatcaaattccaactcgttatcacactcaatttcttgtattattatttcagagttagattggcttttgaaactaggccgaagattcctcatgcatgtcatgtcattaataccaacataaaaagaactgtacaatagaagaaaacaaaaataaaattagaagaagtgaagggaaaggaacaattgcactttattgaatataaagataacagggttttaacacatccaactagatggaacataatatctgaattacagaccctggaataatctagacaactaaaagaaaatcaaaaccaactaccaagactccctccgggtaggaagatgagtagcttcccagttgttgacttttgcacgtggtcccacaaattgcacatctgccctgctggacccttccccagcctgaaccatgttaacctcggcaaataacctttcgaaccccttctccaagtctccatcggcaccaatcagtgatccaggaacctttgacagctgttgctttctgatacccggcatgacgaatgatctagacagacgtgggattggctttggcaatgcccatgctttctgtttcatttttctagatcttctcacatctgcaacggtagtcttgaaccgcagaccaaaagtatccagattctttggaagagaaactggttgcacaataccttgtagagttgcacccaaacccttgcccggtatgaaaccatttttcaacatttcaacagctaccatgactgatgcagtatccatcttaggagttggagctcactttccttccggaattttctctaccgatactgtgtcgaaaacttgataaacccatggtcccttgccatcatcaacctctacgaacggaacaatggcagcattgggcacacacaagttatcttcaccatgtacaacaatttcttgtcgatctcattcaaacttgaccatttgatgcagagtagacgggactgctttggcagcatggatccagggtcatcccaacagtagattgtacgaaatagccacatcgagcacttggaattccatggtaaattcaactagccctattgtgagctcaagcactatgtccccgactgaatctttccctccactgttgaatccccgaatgcaaattttgttcttgtgaattctttcatcctccactttcagcttggtcaatgtggagagaggacaaatgtttgcgctagacccattgtcaaccagtacccgagtaaccatgaaatcttcgcatttcactgtcagatagagggctctattgtgctcggtaccctccacgggaaactcatcatcagaaaaagtgactttgtttacctcaaatatcttagtagctatcttttccaagtggtttaatgagattttgtcaaggacatgggcttcgttcaagatctccatcaaagcccgacggtgttcgtctgaatagatcaataatgacaagagcgagatctgagttggtgtcttccttaactgctccacaatggaatagtcttgcactttcatctttctcagaaattcctcttcttcttcctcaatcaccgttttcttcaccaatactggattatcttttgaggtcttagcttttctcaactcttcgggggcgaagcatctccccgatcgagtcaaaccatgagtctcacacacttcttctctaacctatttccccttgtaagtcactgtcactcattcataattccatgggattgccttgctgctaactattagtaattgggttactggtttgataatgataggacctgtggggagcccttcacaattaccacaggtttattcatcactcctagcacaaccacttttgctttttcatgttttcctgcaacgtcacttgaggaccccttcttgacctccatagatggttcattatttgccctgttcaacttgatcatagacttcttactggttgacttttcaaatggcctggcttcactagccgaatcatcatgacggtttgcgaaggctttttaggctcccctcccctatgcactatctcaatcatatttgtttcatgattggctggcaagggattctgattgatattgggcgcctccggagcttggacctcaatccgattggtgtcaatgagttcttgaatggttgttttcaatttccagcatttcattgtgtcatgtcccggggccactgaacaatacttacaactcaccgagtggtcaagatttttgggatggggattcgacaatttaacctcgatcggattaaacatacccaactatctcagtctgtggaatagactagcatatgattctcccaatggagtgaaagtcttttgcttctgcaacctctcattattaaattcttgtttgggtcaaaaacccgttccaggaggatttctgtaggcctttgggggtggatagttattttgtggagcttggtatgggttttgtggagctagcgcatgccattgtgagtgagcgggcggctgggtataggtttgttcatgatggacagaaaaatagggatctagcggcgggtaatagtgttgtggtgggttatatgaagtgtgggggtaagtttggggatagggtcgcggttggttgtagtaacggggaaggttcctggatctgacccaagctcccgactcaattgttgcaacatcctcctccttcttcttcccgagcactcccccagtaccgttttaaatggcctgagtggttgccatgattgctgaataactcatgatcttgttggacttgagtccctctttgaccatgcctcccattttcactacttcattaaaggaattacctacaacagacaccaagtgaccaaaatacgtgggttccaaagcctgtaggaaatattcaaccatctcgctttcattcatcggagtgttaaccctcgctgcttgctctctccaaaggaatccatattccctgacgctctcaccgggcttcttcttaagatttgtcaacgacagacgatctgggataatttcgaggttgaactgaaaatggtaggtgaaggcttgggccaaattgtcccatgtgtaccacctaatgtgatcttgtctggtataccactctaaagtcgatccactaaaactttggctgaaatatgccatcaacaattcatctcttccacctgctcctctcatcttgctatagaatccttttaagtgtgctaccgggtcaccatgcccattgtatagatcaaacttgggcattttgaaccccactggcaactgaacatctgggaacagacattaatccttgtaggccacacttacttgacctcccaaccttctcatatctcggaatgactattctatgcttttgacctttctgatcatctcttcatgctcgggatttttgggtggcttctcgatctctacccggagatcaagatgaggggtgtaaggatatgattctggaactttgaaggtgggttaagggggatagtactggttgtcgtgagtttggaacaggggttcactggaagatcggtgtaacatagcaggtggaggtaccacaaaaataggtgcgatttgtgggggagggtatgggacttgtttgggtggtggaacttgagaagtatgggaagtggcgccatggcattgttagtagaggggaaaggctggagatgagttcacagtgggaggctctgtgagttaggctgatggtgggatataagtagggttggcgggataaaccggtggtggatgccctttcgcccatgcttggtacatttcagccatctgctgcttcagcttatacatttcttcgctcattgcattaacgtccaattcttccacttcttccgatgggtcgacagtgcttgtttccggttcctggttggccatattcagcctgtctttcgatcgggtgttgtatgagtgagttgccagaatgccagtcaactaaccacctgcctggacttaatacatcaaacaacaaccttgttagcgattaggctttaacagattggcaaccacacattgggcatgaatgcacctaaacagttaaccgtctctattatgtatttgatcggttgcatgcatcatcccgatcttttctttctttttaattgcaaacttccccctttttctttcttttttgttcccttcctttcaatctttcctccgttctcactttgtttttactctctcttgatttcttattttatctcttttctttcttgtttttccgctcttttcttttctttactctctttttttctctctctctcctttctctttttctttcattgtcttgtttttcctcgtattttctttttcttttttttttggttacggtcgaatcttgtggagattgcctacgtatcatgaccctgcatgaatcaggccaaatgtagttctttgagataagagcgaaataaaacatttttgggattttcagttttcataaaaaaacaaatgcttccattacaaaactcaaaaatagaaacttccaaaagattaacagatttcgatgcaaagatgaaatacagactccgaaaatagacatcatattccaacagaagaaaatatagactcgaaaacaatttgacagactctagcagaaagaaaaacttaacatgcctgacagacgcttaacaaaagagaaatgcagactcaagcgaaaaaatcatgaatacatcaatgctcctggtgtccgcgggacatcattcggtctcgccacaggcctatatgcaagctccctttgaagtcaatcaaagtcgttcattatctgtttaacaaatgtcattactgctgcaatgaaggtagtgcgggtcatatcctcacaaatctggaacttcataacgatgtagttagcaatgcttctaattatctctcttatggcgcccttttcttgtaacaaatgcccaatctgctgggccatggcttccaaagtttgctcagccgtatgattttgctcctgaagttgttgcaaatctatttctaattttgccaatgttgtataacaatgttccctttcaactttgaagtcttttgcctgtttgataattttgttttccatggcgatgaccctcttctttaaccctgcgacctcatcgtcgtacctttctctcaactgcttaaccaggcatactcgttcatctgcatttttagacaattgctttcgagccttggctagttcactttctgctttattcaaatcaaaactatagtcatttactttctgcctcaggttagctatgagtttttcatctctgtcgcttcgggatggattttttgccactaccatcattttctgaatttgagctcgaagggcctcatttttttaatcaactttttcttttctccttcattcaccgcgacttgcaggctattctcgaattgaagttctctgacttgcttttacaatttgcttatggtagccctgtactcattttctttggtcagctagtcccattgcacttgtgctccgttggtgaatcattggacatggggtctctttgcgggcctgtcaagttcatattgaactcgagatcttttaccataccaagcagtgtaactaggctccacctcgcctctggataggtctcgtacttgagtattaggccctaagaatctgcactgatgccaaatccggcgcactttctcttttatgaaggcaacttttggatctaactcaatgacttgctagctcaaatcttcgtcgtgtgggatggtctggtaacggcccaactgacgcaagactctgtgtggagcataatgctggatactccgaagacccatcaacagcaacaaacacacctcaaccgacatatagattactttgttgaccttgagccacccaaatgtccattcgatcttattagcggtcaaggatctcgaatgagtatgccgtgcttccgtaccatctggaagctcataatcctctattctcttttcatgtttttcaatgcactcaaggctagttataccgcaattcaagtagccgggacggtagcaaaggtgttcctccatccatatttgtaacaacatattgcaccctttaaaaaactttgctccttcttgacagagagtgagagctcggtaaatttttgccaagatcagcggcactatagtcccatttgcctttttcaacataaagtcgtctatccctactatccccatctctatgttcccatcttttctcgggcaaaccaagacacccaagaacgtcactatgcaagctaatcctcttcgagcttcccacttgtcttgatttccaacatgagtaagaccggtatctggtgtttcgaagccacgtcgattcccgtaacgtcgatacagaaagtagaaggtacaaaatcctttagccagatttccgtatcggatatcccgactgatgcttaacaaatccaaaaatttgtgggaagtcactattcttggtgctatcgggtattgacttctgatattcccttcgaaaccggcatagcctactatctcttctagcgtaggatttaactcgaaatcagcgaagtggaacacattatgtgttgggtcccaaaacggtatcaaggcctcaatcacgtcttttctgggcttgaccttcaaaagcccaataagaccgcctagttcttttgtcacaactttcctactgttgcccctcaaatcatgccaccacgtatgtagctccagagggatctcttcacggactgagaaaggttcattttgatttgtgctcatcctgcacatttattaaggtgattgtaattaaaagaaaaccatgactcttttgacttaagagaaatgaccattttcaaaatttccacaaaacattcggccttgccaacacgacctttcagcacttcgaaaacgaagattttaaggccgtgtcagctaaccagccaaaacctttaaaagcgacaaaagtggttgttcttgcaaaagcagacttctggcgcccttttagggacattcgactatttttgacaagaacgacatcaccataattattaaaaataaatttttttcttttggctactttcgcaaaaaagaagttggacccgatgggggttgcctacgtatctcataccctgagagaatcaaactggcgtagtttgggtaaataaaacaagctactttttatttgaaaacgactgtttttccatttcattggcaaataaaactatttttgaaaatgccaacctttgtttctcctcttttttttgtttttattttctcaaaaattcagtagagtttcgacactgtttggacgttgggtttttcttctttttttttctttttctttcttctttttttagaagaggagattaaatctctttaaccctcatactactattttcctcaacttttccaaatattcataaatcggtcagcatgaagtagaaagtaggatgcatcaagatggtcttttagtttcgggtgcacctgtcctagacagacccaacccctgtgttgagtatccaaagccaaaatgcacatgatgcaaacaaacgttcctaccagggatccggcgtgaggtcttgttatactaggttcaaaacctgggtttattattctagacctagcttacccgagcggacagctcgagccgaggggggcagcgtaccgggaatacagaagcttcaccggctttgcaacttgtccgaacctcattctaaatttggaatatgactctaacagaaacgaagtcacatgaagtgcacacttcttcatgatttaactcagagagaagagggatttcacaacagtttatatacagttcacggaatatcaaagcggtaaaagcaatcaattagcacattaggcccaaatcatataacaatttcagataatggataatgccaactataacaattcatcccagctcgaattcttgaaccctgaactagagattctgggttcgatctccagtagagtcgccagagctgtcacacctcctttttcactacaccccgtaaagggtataaatacaaaggagtttttccaagtaaaggacaatcgaaacgggatgtatttatttaaagatttagagtcgccacttgggataatttatggtgtcccaagtcaccgattttgaaacccgaatcgaggaaaaaatgactatatttaatagtccgcgaactagaaatctgagtaaggaattctgttaacccgagagaaggtgttaggcattcccgagttccgtggttctagcacggtcgctcaactattataattggcttaactatcttattttaatcaattatgaacctatgtgccaatattcactttttaaccgcttttaattaatttttaaagaagattgcacatcatttaaaacatgtccttggatcgcgccacatgaaatgcacccgcaatcctaaacatattttattcaatgttttaagacttgatttgggtcacataaaatgcacacccgagttttaggaaggtaaattattaaaatagcggcctaaagcaactacgcgtattaattttgcgagggccatggaaaatacgctaaatggtgcgcctcgattctaatttcgagggccataaaatatatgtttggctaatatggcacacctcaactatttaatgagtgtaattaattgattaaaagacataagggaatttctacttattttaagacaatgtttgagttaaactttaataactaatgagctagtaatagacaaaaccaatgtttgattgttgaaaggcctaggctggctgtaagcccaaagactggctgcccattactacctgcccagcacgagagacaactaggctcactcatgaagcccagacttataatctaattgcagaaggggaaattgatcacaaccgggccaacgatggcagcccaatttcaagatttaaaactaatacttgaagtaaactacattgttatggagatttagagtttgaaaaacaccaacgaccttgagccaatgcaaaacacattcttgatgctatcatacatgctgaaatgaagttacagttcctgattatcaatagcttatatgcaggtcgtttcatcattgaaagtcaccaattcaaattttcagcaagaagaaaacaatttaaagtttcagaaagacttcatttagtaacaatggacttggaactgcctaactctaaaccttgaaaagaaagcaaacacgggttgatttcacctaaatcaaataagagattttcctgtattgcaacatagcacacttcatgctcaaagaacaaccaatcttatgcatcttaaagtctgaactactactaatcaacattgaaactaaatagtggctttagtagagtattacagccatttgaatcagctatgaaaatataataacatgcaatgaatttgttcaaatgcctaaaccaaaatctggaagaggtaaataaccacaagttaattaataggactatatgattacagaaccaaataatcaaaaatagactgctgtaaaacatggtatcatcaacattctcatttccatttaaacatgtcatttgaggtcgaatgagtacctggttacagcaaagataaacgaagagctttgagaatcagcttaaagcaaaaccaaggtagcaggtatagcagcagaggtcagcagtaaaaccaaatcaaacagtttccaaaaatccaacaatttcagctctttaaaccatttttacatagataaaaccagagttatttgaagccttttaaattccagttgaaacccaagattagggagctgattcagatctaattcccaccccaaaagaagcaaaaatttcaatgtattttcagaataacgtcactcaaccgtttttgcttttcagtatttttggagtgttaaaaagctgcttggaaataaagggaaagagatcatatataggcatgcctaaggcagccctagtacaactgaccaattccctctctaccccttctttcttagttgtttttaccatttttaaccttttagaaaaaatatttgaaaccctcaactctcatcttatcctctagaaccttctatgcttacagaaaatgattccctcaaacctcaaatccctaaattgacccttgacccctgtattaaccctcaggcaatcaaaattaggtcaagttatccaaagacccagcccaaacccatgggtatgtatactacaacacaaacttacaacttcagaccatcaatcaaagagcattgaagctcaaatgacccgggatgttcaggtcaaacgaaagaaaaatgcagggagggaaaacaaacgagtctcagagaacttaaatgatttaaaccaaaaagaaagaaaaaaacatttaatcattttagcaataattcgaaccttataaaccaaaatcgggtaaaaccaaacaaatgaatcaagcaaaataaacagtgaacaggcaacttaagagcatttaatcacaattatattctcaatgaactatgttaatgagaattcaaaggaaattagaaaaaaaaatgatacaaagaaagagaaacacatactaaagctatcagagacaggcatcgtttaacaaacttgttggttttgtgtattgcatgaggccgatgagcttcgaaacgaatcaaagtccatgctagtcactcgttctcaaggagaaaagtcggctggcataaactttgtaccgttatcagcctagaaatgcttgaactctgacaaggggagcaagattatggttcatggaactttggtctttgatctgagatttgacgagctaggctatgattcgaaggtaacgcactggagatttgggatgaggggacgaaaggggttccagggtgttattttggggtcagaccaaggtggcgccgccccagagaacacaaggaaggctctagggttttcttacaatctaagattcgagacgtcctaggcttgatcgatggaaagtgctcgtagatttggactgagggagttgaggagggtatttggtgtaaatttgggtggcgtttggaggtcgcgctgccaccggaggcccggcatttgggggcagcttagctaggatttcggggtgtttgtggtgaaagtggtgagccgaagggattctggggggggaaaggttttcggacagttaaatatccctggggcttcagttctgagccgtttgatcaaggggagatcaatatctcagattgatacttattgaaacgacgtcgtttagtttgggggggcaccgactgggtcaaggcgtgggtttgggccaagtattgggtaatttcgtttgggctggggacaattaaatgggttttagcctagatttggattttctttcacttctttcttttctttttttcaacttcaaaattcttttctttgaaaaattaaaataaaacctaaattaattaataataatttttaagctaaattaacctatccaattagattaatcactcatcatggtatttacaataattaattaaattctaaattaaaagaaaaattatacaattcaaaattaaaaagtaaaaatgcaaaataaattatttttctgtgattttcattttttataaacaaactaatttactaattaatctaaaaatataaaattaaatcctaaatgcagatggaacatatatttttgtatttttcatgaattaaataaaataaacgtgcacagacaaaagcaaataattaatagaaaatgccacaaaatttcaaacactgaaagaaattattttgttttgaatttgttgaagtaatatatatagggcaaaaatcacatgctcacaatagagatgtttcggtgttatttgattcaaggtctacatactcatatgtgtcatcttattttgtatagtatctggtcatgcctagtgactctttgagtgctcctgtttatgtgtctacaccggtaggtgattgaattttggtacatctagtccatcgttcatgtatagttgtgattgggggtcttgagactcgcgtagatttgttacttctggacatggttgatttcgatgtcatattggggatggactggttatcaccttaccacgctatcttggactgtcatgccaagactgtgaccttagcctcaccgggtttacctcgtttagagtggatagggactcctggtcattctacccgcagtgttatttcgtatgtgaaggctcagcgtatggttgagaaggggtgtttggcttatttggcctatgtcatgattctagtaatgaggtcccatctattgattctgtgcccgttgttcgtgagtttcctgaggtattctcttcagacctgtcaggtatgccacccgacagggatattcacttttgcattgatttggcttcgatcactcagcccatttctatcctgttgtattgtatagccccgcctgagttgaaaaagttgaaggtgtagtttcaagacttgcttgagaagggtttcattagacctagtgtttcaccttggggtgcgccggtgttgtttgttaagaagaaagacggatcgatgagaatgtgtattgattaccgccagctgaataatgttacaatcaagaataagtattcattgctgaggattgatgatttatttgatcagctttaggctgccaaggtattttcgaagattgacttgagatctggctaccatcagttgaggattaggacatccgatgtccctaagaccgctttccgcacttggtacgggcataatgagttctaggtgatgtcattcggggtgacaaattccccaagaacttttatggatttgatgaaccgagtgttcaggccttacttggattcgttcgtgatagtcttcatcaatgatattttgatatactcccgcagccgggaggagtacgagtagcatcttagagtggttcttcaaaccttgtgggatagttagttatatgctaagttcttgaagtttgagttatatttgacttcagttgcattcctgggtcatgttgtattagcagagggcattcaagttgattcgaagaagattgaggtagtcaagaactggcctagaccagcatcagctacagagattcggagtttcttgggattggaaggctactattgttggttcgtagaggggttttcatctatcgcagccccgatgaccaggttgacccagaatggtgcccagttcagatggtcgaataagtgtaaggcgagcttccagaagctcaagacagctctgactatggcaccggtgttggtttttcccacaggttcagggctatatatggtctattgtgatgcatctcgtattggacttggtgcagtgttgatgcaggatggcaaggtcattgcctatgcttagcggtagttgaagattcatgagaagaactatcttgttcatcatttggagttggcagccattgttcatgcgtttaacatttggaggcattatttgtatggcatgtcttgtgaggtgttcacggatcacaagagtcttttgtatttgatcaagaaaaaggagctgaatttgaggtagagaaggtggttggaattgttgaaagactatgatatcaccatcttatatcatccgggaaaggccaacgtggtggtcgatgctttgagtaggatgtcagccagtatgggcagtcttgcttatattctagtcggtgagagacttcttgctttggatgttcaggctttggccaatcggttcgtgaggttggatatttctgagcccagccatgtgttagcttgcacagtcgcttgtttttcattattggagctgatccgagatcggcagtatgatgatccccatttgtgtgtccttagagacatggtgcagagtgccaagcaggttaccttaggtgatgatggagttttgaggttgtagggtcgagtttgtgtgcttaatatggatgggcatcgagagttgattttagaggaggcctatagttcccaatactctattcatccgggtgtcgctaagatgtatcaggatttgcggcaacattattggtggaggagaatgaagaaggatatcgttggatatgtggctcggtgtttgaattgtcagcaggttaagtacaagcattagagacccggtggttttttctagaagattgagattcctgagtggaagtgggagcgtaccaatatggactttgtgattgagattcctgagtggaagtgggagcgtatcaatatggactttgtttttggactcccacggactcagagaaagttcgatgcagtgtgggttattgttgataggccgaccaactcagcacatttcattcatgtggcagtctcatattcttctgagaggttagttgagatctatatatgggatattgttcgtcttcatggtgtgcctgtgtctatcatttcggaccaaggtacgtagtttacctcacttttttggagagcagttcagtgagagttgggcacacgggttgagttgggcacaacatttcattctcagacggacgagcagtccgagcggaccattcagattttgaaggatatgctccgatcttgtgtcattgactttggaggctcacgggatcagtttttgcctttagcagagtatgcctacaacaacagctaccagtcgagtattcagatggccccgtatgaggctttgtatggtaggtagggtcggtcgccagttagatggtttgagacgggagaggctcggttgttgggtacgaatatggtttaggatgccttggacaaggttaggattattcaagataggcttcgtacaactcagtccaggcaaaagagttatgccgaccacatggttcgtgatttggcattcaagtcggtaagcgggtattgcttcgagtgtctcctttgaagggcgtgatgaggtttgggaagaagggcaagcttagccctaggttcattggcccgtttgagattcttgatcaagtaggagaggtggcttatagacttgcattgtcgccgagcttagcagccgtgcatccagtgtttcatgtgtccatgcttcgaaagtatcacgtcaatccatcccacgtgttatatttcatcactgtccagttggacaaggacttgtcttatgaggaggagcctatagctattctagaccgacaggttcgtcagttgagatcgaacagttttccttctgttcgtgttcagtggagaggtcagcttgttgaggcatcaacctgggagtccgagttcgatatgcggagctgttatccccatcttttccccaatacaggtacttccttcttatgtttgttcgaggatgaacagttgttttagaggtggagaatgcgatgaccttttgcgtgcgtagtccgggcgcgtagccggaaagatattatgtgaatatctatgaaaaatgataaattttgactataaaatgaattaatttgacttcagtcaacattttgggtaaacggacccagacccgtaatttgacggtctcggagggtccgtaggaaaatatgggacttgggaaaatgcccgaaatcaaatttcgaggtcccaagtctgcaggcttcgcaaatgcgaagcttggattgcaaatgcgagacctccatcgcaaatgaaaaaaaaggacttgggcaagcctgatcgcaaatgcgaccacttggctcgcaaattttgaaggcccagtcgcaaatgcgatgcctgcttcgcaaatgcgaagttctccttttgtgtcggaggtcgtaaatgcggcccaaccttcgcatttgccaacatagcaattcccacatctgcaacctacaacttttatacttagacgaatttttaacccattttcatatcctctcaaaacataaacactctaaggcgatttttcaaaggcttcttcgtctccaaatcaattgtaagtcatttttaactagttttcttcaatccttaacatcttctaacatgatttcaactcaaaatcaatgagtttcatgggggaaattgggtgttttgggtagaacctaagttttttcaaaaattggggatttggacctcgatttgaggtccgatttaaaaaaaacataaatatttggtttcatggggtaatggggaatcgggttttggtttgaacctcgagttttgaccatgcgagcccgggggcgatttttgactttttgggtaaaactttgaaaaactcattttcatgcattgggttgatttatttagcatttattgatgtaattaagtaacttgtggccagattcgagcgaattggtggttgaatcaaagggtaaagctataattgaaacgtgaattgtgttcgtggcatcgaggtaagtgttatgtctaaccttagcttgaggtattaggattcgtgtcttatttgttacgtgttaattgtggagtacgacgtataggcatggggacgagtatctatacgttagggtcaagcatgcctgtgaatcttgtattataattgttatgactccgttgtggtttatagtgtttcacatgttattattatcattgttcccttgacgggatgtttgtttgatatcattgttcccttgccggtatgtttgtttgatattattgttcccttgacgggatgttgttgaaatattattgttcccttgccgggatgttgtcgaaatatcaatgttcccttgctgggaagtcgcaatattactcttgttacctagccgggattctttgtggttgttgttgatttgtaactgggatcgggtggcacgcctgccacaagataattgaaatgggagagggaggcacgcctgacacaagataaatgaaatgggagcgggtggcatgccttccacaagataacttaaatgggagcaggtgccacgcttgccacaagataaatgaaatgggagcgggtgacatgcctgccacgagataaatgaaatgggagcgggtggaatgcctgccacgagatacatgaaatgggagcgggtggcacgcctgccgcaagataaatgaaatggaaacgggtggcacgcctgccacaagataaatgaaatcggagcgggtggaacgcctgccacgagataaatgaaataagagcgggtgtcacgtctgccatgaggtacatgaaatgagagcgggtggcacgcctgccacgagatacatgaaatgggatcgggttgcacacctgcaacaagatgtaaaataaaggtgaaatctgcctttgtttttggttcctttataattctcttgatattctgtttttacctgttattccccgaagcatgttttcctcctaccatatttacttgtttatttctgctttactttacgttgtatattatataactgcacatgattatttggtagtctggtcctaaccttgtcactacttcaccgaggttaggctgggcaattaccagcacatgggttcagttgtgttgatactacactctacactatgtgcagatcccggagaagctcttggactatagttggaggctaccttcagtccacgcggagatccaaggtagacctgcaggcatccgcaggccctgacacctcctctatcttttatatcttgtttcatattttacttcagaaatagtgtgtcttttactttcagaccttgtatttagcagtcttagattgggtgattaaggcttctgcagttgtaatagatacagatttaagatattttattgtttccttctacttaatttaaatttcagttgtttatgtgttattgtttatgttttaaaaaaaagaaacaaatgggtaatgaagtaattagtttaaaggattggcttgcctagctcacactagtaggtgccatcacgacccctaagggtggaaaatccgggtcgtgacaggaattatttatgagttttggaaatgaaatgcatttagaatttgatggtatcgggctcgtattttggttccggagcccggtacaggtcttatatgtgatttaagataagtttgtaaaatttggtaagaaacggaagtcgtttgagttgtttcggacccatagttgtgaaaattgatactttgaaagttttgaattttttcttagatttctatgctaagttcgttgtttaagaggttattttggctatttgaacacacggataagttcatatgatacttttgagttagtatgcatgtttggtttggagccccgagggatcgggtgagttttggatgggtttctgaaggttttgaacttaggaaaaattgtaggttattgtgttttgggaaaaatggattggttacgagttccttattgttttactgtaaattctaaaccttatgtctttctcttaatttactgttgatattgatattcccccacagcatgtaccccctcccatctttacttggttattcctgttttattttccgtagcacatatataactgcacatgtttatttggtagtctagtcctagcctcgtcactatttcgtcggggttaggccaggcacttaccagcacatggggtcggttgtgctgatactacactctgcactatgtgcaaatcccggagcggcagcttttggacagtagcattgggcgggtgccttcagtccagttagagatcccgaggtagtcctgtaggcgttcgtaggcccgacgttctcttctatctttatatgtattctgttttcatttacttcagagacaaattatacttttgtttcaagacatttgaatgtagtattcgtagttggtccgtgatattgtgacaccggatccgggtagagatgtatgttggtattgtcgtactggtttggctaagttatcggattaagtcttccgcatgtatttatttatcgttaatatttcattgttgatcacatgttaatttaaattgttaaaagtgataaataaaagagttagtgattctatattacacggcttgcctagatttcacgagtaggcgccatcacgactcccgagggtgggaaatctgggtcatgacagtatttatttcattcagacctttgtttgtagtactcctagacaatttgtgaagttgtgataccaatcttgggtagatttattatggatttgtattggcagtattattaaatctttacactgtagtcttccgcttattcaattatgttattatctaattgttggctctaaactgttatcggattaaaaatgaaaatacggtaaatagttcaattggttggcttgcctagctttcactagtaggctctatcacgactcctgaggccgggtcgtgacatttttggtaccatccttgccagtgtcattgaatcctaaaaatagttaggaagcaaaagaacaactcatatttattgcaaaataattatattttgagactatgaatgactcattggataagacttaactctttaactactacttgaactcttatttagtgtgttgctatctcttaaaaaatatttctttcttaaaatttcagtttctaaaacattatttttcaataataattatttttataataatgtattgaaaatattattcttaattcaaaactcattttagttggctatctaaaaatataaaaaattctttagctagtgaattctttttattccattttgatatttgacattaaccatgtcaaatatttgagttatttgaattatatgtaaataaccttaaaatttaaaccttctaaataattatagataatcgtcagatattaattaagaaacactacatgaaaaaacactaacattttctcaattctcgtagtaataattttatttttgcactattctcataggtgtcattggaacctaaaaatagccacaaagtgaaataataactcatatttatggcaaagcacaaaagttgacacgatataaacgattctttggttacgacgtgactcttatactacgacttgaacacttatttggtatgattttatctttcaaaaaatatttcttttttgaaatttcagtttctaaaactttatatatattataataatgattgtctttataatgatgctagtgaagatattatccttaatttaaaattcactttaatcggctatctaaaaatttaaatgattctttggccggatttatttcagtatgactccactttaagtttatcgatatctctatccctagaatttaaattttttataccctatatatacaaaaaaattgttctttgaatcattaaatattaaattagttgattattattattattattataaaatattgcatatattgtcttaaaattgtcaagtagtttattttcgacatcatacttggcttaacatcaatgcaaactactcaaattgcattccaattcaaattcgactatcatatcagcttgttagtaatagtgattttttaaaaataacatataatgtaaattataaaaatattctaagatatccttattttataatctatgtgtttgagtaaaaaaaaatatttaaaatcgatgagattaaccttaaaaaattttatactgaacaaagatgaaacataagaagaaatttgttgtcatcttttatttcacgttttcagatctttctaacattttttcaatgttcatttatcttacttttttatgtcattatttcttttgttacaaaaaattaatttatttcactataaaaggacgagtttttataaaaattgtctacatatgaactttaattacatttttagtctttggttgaagttatttcatatttttcttttggctttatctaatcagcctaaataggtactcaccctaccacttaaattaaaaaattgaatgatatgtaatttatatataatccatatataatatgtgtataatcatatgttgtcggtatatcatctatttatattagctataaaaagtaaacaataaatatggtcgattattatgtaaatattctataagatttcgattttttgagtttatccatgatataaattctattataataattttaaactctctacgaatgttcaaaaatatcttatctttttattatctttgaattaaaaaaattaaagagtttttttatgatgacccagtcatcacttattttaaaagaaaattctgcatttctaggccttagaaacctctttctatgtcacctcgatttgtgtgtacagtccgagcgcgtagccggaaagccaatatgtgaaaatctgtgaaaaatgatgaattttgactttaaaataaattaagttgatttcagttaacatttagggtaaacggactcggacccatgatttgaccgtcccggagggtccgtaggaaaatatgtgacttgggcgtatgcccgaaatcaaattccgaggtcccaatcccgagaaatgaatttttgaaagaaaatattttgctaaattaattatgaagtaaagaagagaatttatgttggaaaccattggtatcagacccgtattttggttccggagcccggtacaggtcttatatgtgatttaagatgagtctatgaaatttggtaagaaacggacttgaaacgacgtgaatcggatcgtatttgagaaaattggaaaatttgaagttcttaagaaatttcatgattttgatgttaaattcatagttgttgatattattttgggtgatttgaatgcacgagcaagtccgtattatattttgaggttggtatgcatgtttagtttggagccccgacggatcgagtgagttttggataggccacggagtagaattggacttgggaaaattgcaggttttcaactggtattgtcaggtctgcaggcttcgcaaatgcgaagaatggacctaggcagccttagtcacagatgcgactgtcgtcttgcaaatgcgatttcgcatttgcgaatggtctctcacaaatgcgaagatgaccggaaagttgattgggtcgaaaatgcaaaagtcccagtttctgaagggttcacaattgcgaaccctggtcacaattgcgatatcagagacctataaattcacacttagacgcattttcaactatttttcacatcttctcataacataaactctctagggcgatttttttcaaaagcaacttctcttcctaatcaattgtaaatgattccgaactatttttcttcaatctataatatcttttcacatgatttcaactaaaaatcaataatttttatggagaaaattgggtgttctgggtataacctaaggttttccaaaattggggatttggacctcgattttaggtctgatttcaaaataaattatatatttgggttcatggggaaatgagtaatcgggtttttgttcgaaccacgggttttgaccatgtgggaccggggcgatttttgactttttaggtaaaactttggaaaacttattttcatgcattggcattgattcatttagcgtttattgatgtaattaagtaacttgtggctagatacgagcgagttggtggtggaatcaacatgtaaagcgatagttgaggcttgaattatgttcatggcatcgaggtaagtgtttggtctaaccttagcttgagggattaggagtcgtgtcttatttgctacatgttaattgtggagtacaatgtatcggcatggtgacgagtatctatatatcggtgtcaagcatgcccgtgagtcttgtataataattgttatgattccgttgtggtttattgcgcttcacatgttattatcattattgttcccttgttgggatgttattatcatattattgttcccttgccggatgtttgttttaatattattgtttccttgccgtgaagttgttgaaatattattgttcccttgccaagatattgttatattgctcttgttcccttgtcgagattcttttgtgactgttgttgatttgtaacttggattgggtggcacgtcgccacagaaatatatgaaatgggagtgggttgcatgcctgcaatgagatatatgaaataggagcgggttgcacgcctacaacaagatatatgaaatgggggtgggttgcacacctgcaacgagatatatgaaatgggagcgggttgcacgcctgcaacgagatatatgaaatgggagcgggttgcacgcctgcaacgagatatatgaaatgggagcgggttgcacgcctgcaacgagatatatgaaatgggagtaggttgcacgcctgcaacgagatatatgaaatgggatcgggttgcacgcctacaacgagatacattaaattggatcgggttgcacgcctgcaacaagatgtgaaatgaaagtaatttctgtatttgttttccttatccttgttagtaattggattttggtttctttatattcctcttgatattctgttgttatatgttattccccgaagcatgttttcccccatgtaattaaatgcttttatttttccgatgtatatgatttaactgcacatgtttatttggtagtctgatcctagcctcatcactacttcgccgaggttaggctagacacttactagcacatggggtcggttgtgctgatactacactctgcaatgtatggagatactagtatcggagcatttggaccgcagtgaggttgctgccttcagtccaacaggcgaccctaggtagttctgcacacgtccgtgggccttagcgtcacatcctatctttcctttatcctgtttcctttaatttttttagaaacagtgtatattttatctttcaaactttgtatgtagtattcttagaccgtctatgaaactgcaacaccagttctgggtagtttatgcttaaagagttgtattagatacatattcagataatttattgctttgttccgcttattgtaaatttcgttatatacacgttattgttttataattgttaaagaatataaaaggggtaaaaacataattggttcaaacaatcagcttgcctcgctcatattagtaggcaccatcacgactctcgagggcgggaaattcgagtcatgacaagttggtatttgagctctaggttacataggtctcacaattcacaaacaagcttagtagagtctgatggatcggtgcagagatgtctgtatttatcccccagaggctacagagttaggaaaacttcacatttattctttcctgtcatgctgcttggtttctcaatgctaattaaatttctactcttttctttcgcagatggtgagaatacgtgcttcctcatccgctgaacagcagcccgagcccccagcagcagctcccatgaggggcagagggcaaggttaaggccgatctagacgtcgaggtaggggcagagcttagcctagagcagtagcaccagcgacggagcctcgggttgacattgatgatgaggttccagccccgacagtttcggtgggccctgctcagaaccaagaggggtttcttgctacccccatactccaggatgctctggtccgtctagatggccttatggagagtgtcacctaggcaggcttgcttcctgtagcaccagccatctctcaggctgaaggaggagcctaaactcctgctactcgcactccggagcagatggctccctagtttcagcctccagcagctcagccagttggagaagttcggccgggcatggtagctcaggccggtgatggagcaactatgtctgccaatgcttggtggagattggataggttcaccaagctcttcactactactttcaccggtgcatcttctgaggatccccatgattatttagatagctgtcatgaggttcttaggaacatggggatagtggagaccaatggggtcgattttgctacttttcacttgtcgggatccgccaagacttggtggagagataattgcttggctagacctactagattgccagctttgacttgggagcagtttactcagctatttctagagaagtttctccctatctctcatagagaggcctatcagaggcagtttaagcgtctccggcagagttctgtgactattactcagtataagactagattcatcgacttggcccgtcatgctcttatcatacttcccatcaagagagagagagggtgaggagtttcattgagggacttatccagcctattcgactttaaatggccaaggagacagggagtgaaatttctttttagaaggcgaccaatgtggccaggagagttgagatggttctatcgcatggaggtggtcaggggtctgacaagaggccttgctattcaggcagattctgtggtacctcgtctagaggcagggattcgtatggtagaggccatcctactagggctttttagtcagcacttcaggtttctcacagtgcttcaggtggccatggttatcatatgcagtattctgaccaacagtcctacagtgcaccaccagctcctatcactacaccgccactttagaattcttacggtcgtcagccccagcagccgagggcttgttttaattatggcaacacgaggcacatttctaggtattgccctcgagcatcgagcagctctcagcatcaggcttcccgtgccatggttcaggcaccgagtgttccatagcccgcccagccagttagaggtaggggtagaggtggaggtagaggtagaggtattagaggtggaactcaggccgctagaggtggaggccagagcagcaggccatcctagagatgtagttcagagtggtgggcccagccccgatgttatactcttccagccagacctgaggctgagtcttccgatgcagttatcatagtgattctttgagtgctcctgtatatgtgtctacaacagtgggtgattctattgtggtaggtcgagtccatcgttcttgtatagttatgattgggggtcttgagactcgtgtagatttgcttcttctggacatggttgatttcgatgccatgttggggattgactggttatcgccttaccacgctatcttggactatcataccaagactgtaaccttagccttgccaggtttacctcatttagagtggagagggactcttggtcattctaccgtagttttgtctcttatataaaggctcagtatatggttgagaaggggtgtttgacttatttggcctatgttcgtgattctagtgttgaggttccttctattgattttgtgcatgttgttcgtgagtttcctgaggtatttgctttagacttgccaggtatgccacccgacagggatattggcttctgcattgatttggctccgggcactcaacccatttctatctcgcagtatcgtatagccccacctgagttgaaagagttgaaagagtagttgcaagacttacttgataaaaaaggtctcattagacctagtgttttgccttggggcacgccggtgttgtttattaagaagaaggacggatcgatgagaatgtgtattgattaccggcagttgaacaaggttacaatcaagaataagtatccattgacgaggactgatgatttgtttgatcagattctgggtgccaaggtattttcgaagattgacttgagatttggctaccatcagttgaggattaggacatcagatatccctaagacagttttcgcactcggtacgggcattatgagttattggtaatgtcattcgggttgacaaatggcccagcaacttttatggatttgatgaaccgagtgtttaggccttgcttggattcattcgtgatagtcttcattgatgatattttgatatattcccatagtcgggaggagaatgaccagcatcatagagtgattcttcagactctgacggatagtcagttgtatgccaagttttcgaagtgtaagttttggttgagctcagttgcattcttgggtcaagttgtatcagcagaaggtattcaagttgatcccaaaaagattgaggcagtcaataactggcctagacctgcatcagctacagagatcgggagtttcttgggattgccaggctactatcgtcggtttgtggaggggttttcatctatcacagcctcgatgaccaggttgacccaaaagggtgcccagttcaaatggtcggacgagtgtaaggcgagctttcagaagcttaagataactttgactacgacaccggtgttggttttgcccataggttcagggccttatacagttaattgtgatgcatctcgtattgtacttggtacggtattgatgcaggatggcaaagtgattgcatatgcttcacgacagttgaagattcatgagaagaaatatctggttcatgatttggagttagcagacattgttcacgcgttgaatatttggaggcattatctgtatggcgtgtcatgtgaggtgttcacggatcttaagagtctgcagtatttgctcgagcagaaggagataaatttgaagcagagaaggtggttggagctattaaaggaatatgatatcaccatcttatatcattcgggaaaggccaatgtggtggccgatgctttgagtaggaagttatctagtatgggcagtcttgcttatattccggtcagtgagagaccgcttgctttggatgttcaggctttggccaatcagttcgtgaggttggatgcttctaagcctagctgtgtgttggctcgcatagtcgctcgttcttatttattatagcgtatccgagatcggcagtatgatgatcctcatttgtgtgtcctccgagacacggtgcagcatggaggtgccaagcaggttaccttaggagatgatggagtttagagattgcagggttgagtttgtgtgcctaatgtgtatgggcttcgagagtttattttagaggaggcccatagctcccggtacaatattcatatgggcgccactaagatgtatcaggatttgcggcagtattatttgtcatgatccaaaatccactaagggtcgtgacagcgccgaacaccactgccaggcaagccaaccacaatttactagcagtttctcattttaattattttgaaatcatttcctttaaaccaataaataataaataataaactccgctggataaataaggatgtctttacaaaatttaactattgaaaaatcccgtgatcatcccagaacccggtgtcacaagtacatgagcaatttctaggaaataatgtagtacaacaaccgtccggaatacaatattggacagaaagtaaatacagtaatttgaaagagacactgctagttgcgggtcgtctagagaagtgcagctcacctactctccgtatcaaccgtgctgttatgcctactaggccactagagatgcatgtgcatgtgcaacaaaaatgcacaacaagtgtagtatgagtacgaaaacaacgtgtaaccaatgagtatcccattaaatctcgaagaaatagagacgagaggtcgactttgacatttactagtggtccaataataatatagtgaaaatgtgaggaaatcatggattcttataaagcaattataaactcgtaaaaccggatagcaggtaaacaacatctcaaataaatacggatttccaaggtttacttttcattatgcttatcaactatgtttggccagggaaggaaaatattatcacataacattctcaggcaagcaatacaagcatacacatatcatgccgaggccgtacggcccgatccaacaatatttaaatggtgcactgccgagggtcgaacggcataaactatagatggatctatttaatctacagaggtgttcggcccgttccaaagataagcacacacagacactcaatcaagaagtcaacatggaacaattatccaaagaaaagccaattctcttgtaacaatttaagaaaatgaagtttaaatccttttagaaattcgtttactaattcgatgtgatttaagcaattcagctgtcaataagattacaaatatcccaagtatagcatgcttttaggtcctagactacccagacttaaacataatacgagctacgcacggactctcgtcacctcgtgcacgtagcacccataaataggagcacataaccaattatatcacctatgaggacaattacctcttacaagattagaaaggagactcatctctctccgcagcatatatttcgactcaagaacgcgctcaaacctccaatttggagccgaacgatccaaaactattactatagggtacgaactagtcaatacatgctcaaaagttcatattctaattattaaatcagtttcccaaccctaaatgcaaggttcctaaaattcatcttcaggcacacgtgcccggattctgaaattttccgaagaaagttgttctcaataacctaaggatcaataatatatgatttctaatccatttcataaccaattttgtggtaaaatctaagttttattaaaaccctaggtctagctctaaccccttgatttctccaaatctttaggtgttaatttacccaaaacgcaagtgttaaacttagagataagggtgatgaacttacctcacgatgctatatggaaatcccttctcaagagctccaaaatcactcaatacctgagtgccaaatggtcaaaaatggttggggctcgacttaaatatagctaactgcttcagcagtttccgcatctgcggtcgggggaccgcatctacgaagggagggcgcatatgcggaattggctaaaagggttgggacttcttctgcgatcttgaagccgcatctgtgaagtcgcttctgcggcagaagagccacttctacggtttggactggccatctctgggcggcatctgcgaggctacgacctcttctgcggtctcgcacctgcagtcgactaaccgcaggtgcggttatgacagaagcagctgcttcaacacttctccaaattccattttcgttctggaatccacacgaggcccccgggaccccaaccagtcataccaaccaaacctaaaacacattacggacttgctcgaggcctcaaatcatatcaaaccacgctaaaaccacgaatcgacctccaatccaagcattatgaactttagaatttcaagcttctactttcgatgtttaaacctatcaaatcacgtccgattgacttcaaattttgcacacaagtcatatttgacattatggacctactccaactttcgaaattggattccaaccccgatatcaaaaagtccacttccaatcaaacttcccaagaaccttcaaatttctatctttggccaaatgactccaaaatgtcctacggacctccgaattcacttccgatcgcgctcccaactccagaatcaccatacggagctactcccagactcaaaatcccaaacggacatcgattacaccgaaatgcatttcaacccaaacttatgaaattcttccaaaatgctaacttccacaataggctccaaattgctcccgggtcatccaaaacccgatccggacatacgcccaagtccgaaatcatcatacgaacctgctggaaccttagaatcccgattccgaggttgtttactcaaaaatcaaatcttagccaattctttaaacttaaagcttccaaaatgagatttgtctttccaaatcaactccgaacttcccggaaatcaattccgaccatgcgcacaagtcataatacctgaagtgaagctgctcatggcctcaaactgctgaacgacgcactagagctcaaaacgatcggtcgggtcattacattctctcccacttaaacatacattcatcctcgaacgtgctaagaactacgctagggttgcccgaaatcattatttaacacctcgagcacctactcgtgctaccacaactcagctggtctccctagctcgatcaatccgaagataccctttttcacataggcaaataagccttagagcccaattccaacatccggaattctctgccaggcttgtttccaacatacgctcaccgtatcaatcaccgcatgatgtactagaatatgactgcatacctttgctggattcacaccttgcactgctttattcacagaaccacaataacattctctgagtataatagttgaaattctatgaacctgatactcccattgcacctcatgacatacttaggtcttgctctaactcttacaataccgccacgacggaaatgatgtgtagaaattcataaccaactgctgaatcaacaaatcattgggtctatactcctgacaagaaccatcacctcattctgaaccaaacaatggtcttagctccttaatatacttaatataatcatattgcattgatcctaaatccaatgatcttgtctcacccagtatgaactgctcaggcaataagccaccccagacatgatcaaaagtctcatatgatgacacagtgtgccaataggctatgaactcgaacgtgacaaaaggaaaactaactttggaaggaactactcaactcacgtactaatatggactttccttagaaaatgggaaacaaggaatacaaaaatagcatatagaaaactatactcaacatcacactgttgcggcgtgcaacccgatccaaataacatacccatggcggcgcgccacctgatccacatatagaattcacataaggagatatatatcgagctaaattcctcattacaacaaaataccgaataccggtcacaagcactctaagtgcataataccatccctggggagacatatagtgccataggctacaaaactcaagcacaactgagatgctatatacgatctgaatctcgggagacatcctgctcctataacatcatctctacgcggaacctcaacacataagaaattcaccatgccgtctcacaactcatacaacgccatatatcatttcatgaaatagcaaacgacgaaatactaccccgactacttgtccaaaggagcgtattgctgaaataaacacatctggcctgatatagagcccatattcacatttagatccatccacagacctcaagctgattttgatcacactgaactaggctaataacctttcgaaggttcatagtaactccctttttctcataacacacacgaactaccatcataaccggggcaatcctccaaggtccacaacccaataagtcgagtgccctctaggcataaattctcaaattagtgatattaccacgatcttcatgcttggtttaaatctttaatcaatcaagtgactacatgtcacacttatacaatcttcctgtgagacacgctcccacgaccttccgcactagataacgagtctgcacaactataccaccggtcaaactaatattgtaaagcatatcaagaatccgtaatgaagatgtaagcctccgacacaaatgccgatcttaggtgatgctgaagacaataacagcttactccaaatatccaaatccccttcttgctcatctgagctcgtgacatcctcgccaaataccgaaccacaaacttgatcctcactttaaaatttcataccactcactacatctaacaagccaatatgcgatagtataagaatttcatcataactcctaaaccactattagggtaaatacttcatcacatagaaacgttttacttaactcattccaagagaaccatagctgcacgcgagtgaattctcataaccgtagaacattcaaatccttaagtagttgtctaaaccaccataaccctttcgggatccacctacacataacaaggccataatacttgaaaacttccaaataaaatcaattatggcggacgtcaaacctcgcacgtactgccacaaatcacatatataactttatcacgctgaaggaactgatcacggacgccattatgccaattcaaacatggctaatcaatctaacttcttctaattcatccttaatttgccttagagataataatagctccattccttacatcaccaacctaaatctgcattcatcttgagtaaccccattccacgagaccatattgtctccaaacccatgaactgtttcaaaccctccttgcacgcacattcgcatctttaactaatacacccattctgataattcctctacgaatctgaagtctttttctcattttcctcccaatgccacactgcaagttgaaaatatcatagaacattctgagactcttatcataatcttcaacaaaagctcaattcttaacctttgaatcccctatgactgttattcacatgaacacctatctctacaaagcacccgactgaatcacttcccttgaaatcacctctgtatgaagcataaatccagaattttcccaaagcccgaacatgagccaataaggccaactgtagcacacctttaacaattccttcattccaattacaacttatgttctttcccttagctgtaataactcaccaatatactagtaatcctaaaccttacaaatagacgaccatgcaatccaactgtaggcggtggcactctcccacttagcttaaagccactattacacacctctagaattcaccaagattctttatctcttattgacatgagctcacacaattaaaccgccagattccttgaaatccatccattatcacttcatgaacaccctgaatttccatcaacatgcacatattcgacctcttatcggaatggccagtaaaatccttcgcagaagcttcgccaaccatgagaccgctaacctgctcaaagagaataacccatatgtgtaaatcacttcccaacatcttccaatgttgttgcatggggtacaatcactacgacatcaataacccatcctaagtccgagctcactctctagctgcacaagtccattcacccctcgtggacatcaattaaatatgcggcaacatctttccaattcaaaattatattgtatccttcttcattccaagcagctccattccattatatcaaatctcttgccgcataatagcccacactcccaattaaatccgtaggccccaatcaccaatctttaaaattcccaaatcattccaaactcttcttaaggagcgcattcatcctatcaccaaacccctatgcaactttgccactctcccactttggcggaactaatcgaccacacgacctttgcttcttatacctagccttctagaaattttaaccaccgcttgacactccccacatgtccttcctcattctttgctgctcagttgttgcctcaataaaatttatcttcgtagcacttgaacccacaaatcgctactaactttaaaccttttcggagatcatctttgtcgagccgtcagcattagaaacaccgactcaatcataaaccaccgtaccctacaatatccaacagtcgtttctccaatattatttcacaatatacttccccaagggagaatttcagaagaccataacaccagcgaaattaacacataaaattgaggacgacaacactgcatcgtagataaaaattccaccacgctcaaaattaccaagtcctgttactccatcaccccaaatctggacattcataggccaattgtttttcctccgctggaaattagatatctgatctatgaatcgtgcattgagtaggcttcatttcaaatcattcaccgccccaacacataggaaactatcctaccatcaagttaatattgtgcgataaccaatcatgagcatcatagcaatctgtgcatagcctcaaagctctcaagaatactattactgagccgaaatgacaagatatctttccacaaggcaacgacaatagcccaatcaactattctgggagaaacatcccacaccacatccgtggtaccattaaaattctaaaattctcgatttataacaagctgtttgcgtcgcataagattgagtaggaagaaaataagggcataagcctcaaggaatcaaattgcacaatgaggaatcaagaagggaagtactcctaacagccctgtagcctcccgaagataagtacagacatctccgtaccgatctgcaagactctactagacttgctcatgactcgtgagacctaaggaaacctagtgctttgataccatgttgtcacgacccaaaattcactaagagtcgttatggcgcgggacaccaccgtcaggcaagccaaccacaatttactagcaatttctcattttaattattttgaaatcattttctttaaataaataaatgataaataagaaacttcgctggataaatgaggatgtagagatgagaggtcaactttgacaaaatttaactactgaaaaatcctgtgatcatcccagaacgcgatgtcacaagtacatgagtaatttctaggaaatcatatagtacaacaaccatccggaatacaatattggacagaaagtaaatgcagtaatttgaatgagacattgctggttgcgggtcatctcgggaagcgcagctcacctaagtctccgtatcaaccatgccgctatgcccactaagccactagagatgcatgtgcctgtgcaacaaaaatgcacatcaagtgtagtatgagtacgaaaacaacgtgtgcccaatgagtatcccgtctaatctcgaagaagtagagacgagaggtcgaatttgacatttactagtggtccaataataatatagtgaaaatgtgaggaaaccatgaatttttataaagcaattataaacttgtaaaaccggataggaggtaaacaacatctcaaataaatacagatttccaaggtttactgttccttatgcttatcaactatgtctggccaaggaagacaaatattatcacataacattctcaggcaagcaatacaagcatgcgcatatcatgccgaagtcgtacggcccgatctaacaatatttaaattgtgcactgccgagggtcgaatggcataaactataaatgcatctatttaatctactgaggcgttcagcccgtttcaaatataaacacacacagacagtcaatcaataagtcaacatggaacaattatcaaaagaaaagccaaatctcttttaataatttaagaaaatgaagtttaaatccttttagaaattcatttactaattagatgtgatttaagtaattcagctatcaataagattacaaatagtccaagtatagaatgcttttgggtcctagactacccggacttaaatataatagtagctacacgcggactctcatcacctcgctggggctcgacttaaatgaagctgattgcttcaacagttttcgcatctgcggtcaggggaccacatctatgatcccgcatctgcgaagggaggccgcaactggggaattggataaaagtgctgggaccgcgtatgcggtcttgaagacgcatctgcgaagctgcttctgtggtttggcctggccaactttgggctgtatctacgaggctacaactgcgtatgcattctcgcacctatgatcgacaaacgcaggtgcggttattctagaagcagatgcttcatcacttctccaaattccattttcgttttgttaaccacccggaatccacccgagaccccgggactccaaccaatcataccaaccagtcccaaaacacattacgaacttgctcgaggccttaatcatatgaaaccatgctaaaaccacgaatcgacctccaatccaagctttatgaactttagaatttcaaacttctactttcgatgtttaaacctatcaaatcacgtctgattgacttcaaattttgcacacaattcatattagacattatggacctactccaacttttggaatcggattccgaccccaatataaaaaagtacacttccggtcaaacttctcaagaaccttcaaatttctatctttagcgaaatgactccaaaatgacctgcgaacctccgaattcacttctgatcgtgctcccaactctaaaatcaccatacgaagctactcccagactcgaaatcccaaacagatatcgattacaccgaaatgcacttcaacccaaacttatgaaattcttccaaaattctaacttccacaataggcgccaaatcgctcccgagtcttccaaaacccaatctaaacatacgcccatgtccgaaatcagcatgcgaactttactcgaaaagccaatcttatcgaattctttcaactccaaacttcccggaaatcaatttcgatcgtgcgcacaagtcataatacctaaagtgaagctactcatagcctcaaactattgaacgacgcactagagctcaaaacgaccggtcgggtcattacattattggtggagaaaattgaagaaggatatcgttgcatatgtggctcagtgtttgaattgttagtaggttaagtacgagcatcagaggtctggtggtttgttccagaagatcaagattcctgagtggaattgggagcgtatcactatggactttgttgttagactcccacagactaagaggaagttcgatgtggtgtgggttattgctgataggctgaccaattcagcacattttattcctgtggcagtctcttaatcgtccgagaggttagctgagatctatatccgggaggttgtttgtcttcatggtgtgcccgtgtctatcatttcagaccgaggtacgcagtttacctcacacttctagagagcagttcagcgagacttaggcacatgggttgggttgagcacaacatttcatcctcagacggacgggcgatccgagcggaccattctgtttttggaagatatgctccgagcgtgtgtcattgactttggaggctcgtaggatcagttttttcctttagcagagttttcttacaacaacagctaccagtcaagtatctagatggctccttatgaggatttgtatggtaggcggtgacggtcgttggttggttggtttgagccggaaaacgcttggttgttgaatatggatctggtacaggatgccttggaaaatgttatgatcattcaggataggcttcatatagatcagtatcgataaaaaaagttatgccgaccgtatggtttgagatttggcattcgtggtcagtgagcgggtattgcttcgggcgtcgcctatgaagggcgtgatgagatttgggaagtggggcaagcttagccataggttcattggcccgattgatattcttgatcgagtgggagaggtggcatacagacttgtgttgccgctgagcttaatagtggtgcatcctgtgtttcatgtgtccatatttcggaggtatgacggcgatcaatcccacgtgttagatttcagcattgtccagttggacaaggacttttcttatgaggaggagtcgatagctattctagaccagcatgtttgtcagttgagatcgaaaagttttccttctattcatgttcagtggagaggttagccagttgaggcatcgacctgggtgtccgtgtccgatatgcagagccaatatccccattttttcctccactcaggtacttccctcttctgtccattcggggacgaaaggttgttttagaggtggagaatgtgatgcattctaaggccttaaaaacatctttcagcagcaccttgatttgcgtgtgcagtccgggcgggttgccgggaagccattatgtgaaaatctgtgaaaaatgataaattttgactttaaaatggatttaagttgactttggtcaacatgttggataaacagacctggacccgtgatttgacggtcctggagggtccgtaggaaaatatgggacttggtcgtatgcccgaaatcgaattccgaggtcccaagcccgagaaataaatttttgaaagaattttttttgctcaattaattatgaagtaaagaagagaatttatgtttgaaaccattgttatcgggcccgtattttggtttcggagcccggtacaggtcttatatgtgatttaagatgagtctgtgaaatttggtaagaaacgaacttgaaacgacgtgagtcggaccgtatttgagaaagttggaaaatttaagttcttaagaaatgtcatgattttgatgctaaatttatagttgttgatgttattttggatgatttgaatgcacgagcaagtctatatgatgttttgaggttggtatacatgtttggtttggagccccgagggctcgggtgagttttggataggccacggagtagaattggacttgggaaaattacaggttttcagcttgtatggtcaggtctgcatgcgaagcgtggctcgcaaatgcgacaaatcctcgcaaatgcgaagaatggacctgggcagccttaatcgcaaatgcgactgtcttctcgcaaatgcgatttcgcatttgctaattgtcacgacccggaatttcccaccctcgggagtcgtgatgaaacctacttgtagaagttaggcaagccacgaacttagaaatctttagcgcctactcgtacaagctaggctctttttacaacttatagtaacaagtgataaacatctaaatgatagtggaagaataacattgtttgtcaacatatgtctctacccagaaactggtgtttacaatatccatggactacaatgagtactacatacaacagtttgaaggaagattaacattgtttgtctcggatacatgagataacagaacataataaatgatagaggagacaccgagcctgcgaacgcctgcaaggctacctcggtgtctcggtggactgaaggcaagctccactactgctactgatcaagtgctgctctagtatctgtacaaagtgcagagtgtagtatcagcacaaccgaccatatgtgttggtaagtgtctggcctaaccccggcgaggtagtgacgaggctaggaccagactccagataaacctgtgcagttatataatatatcgcagaaaacaaacatgaataaatagtttaaaaatgggaggtagtacatgctacagggaaatatatcaagaccaacagaaacttaataagatatgaaaggacaactcaatatctacaacactaaaataacaatattgttgcggcacgcaactcgatcccttatcatttaacattgttgtggcgtgcaacctgatccacatatatatagttgttgtagcgtgaaacccgatccaatattgactttgaatctacattgtgttggcactttcaattttcaagtcacgttgttgttttggttaaaggttttaaatgttattatagcttgaaatggtgacactaactgtatatgagttttataacatcatgtatggcatctctgctatagaatatgatttggtatcaaggaatgcatttcatgtctgtttcagattataaataatcagcacttgatcggccttagggggttctcatgaatagctaatttgtttcaagtagttgccgtaaatcccacagttgggccggtgtctttggcccattggcattccgaggcctctcatctgaatcggcctagtttagatttcttctttgtccccgagcccaatctcctaatttacatggccttcgtaattaagcctaggagtcatagaataattgaggcgcgccttgccaaataaaacctcaacatgcatggccctcgtttaattaatcatgtttatccttcaaatttgaggcgtgctgtttagcaaattccacggccctcgcaaagtgcaaacgcgtagttgctttagacgcgctcttaataaaattaccttcctaaactcgggtgcgcattgatgcgacccaaatccaaatctcgatgaagtcgaaatgtgttgacaatcacgggcgcattgattgcgacagggttcgaaacgcgttttcacgacatcgtaattcttataaaataaataatgatataaaagaggttcacaaattaagacaagcctcaccgaacaaaaataaataaatgtggggccctcaatgaatggttatcaaaaatgattagaatttgggagggccatttagcaaacttcacggccttccccaaaataatatcacgttagaatctttaggcgcgattttaattaaattaccttgttaaactcgggtgcgcattgatgcgatccaaatccaaatctcgacgaagttgaaatgtgttgacaaccacgggtgcattgattgcgacgcgattcgaaacgcattttcacgacgttgcaattcttttaaaaataattataataaaagtggttcaaaattaaataaaaggcacataagctagcatgtattaagattagataaaattaaatacaacagttaagcgacctgctagaatcacggaactcgggaatgcctaacaccttctcccgggttaacagaattccttactcggatttctggttcgcagactgtaacagagtcatatttttcctcagttcggggttcaaccagtaacttgggacaccattaatctcgtaagtggcgactctgattctctaataataaatcccgtttcgattgtcctttaattagaaaaactcctttgcgcccttgcagggtgtagtagaaaaggaggtgcgacaactctggcgactctgctggggaccgaacccagaatctctggttcagggttcagaattcgagcttagataaattgttgtattcggttgtatctgatttgcctacatgttttgtgctgaatgtgctaaatgttaccactttaatattacctgaactatatataaactgtgccgatgcccttctctcttcacctctggggatgtgcttacaggttgagactccctattctgttagtgtcataccttgaaataagaaagaggccggacaagttacgaagtcggatggccttttggttcccggtaagttgccccctcctcgactcgagttgtccgctcgggtacacagtctagaacaccgacccaagtttggaacatagaataatgtgacttcatgccggatccctagtagaaacgcttatttgcatcacattgcatttgtcttaggggactcaacacaggggttgggtccgtctaggactatcaacctcaaatgaaaagaccatcctgatgcattctcttgtgctgtgcatttatttgttccgaacctgcatgttgtaatctcgaaaatgttgaaaatttgagaaaaagaaaaaaaaaggaaaaaagagagaaataacagttagggaattaaaaacccaatgcccaaacactgtcgaaactctgccgaaattttgagaaaatgaaaatggaaaatgctttatttctaaatagtctattttactaaaagcaaaagaaaaatagaaaaaaaagtcttttattcttagtttggaaaataggttatttattgtttgttgaaaaagaaaaattgaaaatgaaaaagagtattgttttaaaatagttcggttaaataagtcggttaaaatagttaggcaaccctcatcgggtccaacccttcctttgcaaaaaaaaaacgccaaaaaaaaatgtcaaaatttttatttttcgtcgtaaataagtcgggtgatgccgttttgccaaaaatagccaaatgttcccaaacggaatgtcggaaggctgctttgcaaaacggccatcttggtcaatttttgatttttgaccggttggctttcgcagccttaaaatctttgttcccgaagtgctgaaaggccgcgtttgagaatcgagttcttcatttttaaaaaatatataggtaattttgagtcgaaaatatagatagttttttttttgagtcgaataaaagtttttcttttgcttaatcatcttaataaatgtgaaggacgagcacgatgctaaatgagcccttttcaataatgaccaaaatcctttttgagttgcgattatggtggaatgatttaggctaagaagggcaagacgaagagaaaaaatatttgaaagatctcccggatttatgagactgtcacgacccaaactgaagggccatgactagcacccgaccacacttgccgagcaccaacgtacatttcatctaaccttcattattatcttttaaagctgacgagatcaatataaatggtagacctagatcatggacaaccagcaataaaatatgacagcatgaacatacatagcagggaatgaccagacaatcaagaaactatgtataaggtatgagctaccacgctactatgaaagactatacaacaaaaactagccgacaaggcatactaaactatacatgagccgacacctgtctatgagcctctaaaagaacataagtgttgcaacatatccggaacagggccccgacatacccataatgtctttaacaaaaattgcataccaagaccaaggcaagtccggagaagggatctcgccaatcaccgctgaactggacagtctactgtggtgggggagctgcacctacctgtctatcaggacctgcagcacgacatgcagcgtccacaaataaaaggacgtcagtacgaataaagtactgagtatgtaaggcaaggaaccataaatacgatcagtaatgtaagcaaggatagagaatatacaacctgtaacatcttagtacctctgagggctacttacatgaaatgaatgatacatatgtataaatacataaacctttaaagcattcgcctctatgggcatcatcatcatcatatcgtacccgaccataataggctcggtagaatcatacccggccacgtggagctcggtaaaacccaactgatcagtggttgcacaataggtgccgtacccggccaactatagcgtggctcggtagagtaaaatagatacatatatataatgcatgctcgactcatggaatcatattctaaacctttcggagtgacgtaaggtcggtatcctctgtacacgttattaggactaactcttcactatgaaccttataagaatcaggaagtaccaacaacattgataacataagactaagagaagcaacattaacatcaatcgttccataagagggaaaacaatgtaagtactgctagcttctaagagtagagtatcttggaagatcgttcattacattatgtacaatcggagtcgtgcaaaagaaggaaagggatagcctcacataccttatatatactgccccaatctcaagctatgcaattgtcaaaactccctagtctacaataagagaaacgatactatcgttatcatttaagcgtcataactattatgtatcgaccacaacctattttacgatgaaatggacagcacctaccctatatatatgacctcacaccattcaaaacagtcaccaaacagcccaaacaacatcaataataaacatattgagcctcccaaaatagtccacacatagcctaatcactccatacatacgacgaccaccgtagtcgtgtcaaacaacctgaaaatgttacgaataactatcagcccataaccctaaatatatatggtgtttctccacacccttcctcatccaaaactccacaagatagtagtaaaatacgcagcccaacaacaacacaaaacagtccacaaaacaataacattactaccaagcctttcgatatatatctcacaagttctagcttcaatggcttagccgcaacttggataatcttaaatacatatagagtaagaggttccttacctttatacagaaagaacaactccaatttgaccttaaatttccatgaaatatccctccaatgctgccacaacaacaaaaaagtgaaactagcgatcaattagtgtttttcggcactagaatcactttagaaggcttgaaatcacctaggattgatattaagaacatgagggagtatttatagaacataaaccctttaaaacaacctcccacacgagctgaaacggcacagaaatgagcaacaacaagaagaacaactgacttactagcgccacggaattcccgacacttgatttgtgttgtttgcccttttttgggtcttgaatcttgagagaaccttgagaggatgttcctagggttctaaggtctgaaaatagtgaaaaaaatgacttaaaacgggttggggtcatcctatataggtccaaatatcttaaaccgccttagtgggctccatagagaggtgcttggcgcagtctcgcaaaaacatgaatatctctctactccgagatcgtatcgatgaacgatttaatgatttggaaactagactcatagatatttaattttattggtagatcaccccgtaattccttgtaaattatgagaaaagattagaaacatttgacctaatgtttaagtaaaattatgaacctaagttgcgacaacttttgtcgacttttttttcataactcatttgacttcaagacttatgatacggatattatataattaaaataccttaataaatgacctcttgagtgtattaagcacctctagattacctgaaaatacgagttacaacatccttgattcgtttaacttctaatactggttaatcacccttatacactcttgtatcacttaagaccaataggattgacttcttatcatctcatagataattcctttttggatttatgttaactaatatatggcatgaactaacacatgtggatatgggttgtaacaccctccccccttaggaacattcgtcctcgaatgtaagggtttatggggagtttaaatcatcgtggattccaatggaaatttcctatcaattttcccctataaaatggtcactagcaaaacttgaaagtaattaagcccaacatatggcttcacaagtctacacaaagcattatgcgtatttacattatctacatatcaccattttgtattaaagaggagtattctcaaattattgcttacctcatagagccgtttcaccttccaatgtatcttgtcttccaccagcatccttgttatcttcattctggaataagtaagggtatttagacttcatctcctcttctgtttcccatgtcatttcttccatatttttgttcctccacaatactttgacggaagctacatcttttgttctcagcttgcggacttgccgatctaatatcgccactggcacttcttcatatgataggtcctctgtaacttgtacatctttgatagggacgactcgagaagggtctccaatacattttctcaacatagatacatggaataccgggtggacaaattccaattcggatggcaattctaactcataagcaacctgtccaatccgtcgaagaattttatacggcctgatatacgttggactcagcttacctttcttcccaaaacgcataatacccttcattggtgagatcctcaggaaaacccaatcaccagcctcaaactctagatcacgacgtcggacatcagaataagatttttgcctgctttgtgccgtcctcaatcgctcctgtatcactttcaccttctcaatagcttggtgaatcaaatctgggccatataattctgtttcaccgacttcgaaccatccaactggtgatctacatctcctcccgtatagtgcctcgtatagggccattttaatactggaatggtagctattgttataggcgaattctatgagtggaagatgatcatcccaattccccttaaaatctagaacacatgctcgtagcatatcttccagtgtctgaatggtacgttcagcctgtccgtcagtctgcggatgaaatgcagtgctgagatttacctgtgtgcctaaacgcttctggaaagacctccaaaagttagccgtaaattgagctcctcggtctgatataatacatatgggtacaccatgaagcctaacaatctccttgatatacaacttcgcataatcttcagccgtgtaagttgtctttactggcagaaaatgggcacattttgtaagtcgatcaattatcacccagatggagtcaaacttatgaaaagagcgaggtaatccaataatgaagtccatattaatcacctcccacttccaggtcggaatctctatattttgaagcaatccaccgggtttctgatgttctatctttacttgttgacaattgggacactgggctacaaattctgcaatagacttcttcatattatcccaccaatactgctccttgacatcatgatacatctttgtcgagccgggatggatggaatatcgggattgatgaatctcattcataatcttctctcgcaaccctgccacattaggcacacacaatcggctctggtatctcagtgccccatcttttccgatcccaaaagccatacttttacactgttgaatgctttctcttaatcgtactaaaataggatcttcatattgtcgtgtttttacctcggctaccaaagatgattctgatgtattctgtacagtaacacctccatcatcagagtctaacaatctgattctcatattgtctagctgatgaagctctttaatcaacccccatctacctgcctcaatatgtactaagcttcccattgatttacggctgagagcgtctgccacaacattggctttaccgggatgatacaatatctcgacatcgtagtctttcaataattcaagccacctacgctgcctcaaattcaactctttctgcttgaagatgtattgtaaactcttgtgatctgtgtagatgtcaacatggacaccgtataagtagtgccgccatatcttcaaagcatatattactgcagccaattccaaatcatgggttggataattcttttcatgcttcttcaattgtcttgatgcataagcaatcacattcccacgctgcatcaatacgcaccccaaacctatacctaaggcatcacaatataccacataaccttctgttccttcaggaagagtgagcactggtgtagatgtcaatcgattcttcagctcctgaaaactacgttcacaagtgtcagaccactggaatttggtagctttttgtgttaacttagtcaatggtgatgatatagaggaaaatccttttacaaaccgcctataaaacctgctagccctaggaagctgcggacttctgatggtgttgtaggtctcggccaattctttactgcatcgatcttctgagtgtcgacactaataccctcatcagatatcacatggccaaggaatgctactgagttcagccagaattcacatttggagagcttagcatataacttacgatcctgaagcgtctgtaatactatccgcaagtggcccacgtgttccgcctccgaacgagaatacactagaatgtcatcaatgaatacaatcacgaacacatcaagatagggcctgaatatagtattcatgagatccataaaagctgctggggcatttgttagcccgaacgacatcaccaagaactcaaagtgcccatatcttgtccggaaggccatctttggaatatgtttctccctaacccttacctgatgataccctgaacgtaaatcaatcttggagaaatacttggcaccctggagttggtcaaacaggtcatcaattcttggaagtggatacttattctttatagtagacttattcaactgtcgatagtcgatacacatccgtaatgacccgtctttcttcaacacgaataggactggtgcaccccaaggtgaagtgctaggcctaataaagaccttatctaggaagtccttcaactacaccttcaactcttgcaactctgccggggccattctgtatggaggaatagagatcagttgagtgtcacgcaacacatcaatgctaaactcaatctccctttcaggaggaaggcctgggagttcatctgggaaaacatctaggaattcgttgaccacagggattgattgtaaagtaggcggtttcgcctccgcatccctaacgcgaacgagatgataaatgtagccttttgagatcattttccttgccttaagatatgaaataaacctacctttcggtgtagcaatgttccctttccattcaatgatgggttcacccggaaattggaacctaaccatcttcgtatgacagtcaacatttgcatagcatgaggccaaccagtccattcctattatcacatcaaaatcaaccatttctaactcaaataaatttgccgaggtttgaagactacaaatcatcacagtgcaacctctatatacccttctagcaatcacagaatctcctatcggagtagataccgcgaggggtttacttatcaattcaggttcaatgccaaacttattagccacaaagggtgtaacatatgataatgtagatcccggatcaatcagcgcatatacatcataagaaaacacagatataatacctataagaacatctggagacgactcgagatcctatcgacctactagagcataggttcgattttgagcaccactcgaactcggcactgcacctctacccctaccacgacctgtcgactgctgaaaaccccgtgctggaggtcgaactgatgaggaagaaccagacacagatccagttggctgagccataccatcacctcctctattaggacaatcccgcatcatatggacaggctgcccgcacgaatagcatgcatcagaacctcgacgacacagtccaaagtgggccttgccgcactgatcacaatgtggtgttgggggtctcatctgactagtatccctgtgatgttgcgagccagatgcccgcgaactctgacctggaccagaataggatcgatcatatcgaggcctctgaaactgtggaggagcattagctacaagtggcgccgaactcctcgaaaactgtggcctgatacggcctctgaagtcattagaataccctgcaaatctcgcccacttatgctggcctctatcctgctccctaactgccctctactggcgcttacgatcctctagggtctgggcataagcttgaatacgggaaatatccatgccctctaccaaggaggctgtcgtacactcatttattagatgtggtcccaacccattcacgaacatatgcaccctatcactcatctcggccaccatatggggagcataccttgccaaagaatcaaactgcatactgtactctcgcacactcatattaccttgtctaaggttcaagaacttatcagctctagctcgtcgtatctcaactggcaagtagtgacgaagaaaggcctcagaaaattccttccacacagctggaggagggttcggacccctggatctctcccaactatcataccagagaactgctaaatcccgtagccgataagaagccaactctactgcctctgtatcactaacatgcataacccgaagtgtacgataaacctggtcaataaaagtctgtgggtcctccttggggtctgatccggtaaacactggagggtctaaattaataaaatcccgaactcttgtactaactggtttctcagcagcacctgtattctgcctctgagcctgagcagctaccaagctagtaaataactgcaaagcactctgcatatcctggtctggagtgctagacggaggaactggaggtgctgggtgccttctaataccctctggaggagatggagtagataaggtatgagagggcatctcactttgagcctcactttgtcctgctctgacttggggaacctgactggtaccctctcccgctgctgtatcaagccgtctactaatcgtttgcttcctagtcgaaggcatcactggaaaaaaacaaggtgaatattagagacgaacacttacgactcaactctacgcacgatctagattcaggaagaaggtaacaaccctagatgtcatgtagcctcctgattataaatgtggcgcgctacacatccataatcaagactctactagacacgactcatagacaacccctaggacagacttgcttcgataccaagtttgtcacgacccaaactgaagggccatgactagcacccgaccacacttgccgagcaccaacgtacatttcatctaaccttcattattatcttttaaggctgacgagatcaatataaatggtagacctagatcatggacaaccaacaataaaatatgacggcatgaacatacatagcaggggatgaccagacaatcaagaaactatgtataaggtatgagctaccacgctactatgaaagactatacaacaaaaactagccgacaaggcatactaaactatacatgagccgacacctgtctacgagcctctaaaagaacataagtgttgcaacatagccggaacagggccccgacatacccataatgtctataacaaaaattgcataccaagaccaaggcaagtctggagaagggatctcgccaatcaccgctgaactggacagtctactgtggtgggggagctgcacctacctgtctatcaggacctgcagcacgacatgcagcgtccacaaataaaaggacgtcagtacgaataaagtactgagtatgtaaggcaaggaaccataaatacgatcagtaatgtaagcaaggatagagaatatacaacctgtaacatcttagtacctctgagggctacttacatgaaatgcatgatacatatgtataaatacataaacctttaaagcattcgcctctatgggcatcatcatcatcataacgtacgcgaccataataggctcggtagaatcatacccggccacgtggagctcggtaaaacccaactgatcagtggttgcacaataggtgtcgtacccggccaactatagcgtggctcggtagagtaaaatagatacatatatataatgctcgactcatggaatcacattctaaacctttcggagtgacgtaaggtcggtatcctctgtacacgttattatgactaactcttcactatgaaccttataagaatcaggaagtaccaacaacattgataacataagactaagagaagcaacattaacatcaatcgttccataagagggaaaacaatgtaagtactgctagcttctaagagtagagtatcttggaagatcgttcattacattatgtacaatcggagtcgtgcaaaagaaggaaagggatagcctcacataccttgtatatactgccccaatctcaagctatgcaattgtcaaaactccttagtctacaataagagaaacgatactatcgttatcatttaagcgtcataactattatgtatcgaccacaacctattttacgatgaaatggacagcacctcccctatatatatgacctcacaccattcaaaacagtcaccaaacagcccaaacaacatcaataataaacatattgagcctcccaaaatagtccacacatagcctaatcactccatacatacgacgaccaccgtagtcgtgtcaaacaacctggaaatgttacgaataactatcagcccataaccctaaatatatatggtgtttctccacacccttcctcatccaaaactccacaagatagtagtaaaatacgcagcccaacaacaacacaaaatagtccacaaaacaataacattactaccaagcctttcgatatatatctcacaagttctagctgcaatggcttagccgcaacttggataatcttaaatacatatagagtaagaggttccttacctttatactgaaagaacaactccaatttgaccttaaatttccatgaaatatccctccaatgctgccacaacaacaaaaaagtgaaactagcgatcaattagtgtttttcggcactagaatcactttagaagtcttgaaatcacctaggattgatattaagaacatgagtgagtatttacagaacataaaccctttaaaacaacctcccacacgagctgaaacggcacagaaatgagcaacaacaagaagaacaagagacttactagcgccacggaattcccgacacttgatttgtgttgtttgccctttttttgggtcttgaatcttgagagaaccttgagaggatgttcctagggttctaaggtctgaaaatagtgaaaaaaatgacttaaaacgggttggggtcatcctatataggtccaaatatcttaaaccaccttagtgggctccatagagaggtgcttggcgcagtctcgcaaaaacatgaatatctctctactccgagatcgtatcgatgaacggtttaatgatttggaaactagactcatagatatttaattttcttggtatatcaccccgtaattccttgtaaattatgagaaaagattagaaacatttgacctaatgtttaagtaaaattatgaacctaagttgcgacaacttttgtcgacttttgtttcataactcgtttgacttcaagacttatgatacggatattatataattaaaataccttaataaatgacctcttgagtgtattaagcaccgttagattacctgaaaatacgagttacaacatccttgattcgtttaacttctaatactagttaatcacccttatacactcttgtatcacttaagaccaataggattgacttcttatcatctcaaagataattcctttttggatttatgttaactaatatatggcatgaactaacacatgtggatatgggttgtaacagagacattcagcctcgggggatattatcagggcattggtcgcttggtgggattcggcacataatgtatttcctttctcggacattgagctcaccccgacattggaagaaataacggcgtacatcggaagtgatcaagctccattgaggttcaaatacttaattgctcccagggccattattgtacatcggtttttagattccttgaaaataccccgaacagttcatcatccagatttggcaaaaggtttatgcagtttccgctacatatatgatagatatggccacgtgggcagattcaataatccagactttaagctatgcagtagaagtaaccgacaaaaatgggaggaacacagacgggtggctttcataatagcctttttgggcctcatagtatttccaaggaaagatggagatattgatttgaaagtagctggggtcgtctgtaccttgcaaaccatggggaaaagcactttagcacctatgatcgtggctgacatcttccgggctctcacggcttgcaaagctgggggaaatttttttgaaggatgtaacttgttgttacaaatgtggatgactgagcatttgtgcccccgctctcagctcttgagttacggttcattcgagaaaacttgtataggagaatttcacacaagaatcaagggggctagtctacctgaaggagtcacggcttggacatcattattgcggaccctcactgccattcaaatacagtgggtgctcgaatggttgcctgtcgaagaactcatatatatgccagcggccaggccgcattttctgttgatgggactcaaaagcatccagccctatgcaccatatcgggttctgatgtaactcaggaggtaccaagtagtaccaagagatgaagatctgagtacccaagtggtcgaaattagtcctgatagtcggtttcccgaagaagaggttcgccaaatctggagtgagtatcaacatttgatggcaaacacttatgtgtcagataaggctaaaggggaagttgccccagggtatcatgattggttcagaggcgacgtggcatgtgggagaccgggtaaaagacctcatctcgaagattttgccgagtcgtcccaagagcagtgggactggttagcaaaggaagaaggctatcgagttgagattggtaaactgaagcagcaagttgagagtctgaaattcgagaacagtgtacaggttgccgcggatcaaggtgagaataacagactggctcgagaaaacgaagcgcttagggcccgaatccagtaattgaggataaccgtcgataagcaaccaaggagccgatcagatgagcaactaataaaaaggctggaaaatgaagtcagggaatggcaggatgaattagaaaaatccgagaatatcgtggcagagcttaaagcacagtgggatacaagaacagaggagcgtcgccagtacttgaatcagttcaaaacggaccatgagaaaactgttgccgatttaaagagaaaagtggttgcccttgatggtaaagcggttagacaggctagagattttggaattgaaagtggacattgttacgacttgtttgcccaaatggaggtagaagtgcagcagttgcaagatcaacacctgcaagattctcgagctttaaagacgtgcagcgatcagataagaagcttgtttgtagaaaagaagcaaacaaaagacaggattagagccattgctcataccattttcaggagatgccgggtttgtgaagacatgacccatactacttttgtctccgcagtgatgatctatgtaaaacgaaccatgactgaattagagcagcttgaaagggatttggatcctaggaccgcggcgaggccgaacgacgccctgcggacacctaagtttgaagcattagagtatgcataggccatgtctgtagttttctaccttttgagtctgtcttttgtctgtctgttatcttttcaggtcaagtatgtttgcagtcttagagtctgtgtttgcttttaatttgcgtctgttagtttcattccgaaaaatgtttattttgtaatagtttgttttagtaatgaaaattgaaaatttcaaaaataattcttatttccaccctttatttttgcatatatatttcacgaactacgtttggtctgattcgtgcggggtcacgatacgtaggcaatctccataggattcgaccgtaatcgtaacaacaaaatataagaaagagagagagataaaagaagggagcggaaaaagagaaaaagaaagaaaagagcggaaaaacaaaaagagaaagtgaaagcaagaaatgagcagaaacacaagagaggaagaaataaaagaaagaaaagagcacaagagagggataaggtgagaaatttgaaagaaaggtaaaatgaaaaaaggaacgaagtgccgggatgacgcaaacgcataatagaaatgattaactgtataagtgcattcataccaacgtgcggttgtcaaatctgtgaagacttaatcgctaacaaagtggttgtataaatgtgtgagttcaggcaggtggttagttgattggcagttctagcaacccacccgtacaacacccggtcgaaagataaaataaacatgacaggacaggactcggatatcagtctcgtggacccttcaaatgaagttgaggtaacagatgtgggtgctatgaaagaagagatgaggaaactaaaagcacaaatggccgaaatgtatcgagcatggtctcagggacatccggcaccactataccccactaatccatcttacatcccacctctggctcaggctcaggagcccatcactccccacgcatattcaactctcccctattacacccagggctatggtactacttcatatgcccctccagctccaccacccaaacagaaccctcccccacccatggttccagtctttgtggcacctcccccagccccattacatagatcgtccagtgagccgctattccaagctcacgacacccaatattaccctctcgaacccacttttaaaacgcctgagccatatacctatactccccattttgaaatcccagaagaagttgagaaaccggttaagaatgcagaacaggaggaagtgattcgtaaagtcaaaagcctggagcaatccttcaggaacatgcatggtttaggcaaccgagtcagtgttgcatacaaagatttgtgccctttccctgatgttcagttgcctgcggggtttaaaatgccgaagtttgacttgtatgaggggcacggtgatccagtagcccatctgcatggcttttgtagcaagatgagaggtgttggggggtagtatgaattgttgatagcctatttcggtcaaagtttgagcgggtccgcgctagaatggtacacgagacaggaccccggccgatggtatacatgggatgatttggcacaagcattcattggccattttcagtataaccttgagattgtccccgatcgtctgtcattgttgaagctggaaaagaagcccggggaaagttttagagagtttggcttccgctggagggaacaagcagcaagggttgatcctccgatgagggacagtgagatggtagattacttcttgcaaacattggagcccacctattttggtcatctagtgacatctgtcggaaaatcgtttaatgaagtggtaaagatgggagtcatgattgaagagggattgaagtctaacaagatcttgagctactcggcattgaaagcaaccacccaggccatccaaagtggtactggtggtgggcttggaaagaagaagaaggaagaagttgctacgattgaaactagtacttggtccaggcccaataaccctccaccctactacaaccaacccagaccccaccacccaaactaccaatataccccatatggcccaccgcaaccctactatccaccactagaaccacacttttctatccaccacgcccagacatacactcagcctccggtgcacttgtaatggcgcacaccgactccccaaaacatacatccaccaccacaaaacacctatccaccccccagggcaaacagaccaggaaccagcttccgcccaaaccaagcttttagaagtgagaaggccccaaacagaaaaacatttactccgctgggggaatcttacaccactcacttccatagattgaaacagttgggaatgttgaccccaattgagtccaaagcaccaaatccctttcctagaaatttggaccattttgttagctgcgagtattgctcagggatgccggggcacgatactgaaaaatgttggaagttgaaaaacgcggtacaagaactcattgataatcgccgtattgaagtacaggctccagaggccccaaacatcaatcaaaacccgttaccagcgcattatgaagccaatataatcgaactgatacataaggggatagagcctaaaaaaaccctcgcagacggtcatgttgatccgttctacggaagacaaggtcaaagaaaagacagttagcataaggccagcggttcagctaaaagctataaaagataagccagtgttggtaatggaaaaaggaccatttgttgctgcaaaaaagccagagccagtcaagttagtggtaccggggtcatcatctgtacccgtggttgttgtgaaagggtcctacatagaaccagttgtcataaagccgatagtccaattacccgtggtttatagcaaagccgtactgtggaaatatgacaaggtagtgttgacataaaaaggaaaggaaattgaggaagagagttgtgaagcacaaggactaactcggtcaggacgctgttttgcgcccgaagagttgagaagggctatgggcgctaaggataatccagtgttagtaaaaaaggctgtgacagaagaagaggcagaagagtttctgaaaaagatgaaagtgcaagattattccagtgttgaacaattgagaaaaacaccagcccagatctcgttgttgtcattattgatccattctgacgagcattgccaagctttgatgaagatattgaatgaagctcatgtacctgacaaaatttcagtgaaccatctggagacaattgccaacaaaatctttgaggtaaacagggtaacattttctgatgatgaattgcctgtggaaggcacagaacacaataaagctctctacctgacggtcaagtgtgaagattcaatggttattcgggtgttgatcgataacgggtcaagtgataatatttgtacgttgtccacattgaacaagttgaagattgatgacgatagaatccgtaaaaatagtatttgtgtttgagggttcgacagagggggaacaaacacagtgggggatattataatcgaattgactattggccccgtcgagttcactatggaatttcaggtgttagatgctacagtgtcctacaatcttttgttgggtcgaccatggatccacgcggccaaagcagtgccttccacactgcaccaaatggtcaagttcgagtgggatagacaagaaatcgtgttatatggagaagatcccacatgcgccatgaatgatgccattgtgccctttatagaaactgaagatgataagggaccatgggtttatcaggtcttcgacacggtcccggtgaacagagtgcccgagggtaaaagcatcccatgtcctaacggcatgggttcaaaccaacaacggcagatgttagaagggctcgtaaattgaaaaagaaagcttgggttcttcccaaaccgattccacgcttgtccaggtctttcgtcaggccgggtagcaagaagcagtcattggctaaggtgttgggtccactgattggtgcagaggggaacttggataaggtgttcgagagggtatttgctgaagtgaacatggttgaggccggggaagggtcaagcatagcagatatacagtacatcggaccgcatgctaacatcaacaattgggaagctactcctcttccaattcggtgggagtcgtggtagtggattttgttttccttttgtcacctggattattccagggtttgtaattcagttgctatgtttcgtccgtttggatgagttaaaaccctgttatctttacattcaatgaaatgcaattttcttcattcctaattttgtttccattttttttcttttcttttgtacagttctttttatgatgatatcaatgatatgacatgcataaggaatcttcggcccagttttaaaagccaatctagctcagaaataataatacaagaaattgagtgtgatgatggggtggattgtaacgacgatgaggcttatgaggaaattagtaaagaattaagtctctttgaagaaaaacccaaacctaacctaaatgacacagaagcagttaatctaggggaccaagacaatgtatgggaaacgaaagtaagtattcatctggagccacaactcaaggaggagataattagagtattgcatgagtgcaaacatgtttttgcatggtcgtatgataatatgccaggtctaaacaccgattttgtggttcacaaattgcccattgatccagcactccctcctgtcaagcagaagttgataaagttcaaaacgaacataagtgtgaagatcaaagaggaaattaccaagaaatttgacgcaaaggtcattcaggttacacggtatcccacttggttagctaacgttgtgcatgtgccgaagaaagatggcaagaccagggtgtgtgtcgattatcgagatcataacaaggcgagtccaaaagacaatttcccactgcccacatccatatactgattgacaattgtgccaaacatgatattggttcttttgtggattgttacgcgggttatcatcaaattctaatggacgaggaagatgcagaaaagacggcattcatcacgccttggggaacgtattgttatcgggtcatgccgttcggtttgaaaaacgctggggcaacttatatgagggccatgaaaacaatattccatgatatgatacacaaagaaatcgaggtgtacgtggatgatgtgatcgtgaagtctagacagcagtccgaccatgtcagagatttgagaaagttctttcaaaggcttcgcaggtacaatcgtaagctcaatcctgtaaagtgtgctttcggggagccatctgggaagttgttggagtttatagtcagctggcggggtattgaattagacccgtcgaagatcaaagctattcaggaattgccacctccaagaaacaaaactgaggtgatgagtttgttaggaagattgaactatatcagtaggttcattgctcagatcacgacaacttgtgagccgattttcaaattgttgaagaaagacatcgcggtcaaatggactgatgaatgtcaggaggcttttgataagataaaggggtatttgtcgagcccacctgtgctggtcccgccagaaccagggaggcctttgattctatatctgacggttttggataattcattcagctgtgtactagggcagcacgatgttatgggtagaaaggagcaggctatctactatctcagcaagaagttcacatcttacgaggttaagtatactcatctggagaggacatgttgcgccctaacttgggtggcacagaagttgaaacattatttgtcatcctacactacttacctcatatctcgcttggaccggttgaagtatattttttagaagcctattcctacagggaggcttgaaaagtggcagatcctgcttacagagttcgacattatctatgtgacagggactgcgatgaaagcacaggcactagccgaccatttggctgagaaccacgtcgatgaagattacgaacctttgaaaacttatttccctgatgaagaggtgatgcacattgatgaattggaacaagctgagaagtcgggatggaaacttttctttgatggggttgcaaatatgaaaggcgtgagaataggagtggtgcttatttctgaaacaggtcagcattacccttttacagctcggcttcgtttctactgtacaaacaacatggcagaatatgaggcgtgtatattgggattgagattagctgtagatatgggtgtacgggaagtcttggtcatgggtgactcggacctactgatacaccaaattcagggagaatgggaaacacgagatttaaagcttataccgtaccgataatgtctgcatgagctttgccagcggtttcaggctatagagttcaagcacattccaaggattcataatgaggttgtcgactctttggctactttggcgtcgatgttgcatcatccagacaaggcttatgttgacccattgcagatttaggtacgcgatcagcatgcttactgtagtatgatagaagaggaaatcgacggtgagtcgtggttccatgatatcaaagagtacatcaggatgggagtatatccgatacaagccaccggtgatcagaaaagaatgattcggcgattggcaagcgggtttttctttagtggaggagtgttgtacaaaagaactcctgacctcgggttgttgagatgcatggacgcaagacatgccacatctatcataactgaggtacatttcggagtttgtggaccgcatatgagtgggtacgttctagcaaaaaagattctccgagcaggttattattggctcactatggagcgggattgtatcagttttgtgcgtaaatgtcatcagtgccaagtgcatggagatttgattcattctccaccatcagaactacatacgatgtccgcaccatggccttttgttgcatggggcatggatgttattgggccaattgatccggcagcgtcaaatgggcacaggtttattctggtagctatagactattttaccaaatgggtggaagctaagacgttcaagtatgtgactaagaaagctgtggtcgactttgtgcactcaaatatcatctgtcggtttgggattccgaaggtactcatcacggataatggggctaatcttaatagtcatttgatgaaggagacatgtgagcagtttaagattacccataggcattctactccataccgtcccaaggctaatgggacggttgaagcagccaataagaatataaagaaaatactccgaaagatggttgaagggtctagacagtggcatgagaaattacctttttcattgttagggtaccgcaacaccgttcgtacctcagtgggggtgactccttattcattggtgtatggcaccgaggcagtaatacctgcagatgtggaaatcccgtctctgcgaatcattgcggaggctgagatcgatgatgatgaatgggtgaaaagtcgccttgagcagttgagtttgattgacgaaaagagattggcatcagtgtgtcatggtcaactgtaccaacgaagaatggcaagagcatacaacaagaaagtgcgtccaaggaaattcgaagtcggacagttattactgaggcggattttgcctcattgggatgaagcaaaaggaaaatattccccaaactggcagggaccatttgtagtaaccagagtgttgtctaacggggcattgtatttgacagacgtagaaggaaaatgtatagaaatggccattaattctgatgcggtcaagagatattatgtatgatttctttatttctgaatgtatctgtttgtatttggcatatcttaaagattgaaatgacgaagacgttttgtcctgctatccaaatacttttatcctttgtcatcccctttgagccttacttatgtttcatacccctctttcggaatcaatgacactatcagagaacacaggtgccgaacataaaagaaagaaaataaaagcaaagtaaaaagaaaagtaaaggaaagaaaggaaaaagaaaaaaagaagaagaaaagaagagaaaggaaaaatgaaagggaaggaaaagagaaagagaagaaatgaaaaaagaaagaaaaggaaagaaagaaaaacacaacaacgaaggtaattatgatacagtgaactacgtttgacttgatcccgaaagggtacgtaggcagccttactccgaggttcagtcataccaaaataaaaatccaaaaatccccaagcaagaaactggggcagaagttgtgattgttgtgaacagttggattccgaaagttataatttgaacccatttgaattattttgagccttttatacctttctttctaacccaatccaaaagcctacattactctccaaagaaagaccttctgatcaatttttgagaaatgccaagtcgagcaggtagcggtaattcgtggcagtggcaacactctggttcaagcaagaagaacaaaagataaaaatgagagagtcttatgggtgaaaaccctcacgggcaccgtaaggcgacgggagctgagagaaaataaaatgagagagtcttagtggtgaaaaccttcacgggcacctcaaggcgaaagtgagttgagaaatggcaaactaagaaaggtctgttgatggaaaactgtttcgaggcaccgcaggatgaacaaggttaaggtctgcttaattcaaacaattgatggaagtcctaggcaacgaggtatggcaattgagagttgtttagttggatcggctgggccgattagtccggaatgcatgtcatgaccattggtgccagctgttccggtcagataagtttcttttcttcacttcatttttagtagtcatccggttttctagattcttcttatccctaacccgtaaaaccattgcatttcattctctttgggggggggggttgtttgtctaaatgttctaatgtcagttatgttcaaacgcaagtgggaaaggatttcaaggctcgctaccagcttccaaaattgtaaggcacaacgtggtcagagcatatcaaaaacaacatgatgtcaagtggaatacagggaattaacggaaatttcatcagtggaatgattgggaaaggtcgtgagaaatgcaaaggttcaaacaaaagggttagaaaagcgaaataacagcatgggtgtaaaacatttaggtcgccagaggttggggaatttaaaagttggttagaaaatcaaacggttcagggtcagtgcatggaagtcagtcaacacaaagcaatgcaggggaaggatttttcagcaagaatgccatcaactaaccaccattttaaactaacagaattttctttgattggaacgggggcagaaagttggttgttcaggaggaattctccataaagggaaagcaagcagtaatcaagtttgaccgcaaagtgcggtttgattaaatacaagataatcatgaatagcgtaggggaatataatttggttgcaaagtttgcatgtttaggataaaatgcaagttgtcaggaccttccttgataataggacataattcaaatacccggataagataacatggtatagtgagaagtaacaccttaggttcataattgtttggagttgacaggatcttcctggataaaatgatgtagtttaaacccttgtagatagcacgatgtagtgagagtaataccttaggtttgtaattattacccccctggataataggatttagctttcaattcttaataatatgtgataatatgattcagcttaacactcacccatacacccagcttccaaactggggcagaaaaattttcgttggttgattattttgttgaagtcaggagtccgcctggagaacagagacatacttttcaagtttggtgtcatgagtccgcctgaaggacggaaacatatagtttaaattttaaaagtcaggagtccgcctggagaacagagacatacaatttaagttttagcgatcaggagcccgcctgaagaacaaaggtgacacaatgcaagttttagttttcaatcaatttctttgtctattttgaagtcaggagtccgcctggagaacagagacatacagtttaaattttagaagtcaggagtccgcctggagaacagagacatgcacttcaaatttcggtagtcaggagtccgcctggagaacagagacatacaatttaagttttagcaatcaggaacccgcctaaagaacagaggtgacacaatgcaagttttagttttcaatcaatttctttgcctattttgaagtcaggagtccgcctggagaacagagacatgcatttcaaattttagcagtcaggagcccgcctggagaatggaggtatttatattttaagttgtagttgaagtcgggagcccgcctgtatgacagaggagcccgcctggataatagagtaatacgtttcaatttcaagttaagcagttaggagcccgcctggataatagaggaatacattcaatttcaagttcagcagtcaggaacccgcatggataatagaggaatacattaaatttcaagttcagcaatcaggaacccgcctgaagaacagaggaatacactcaaatccaagattatttaagttcagtaatttggaaagaaatgataacatctcagttcacgatttgaagtaacaatagtgagtttcacaacaaggcaacaaggcaagaaggaagtgcaagatgcaagtttgaagactttagataagacttttgtaattcacagttcatagcttagtctagcttcttttattttaccatggtgtaataaggaaggtcagcaagcagtagtagtagcaatcgcagtgaaatcacagctcctggtatcccagctaccagacactcccgaactacactaacctaattcctgtttagcccaggatatgtaggcaacctctgaaacagggtgcggtcaaaacttttcaaaatgtttcacgacggaatatttgaacgggcaaaaatcgctcgtatttgctcacttatctttgcacgaaaacatttcatgtttccgagcaaagaggggcagctgtgagcacgtgatttttgccctgtatatgaataattcccaaaaattcgaacaaaataatttttgtgcattttggtattattttatgatattggttgcgttttatgtgtgcatgttaattcatacaaaaatatgcattttcatttagcatataatttcatacttttaggatcaattaggggttggtttattttagaaccaagcatgaaaaattacaaaatagtttacttttgaatttttattttttaagtcgtgaatttggcgtaaaacaggtttagatagttttagaatttaattagtttagctttggaatattaggactctattgtaaattaaaaaatataaataataaaataatataaaaatagtataaaatggaaaacaaaagtaaataataagcaagcaaactcatcctacctttcctctcaaaccctaatcccagccgcccccaaacccctcgccggcgtgaagcgcaacgtacgtcgttcaaccccaaattaacaccatagatcccccatgaatccctctttttattcctactattggtttccctcgaatatttccagagctcgtcgaatccccgattgaagtttttcggccaagtcgcaaactcatcctaatcggcccaaaatcacaccacaccatccccagacttccctcaacccaaatccatgaccatcttctttcgaatctcggtgaagcggcttgaatttcagatctaagaatttctgtccaaaaccctaacccaaaatctttgtgattttggaccgtaatatctttaaccatgtggtctcttgtaaaaacacatggttagggatgttatgtgtcaaaaatctggaaaggttcggacgtcagcaatgggccagagtttctcgcgcttcagtgagctttcttgtttctttttacttgtatggttgaagttttagttagttttgatttcattaagtgttctgttaatcttacgatttatttttgtgtattagtatagtgtaaattttctttgttccttgttccttgttccatctgttttaatcagtaaatcgtcttcgcatttttagtttagtttgatgcatgtgtcatttgttagttaatcatagtcttaatttcagaatcggcataattgattagttttggattgaataccattttgtccattaatgttagctagatgtttaggttgatttcaattgctttttagttctgaatttaatgttcgaatggtcaattgtgagattattggttaaaagttattttaatttcatttaatgttgattgatcctggtctcctagtttttctaagttgtttgggtttgggtgattgaataattgggattggttagttcaattggttaatttctgagttctaattaatcaatcctagttagttttgaattaatttaggggattggttatagctgttgagaatgtgggtagaatcagtaacttggagaagctttcagtggtagtttaggcatggaaaggggtaattctgataagaatagtaatttcaaagtaggggtaagggtagtataggtattgtgggggtagaagagcatcctagggccttatacaagggtactttagtgtaggtgttagcacaatagagggatttacttgttgggcaagtcaaaaataaagggactaaactgaaaatgagggagggactaaaaagaaacccaaaatctgattgaccctcttgtatcacctacaaaaaggcatcaagtgccttgaggaaggggattcaactttcagccataaaaatcacccctcacaaacattctcttcatttttttaagatctgaaaattgaaatttaaaacttcaaaagccaaaaaatacattattctaatagaaaatcaaaaaaaaaaataggttagtattccattggaattttcatttttaaactcccagtagtgtttgagttcaaggcctggtagttgcatttgctgatttcgaagggttgtaaatatcactgagctggatttcgattgaatctggttttgactggaaatagaaggaatttggtggataattgtcaaggttatttggtccattctgattttggtttgagttgatttctcagtggtttcaaatttcattctgggctgtgtctcaatttcctgggctgtgtattgttgttgtttgatcatctcttggtctactgttgtttgaactgctgctgactcactcttctccttcattattcttcaaatctccaggtacaatactcaaacctgacatggaattgaatattgattggcttgcacgaagctgttggaaattcaagttgaaattcaattaactatctcaagtttgatgttctttaatacttttagtatacatgattaagtgcttcagttctgtatatttctatttttggtttgtatcgagtgctagtgcatgctaagggcttaggttgatttcgttgcttggatctattgtataatttcagaatactgggtgttttaataccgttcgaactcaagtgtaggaattgattgcttttaagctttcaaatggtgatcatgttaagcttagttgagtggcttttgcgtttctgactttgaactacattggcactttcaattttgaagtcatgttgttgttttggttaaaggttttaaatgctattatagcttgaaatggtgacacaaactgtatatgagttttataacatcatgtatggcatctctgctatagaatatgatttggtatcaaggaatgcatttcatgtctgtttcagattataaataatcagcacttgatcggccttagggggttctcatgaatagctaatttgtttcaagtagttgtcgtaaatcccacagttgggccggtgtctttggcttattggcgttccgaggcctctcatcggaatcagcctagtttagatttcttctttgtccccgagcccaatctcctaatttacatggccttcgtaattaacctaggagtcatagaataattgaggcgcgccatggcaaataaaacctcaacatgcatggccctcgtttaattaatcatgtttatccttaaaatttgaggcgtgccatttagcaaattccacggtcctcgcaaagtgaaaacgcatagttgctttagacgcgctcttaataaaattacctttctaaactcgggtgcgcattgatgcgacccaaatccaaatctcgatgaagtcgaaatgtgttgacaatcacgggcgcattgattgcgacagggttctaaacacgttttcacgacatcgtaattcttataaaataaataatgatagaaaagaggttcacaaattaagacaagcctcaccgaacaaaaataaataaatgtggggccctcaatgaatggttataaaaaatgattagaatttgggatggccatttagcaaacttcacggccttccccaaaataatattacgttagaatctttaggtgcgattttaattaaattaccttcttaaactcgggtgcgcattgatgcgatccaaatccaaatctggacgaagtcgaaatgtgttgacaaccacaggtgcattgattgcgacgcgatttaaaacgcattttcacgacgttgcaattcttttaaaaataattataataaaagtggttcaaaattaaataaaaggcacataagctagcatgtattaagatcagataaaattaaatacaacggttaagcgaccgtgctagaaccacggaactcgggaatgccttacaccttctcccgggttaatagaattccttactcggatttctggttcgcagactgtaacagagtcatatttttcctcggttcggggttcaatcggtgacttgggacaccattaatctcccaagtggcgactctgattctctaataataaatcctgttccgattgtcctttaattggaaaaactcatttgcgcccttgcagggtgtagtaaaaaaggaggtgcgacaaggttaagtacactcacctggaaaggatatgttacgccctaacttgggtggcacagaaattgaaacattatttgtcatcctacactacttacctcatttcacgcttggatctatttaagtatttctttcaaaagcctatgccgacaggtagacttgcgaagtggcagattttgctcacagagtttgacataatctatgtgactcggacagcgatgaaagctcaaacattggccgatcatttaaccgagaacccggtcgatgaagagtatgagccactgaggacttattttcccgatgaggaggtgatgcatattgacgagctagaacaggccgaaaaaccaggttagaaacttttctttgatggggctgctaacctaaaaggagtgggataggagtcgtgcttatttctgaaacagggcatcactatcctgttacagctcaacttcatttttattgtaccaacaatatggctgagtacgaaatatgcattttgggtttaagtttagctacagacatgggtgtccaggaagtcttggtcttgggagactcagatcttctggtacaccaaattcaaggagaatgggaaacacgacatttgaagctcataccataccaacaatgtttgcatgatctttgttaacggtttcgatcactggagtttaggcatattcttagggtccataatgaggtcgccgatgctttggctaccctagcgtcaatgttgcaccatccagacaaagcctatgtcgatccttcgcacattcaagtacgagatcagcatgcttactgcaacatgattgaagaagaacttgatggcgaaccatggttccatgatatcaaggaatacatcagaatggggatatacccagtgcaagccacgtgggaccaaaagagaacaattcgacggttagcaagtggattcttcttgagtgggggagttttgtataaaagaacaccagacattggattgttaagatgcatagatgctagacaagctatggttgtcatgtccgaagtacattcaggaatttgcggaccacatatgagcggatatgtgctggaaaagaaaattctccgagcaggttattattggttcaccatagagcgagattgtatcagttttgtgcgcaaatttcatcagtgccagatacatggagattcgattcattctgcacatcgaatttgcacacgatgtcggcaccatggcccttcattgcttggggcatggatatcattggaccaattgagccagcagcatccaatgggcatagattcattctgatagccattgattatttcaccaagtgggttgaggccaatactttcaaatcggtgaccaagaaagcagtggtcgattttgttcactcaaatatcatctatcgattcggaatcccaaagatgatcatcacggataatggtgctaatcttaacagtaatttgatggaagaggtatgccaacagtttaagattacacatcgcaattctaccccatatcgtcccaaggcgaatggagcagttgaggtagccaacaaaaacataaagaagatacttcggaaaatggtagaaggttccaggcaatggcatgaaaaattaccatttgcattgctgggttatcacactactgtccgtacttcagtaggtgaaacttcttatttatttgtatatggaactgaagtagtgatacatgcggaagttgaaatcccgtcccttcagattgtcgctgaggctgaaattgataataatgagtgggtcaaaacccatctagagcagttgaacttgattgataaaaaaagattggcagcagtgtgtcatggccagttatatcaaaagagaatggcaagagcatacaacaaaaaggtacgtccctggaagtttgaagtaggccagcaggtgttgaaacgtattcttccacaccaggctgaagcaaaaggcaagttcgcccaaattggcaagggccattcattgtgaccagagtgttgtccaatggtgctttatgtttaacagatatcgaaggaaaatgcatagacatggctatcaattctgatgtagtaaaaagatattatgtatgatttctttgttataactgttgattgtttgtatttggcattatttctaagattggaatgactaaagcaatttgttctgctatctaaacactttaccctttgttcccccttatgagccatatttatttctttgcatacctcccttttggaatcagtaatgaaaaagagagaaaaagaaagaaaataaaggagaaaataaaagaaatgaaaagtataacaacaaggaaattcaggtgtgaactatgtttgacctgattcctgttaaggatacgtaagcagctttacggctcagtcatagtaaaataaaatatcaaaagatccccaagcaagaaactgtggcagaagttgtatttgtaataaagaatgtgattccaaaagttgtaattttaaacccatgtcaaattgttttgagcctttgataccctttatttccaagcccatccgaaagcccacattacggtccaaggaaagaccttctaatcaatcttcgagatatgccaagtcgatcaaatagaggtgattcatatcgaggtaacactctggtccaagcaagaaaaataatgaaaaggagagagtcttattggtgaaaaccctcatgggcaccatgaggcaacgaaagctgagagaaagtaaaaatgagagagtcttatcggtgaaaaccttcacgggcaccatgaggtgacaaggaattgagaaatgaatgaatgagagaggtttgtcagtgaaaacccttcagggcactacaagtcgaacaagatccgtaaagttggcggaaagtaaatttagttgtgggaaatcttggagcacgaagtaaaataatttaaaaaagagattggataaatagaatgggctgattaatccaaaatgcataccatgatcattggtgtcggtgattccgctcagatgagtcccttttcttatctccaacaatcatccaaatttggattcttttctttattcttaaaagccttacatttcattgctgttaattttacttctctaaagctcttccaagttagccttgtaagaagaaatttcaaagcttactactagttttgaaattgcacaaagcaaaatgcacctagaacatgccagagatgatataatgaaaagtgggacatagggtgtaagcaaaggttatatcgatggaattgttcagtaatgtcgtaggagatatatgagttcagacaaaaaggtcagaaatggagaacaacagttagggaccctacagtcaaggatcgatcagaaggtcaaaacagtcttttcggccagttcaacacagttggacgaagcaaagaatggcaaaaagaaccacctccagcaagaatgccacaactaactaccacgttttaaactgacaaaattctctttgatttaaaataggggcaaagatggcatttcatttcaggaaatcatccatatggagagtaagtacgaggcaggtttgatcgcagaattctcaggaccctcctgaaaaatgggacttagtttaaaattcaaaataaccatgagtaccggaatttggcatgaatgcaccatagaggattataagtggagcttcgaagtttgtatgttgagatacactttggaaattaccccatgagaacaaagattctgatttctcttctttcccagattaatgattatgattttctacatcctcaactttttccccaagcagaaacaccatctttttccactttttccccaatttaatcggaaattctcaggaccctcctggaaaatgcgacctagtttaaaaatcgaaataatcgtgaaaagcaaggtctagcataggtgtaccccaaaggaatataagttgatttcaaagtttgcatgttttaatatgggattcaattaggaatttttaggaccctcctaaataatgggacctaacattgagattttttattagataacaagatttagcaagagtcacacctttagaagatataacttatatttaaaattgtcatttaattaagagtggtgaggacccacttggataacgggatttagctttcaaattcttattttgtaacattgttcaatttaacactcacatataagcttagctaccaaactagggcagaaaatttttctttgtttttgtctattttgttgaagtcgggagcccgcctggaaaacgaagggaagaaacaattcgagttcaagcaatcaggcatccacctggagaataaggaaaagcagcggaagattcagcaatcaggcgtccacctggagaacaaggaaaggcagtggaagattcagcaatcaggcgtccacctggagaacaagggaatacatttcgagttcagcaatcaggaacctgcctggagaacaagggaatacaattcaagttcagcagtcaggcacccaaatggagaacgaagggaacaagcaattcaggttcgagtaatcaggagcccacctatagaatataagataggcaacaatggtcaaagaaagatgtttaaaggttcagcaatcaggtacccgcctggaggagagggaaagcatatcaagaatgcaattcgagtcagcagcaaaggaacaactgagggaaatacaaatcaacaaggcaacaacagtcacaagaccaagtttgaaaataaatcattataaagcatagattgtagcttagtctatcttcttcatttttgtcatggtgtaataaggaggttagtaagcagtatcagcagcagcaatagtaacagtgaaaccacagctttatggtagtcccagctaccgaaacttcccgaactacattgacctgattcctttttagccaaggatatgtaggaaacctttgaagcagaggttcggtcaaatctttcaaaaaatgcttcctacggagtattcaaaacgggcaaatatcgctcgtatccgttcactttatctttgcgcaaaaactttttgtgttttcgggcaaagaggggcagctgtgagcacgtgatttttgccctataagaattactcccaaaaaattaaaaataagataattttttccgttgtttgcaattttgtggatttttatagtattttctgttattatttgcatgagttcatgcatgtttatatgtttaaataaataaaaaatacaaaaaatagattgaatttgcatttaggatttaattttataattttttttagttgagtagtaaattacttatttttacaaaaatgaaagaatcaaaaaataatgtattttgcatttttaaagtatttaatgtaaaattgtgtgattattttatttttagtatttaattatttgtgataaatattatttaatgtggattagtattttaagtcaattttggttttataatttgagttaggatttttggttttaaatttgaaaacaatttaggaagaaaaagaattaataaaagaaaaggaaattaaattggggcaaactcaatttaaccatcaatgcccaaatcaaatacaccccaaactagcccggacctgtctcccccaacccgttccatctccagcctcaaccaaaacgacgtcgtttggacatgctctaatctgggccattgaatcaacctgatcgaacggtcccaaacctttcccacaacccgacccattcccatacccaaaccacccacttagccaccaaacgaccccatttttccccttgatcaatctggatcgtcgatctcctctaatccaacggccccggttaattccccattttaatataccaaacaccccccactcgtctcttcagagaccaagaacatgcaccactgcacgctgccctcttccgcccaccggaaatcgcctcatggtggtttcggtggcccaaacaaccccaaattaacaccagtgattctccttcacctcattatctcaaatccttaaactgttcctttcgaatcacggccgaaatcgtcgaatcttcaatcgaaatttgaaccccgaaccctagtttacccaatcgaccccaaactgacaccccataaccttcctgacctccttatacccaatacatatctggtttccctctaatttgtctaaaatagatcgaatttcaaatcttgagttctgattctaaaagtcagagttaaacacaagaattgttgatgatttcaaggccgattttgtcgcaaaatggtgttaatcatttgttctaacaaagaacgcttgactaacatcatttggcgatgaagtcggaaaaaattcgagtgccaaatgaacctgttgagttggtgagtatccagtactacttcttttcttttcttgttattattccacttctgccccgtcttcttcttttcttaggtttgaattaggcttaaaattgtgaattgtccattcgattgtctttggtgcatatccatgtatgtcgttaattaatttaatagcgatgttgatttttcaaactagttaaaggttttagtcttttgtttactataattgtggtacttcgaaacttagggagggatgaataacagaagccttgagggtaatttgggtagggaaacctgtcaataattaattagagggcttctcaatagtggtagggtctaggaaatgcactactgaattaattataagcactaagtagtggaatgaattaaaaatgaaaaggggacttgtagtggctggcttaatgcccttttaggaggtggaaatcagagaacatgggtgatgtaattaaagactaaaaaatacaggtgtaaaagggtatacagtctggaaagggaggggaacagaagaaaaaaggacagaatacaccttaaaagggggatactcactgatatataagaagcaaggactgactttgtgtaaaaaaaagtagagagatgcagagatagagagagataagcattaagatatacacagcagttggatattctaaaataggagggagggagatccaaatactctaaaatactaagaggagaaatttctgaaaataccaggcagcagtagaaactattgtttcattaagttatcttggtgatttcttagatttcaaattcctgaaatgaatcctagttcactatttcattgatctctcttgttttgatttttttttcaaattttcaatctgtccaatctagtttagttcattcgagtgttagaagtggaatggatttcgttttgagtgggatgtgaagtttgctgaacaagtagatactctacgggtttctggggtcgatcttgacacctggtggttagaatatgaggtttatctgttgtactgttgattgtttgagcttgctgaatctcatttcttcattgtttaccctcttttccaggtatacacttctatttccacctaatgtaaagcttggcttggaatatataaaagatggatttatggagctttgagtaggagttatgttgtgttagtttacttgtttgtttctatttcattttggtagttttgatcgttacccctccacccctgaatatgtgatcaagagaataattttctaaatattgtagattacatgatagtttggatgggtatctcttttagttgaagccttttaaatatattcggttggttgcttgtttttgctttaaggtctggatttgagcctggttgaatatagctaactcaagatcttttggattgttaaatatgtactagttaaggttgttccaatgtttatttgtcgaagtaaataagtattttgcttcctgctctcttatgagtttctgaaatgtatggacttttatggtaatatgatttgtttcgatgctgtaattgaatcttaatttattgaatcctgctgtcagttaattttttaaaattcactactgctaatcagaacagaagggtatttgtgtggcattgtgaagtttagtcattgccggggactgatcatttagcagctgtaatcactagttgatcacagttgtaaattgacgaccatgtactcatgctaagttatttaaattgtccgatggtttgttttcctattcttgtttctctgtacgaatgtttgataggcttcttatgattagctgcgatctcatttgtattcaaagatctacatgagttctcgtataactagcaggtagtgtgttaaaattggaattctagtgaaaagtcaattgaagttgtatgtgtcaatagcacatgggtttttgtaatttcaagcattgaaagtgtattgcgtgattggcagtataatcgtttaagtcgactattcatgcacctaacaaatgttgaactgggtattagtttttgtacaagtcatttgtgtattctggctcatgtaatattgctatacaattgtttcatgatatcatcagtttctttctagtttgatttgaaaataaaaagggtataaggattttcttttggaattcaggatccatgttggtagaatccatttgacgtacatgtcaaaaattaatatttacacatctatccacattgaccttccataattaatggccctcacaaaactagttagctttttatagaaaacttgaactgcgccattttcattaaataatccatggcccttatgtaattaattttaatccttagaaaccgagcgtgccatttagttaaatttccatggccctcgcaaagttaaaaaatgcatagttgcattaggcgcgtaatttaaaattaccttcctaaactcgggtgtgcatttcatgtgacccaaattaaaatcccaacaatgttaaataaaatgtgtcgtggaccgcgtggttcaagacatattttaaatgacgttgcaatcttcctaaaaaatgaataagagcgattaataagttaaaatataatcataggctaaaacatgtattaaatcagataataggccaattataatagttgagcgaccgtgctagaaccacggaaccggggaatgcctaacaccttctaccgggttaacagaattccttaccaggatttctgtgttcgcggactgtaaaacagagtcaatcttttcctcgattcgagatttgaactggtgacttgggacaccataaattatcccaagtggtgactctgaatttttaataataaatgaatcccgtttcgattgtccctttaagttggaaaaaacacccttataccctttccggggtgtaggaaaaaagggaggtgtgacaccacctgagtgttgtagctgaggaaattgagactaaccctggcgacctgaatgaccaccccaaaaactctggagcggaggtgcactgataggagttggtggtgcgctgtaggactattgatcggaataccacatctgcggaccacggctacctgaagcgccgtgagagacttgaagagatgactaaaagggcctaggaggatggcctctaccatatgaatccctgcatccagaagaggcaccactgaatctacctgaatgatagggcctcttatccgaccattgaccacctccctacgacaggaccatctccactctataggccacattggccgcctcctaaaaagtgatctcactcctagcctccctagccatttgaaagagaatgggctgaataagaccataaataaacctcctcaccttctctctctctcggtagaaagtatgaaaagagcatggcaagctatgtcgatgaacctggtctcatactgggtaaccgtcatggaaccctgctggaggcgctcaaactgcctccgataagcctctcgctgagtaatggggagaaacttctccagaaatagttgtatgaactgctcccaagtcaaggctggcgatccggccggtctagctaagcaataatccatccaccaagtcttgggggatctaggcaagcgaaatattgcaaaatcgaccccattggtctcaataatatccatgttcttgagaactcatggtagctgtctagataatcctggggatcctcagtagatgtaccgttgaaagtggaagtgaagatcttggtgaacctatacagcctccacaaacatcggcagacatagccgctccatcacaggtctgagctaccacactcggctgaattgctccaactggctgaaccgctggagtctgaatctgaagagctacctacttcggagtgcgagtagtaggagtctagccccccctccatcccgagagacggctggtgctacaggaagcaagcctactggtgacgctctccatgagacccactaatcggacaagagcttcctaaaggactggggtagaaataaacccctctgggacctgagctaggcctactggagttgctggagcctcatcatcaaagtcaacttgaggctccactattggggctgttgctcgggactgagctctacccctacctcagcctcgccatctgcccctcgtgggagctactgctgggggctcgagctactgagcggtagatgaggaagcgtgtgttctcgccatctgcgaaagaacagagtagaaattcaattagcattgagaaacagaactgcactacatgaaagaacaaatgagaagttttcctaactctatagcctctggggataaatacggacgtctccgtaccgatccctaagactctactaagcttgtccgtgaattttaaaacctatgtaacctacagctctgataccaacttgtcaggacccgaaatttcccatcctcgggagtcgtgatggtgcctactcgtagaagctaggcaagctacgaacttagaaatcattagctcttctgttttaatctctttttacaacttatagtaacaagtgataaacatctaattgacatcggaaaatgagatttaagcggaagtcttaaataaatataaaaccaaaatgtttcgaaagtcaacacatgcctctacccagaaactagtgtcacaatatccacgaactacaaagagtactacatacaacagtttgaaggaagaataacattgtttgtatcggatgcatgagataacagaacataataaaagatagaggagatgtcgggcctgtgaatgcctacaaggctacaccagtgtctcggtggactgaaggctggctcccctactgctgctgatcaagtgtcgctccggtatctgcacagagtgcagaatgtagtatcagcataattgaccccaagtgctggtaagtgcctggcttaaccccaacgaggtagtgatgaggctaggaccaaactccagatgaacctgtgcaggtatataatatatggcggaaaacaaacaggaataagtagtttaaaaatgggagagggtacaagcttcggggatacatatcaagaccgacagaaacgtaaaaagatatgaaaggatagctcaatatgtacaacaatataataaaaatattgttgtggtgcgtaacccaatcccttatcatttagcattgttgcggcatgtaacctgatccacatatatttagctgtttcggcgtgcaacccgatccaatataatatttgttgcggcgtgcaacccaatccaatataatatctattgcggcgcacaacccgttccaattatacagttaacaataatcataattaaccgtcccgacaaaggatcaacaatagactatattatccccgcaagggaactcagcagtacaagtatatacgtcccagaaaggaagaatcggctagaaccaatcttaactcaactcctactcgtctcaattaccaccatttctcaatcataagaagatcctacgataaacaaactaagtctttagtcaatatcaaggatttactcactatttcaaccatagtaatattgaagaatataacaagtatcaatttaagactcacggtcatgcttgacaccaacgtataaatatttgtcaccatgcatataaatcatactcaacaagaagcaaagagcaaatacgactcaactcctaatccctcaagctaaggttagaccagaaacttacctctatacaacgaacacaattcaagcctcaactacagctttacctcttgttccaccaccaattcgcttgtatttggtcacaagttacttaattacataaataaacgctaaatgaatcaatttgaatacatggaaatggattttccaaagttttacccaaaagccaaaattgcccccggccccacatggtcaaaacctgactttcgaaccaaaaccctattacccattccccacgagctcaaatatgtaatttgtttttaaatcggacctcaaatcgaggtccaaatccctaatttttgaaaaacctaggttctacccaaaaacacccaatttcccccatgaaaataattgatttgaagttgaaatcatgttaaaagatgttaatgattaaagaaaactagttaaaaacgacttacaattgatttggagaagaaaggttgtttgaaaaatctcctcttatgtttttgggattattgaaaagtgcaaaataactgaaaatatcgtctatttatacccctctcagaccccctgtgtgtaccgcacaaaatggactgcggccgcacaggtcttcctgaggtactgcagtccagtgccatgtgtggatcgcacgaaatggactgcgtccacacaagcctccaccatggaccgcaagaaatcgagcgtggccgcgatggcttggccttgctcaccgcggaccgcacacatcccaccgcgttcgcggagtccccatcgcggaccgcgagacctggcttcagagacctgcaacttctctgaatctgcaacttttccctatgtgtaaaaacatcccgaaactcacccgagccctcggggctccaaatcaaatgtcatactaattaaaaaatatcatatggacctactcgtgcgatcacatcatcaaaatcacatgtaaaatcatgaattaaatctcaaaactcaatattttcatcaagaactctcaaagttcataactcttcaaccggaagtccaactcacgtcaaataaactccgttttttcaccaaatttcatggcaacgtcttaaatcatatataagacctataccgggcatcgtaaccaaaaaacgggccctataccatcatgttctaagcaaattttattttaattttccttaaaaagtttaaaaaaaacaatttcttttaaaaatttatttctcgatcttgggacctcggaattcgatttcgggcatacgcccaagtcccatattttcctacagaccctcggagaccgtcaaataacgggtccggatccgtttacctacaacattgaccgaagtcaaattaactcatcttatagccaaattttatcatttttcacagaatttcatatttaagctttccagctacgcgttcggactgcgcacgcaaattgaggtgactctaaatgaggttttcaaggcctcaaaacacggaaactttgttttaaaataagttatatccttttgggtcattacgcaaatggtctcacacttagacgcattttcaaccatttttcacatcttctcaaaatataaactctctagggagattttttcaaaggcaacttctcttcctaatcaattgtaagtgatttctaactagttcttcaatctttaaaatcttttcacatgatttcaactcaaaatcaatgattttcatgggggaaattgggtgttttcggtagaacctaggtttttaaaaaattggggatttggacctcgatttgaggtccaatttcaaaacaaattatatatttggattcgtggaggaatgggtaatttggttttggttcgaaccttgggttttgaccatgtggtcccgggggcgatttttgactttttgggtaaatctttggaaaacttattttcatgcattgtcattgattcatttagcatttattaatgtagttaagtaacttgtggatacatacgagcaagttggtgctggaatcaagagttaaaacgatagttgaggcttgaattgtgttcgtggcatcggtgtaagtgtttggtctaaccttacctcgagggattaggagtcttgtcttatttgctatgtgttaattgtggagtacgacatataggcatggtgacgagtatctatatgtcagtgtcaaacatgccccttagtcttgtattgtaattgttatgactccgttgtggtttattgcgcttcacatgttattatcattattgttcccttgccgggatgttattatcatattattgttcccttgtcgggatttgttttgatattattgttcccttgtcgggatgttgttgaaatattattgttcccttgacgggatgttgatatattgctcttgttaccttgccgggattcttttgtgattgttgttgatttgtaactgggatcaggtggcatgccaccacggaaatatatgaaatggacgcgagttgcacgcatgcaacaagatatatgaaataggagtgggttgcacgcctgcaacgagatatatgaaatgggagcgggttgcacacctacagcgagatatatgaaatgggagcgggttgcacgcctgcaacgagatatatgaaatgggagcaggttgcacacctgaaacgagatatatgaaatgggagtgggttgcacgactgcaaagagatatatgaaatgggagagggttgcacgcctgcaacgagatatatgaaatgggatcgggttgcacgcatgtaacgagatgcatgaaatgggatcggattgcacgcctgcaacaagatgtgaaatgaaagtgaattctgtatttgttttccttatccttgttagtaattggattttggtttctttatattcctcttgatattctgttgttatctgttattccccgaaggatgtttccccccgtaattatctgcttttattttttcgttgtatatggtttaactgcacaggtttttttggtagtatggtcctagcctcgccataacttcgccgaggttagactaggcacttaccagcatatggggtcggttgtgctgatactacactctacactgtgtatgtagtattctcctgcagacgtccgcgggccttggcgtcacctcctatctttactttatcctgtttcctttacttatttcagaaacagtgtatcttttatctttcagactttgtatgtagtattcttggactgtctgtgaaactgtgacaccagttctgggtagtcgatgcttaaacaattgttagatacatattcagataatttattgctttcttgcgtttattataaatttcgttgtctacaagttattgttttataattgttgaagaatataaaaggggtaaaagggtaattagttcaaacaatcggcttgcctagctcacattagtaggcgacatcacgtctcccgagggcggtaaatccgggtcgtgacattttttgaaatattttgtttacatttaaaaaaatattccacgtcataccaattttttctatatatactctttgttacacttaaaagtcgctatagaaactattaattagaaaccaatttctctcttgttgagttttaaaaaaaatcattcacataatctaataattcaaaactaatattcttcaacgaaaaaaatattatactcttgcaatattggcttgactacagctaaatgaaggggtttcagcttatacctttcaattcattgaatgtgctaaataaattaatgatagcaactatatagccaaagttttgttatttgtttgatgtccattcatgtaaattgactcttcaaacaaatattctccaagaagaaaaatgaaacaactttttttttaatattgattgattttgtgatgtttctttctccagcatgtaagtttactttattatatatgcaagtaaacttttatttggtcgtgtaaactcttttttgttatttagataaacatagacatgtaccctatatattacatttattttaaaagatttcattttattcaaatctagctacagtgtttcaaagaactatacttataggattttaaatgtgaaaaagttttatagttatatggagtaatttttttttttgctagaggcgaagtagtattttaaataattagaaaaaataacaaagttcctaacatgattgcatatgatcattaaccgtattaagtatgataacatgataaaaaagataaattttatttttgatttaaatgcgaattttaaaaatttatctataaattaaaaattatcttttaattcaaattccttatatatatatatatatatatatatatatatatatatatatatatataaaaaactaaaatagtcaaatatagaataaagataccatatactattgatatttattagcttgccacatggcttaaccatactgtcaattatatatggtaactttcttgctttaatatatatatatatataatctatatttttaatttgggatttaccagccacctatcattaattagaccgttcaaaaagccgtatatttcgaccagctagcatccaagtctaacgtttaccctcttcaaaatatatatatatatatatatatatatatatatatatatatatatatatatatatatatatatatatatatatatatatataatctatatttttaatttgggatttaccagccacctatcattaattagaccgttcaaaaagccgtatatttcgaccagctagcatccaagtctaacgtttaccctcttcaaattttgtatattatctttatttgaattatacttccagaatcgttttccctccatgtgtttaaagttctctagaataaaattacaagaaaataattgtcaatttactccatccactagctagggatgtacaaataaaatcgagaaaccatactaaaccaataatcagaatcaaatcgagaaaaaaaccccgactatgcatggtttggtgttgggaaaaaaactcgaccataattgatttggttttaattaaaaaaagacaaaccgaaaccaaaccaacccgacattacatgtatagaaatttaatatatttaatacataaaaatatttattgtagtgtattttataaatatttatttgtgatgacccacaaggtcatcacttgttttaaaagcaattttatgttccgaggctttgaaaacctctttctgtctcacctcgcattatgtgcgtagtccggacgcgcttttggaaagcttctatatgaaatctaagtaaaaatatggaaattggcttttaaaatttgataaaagttgactttggtcaacattcttggtaaacggacccagacctgtgatctgacgatctcgtaggatccgtagtaaaatatggagcccggtacaggtcctctataataattaagttgaatctgtaaagtttggtaggaatcggagtccgtttagtataaatcggacctttatttgagaaatggaaaattttgatgttcttgagagatttcatgaatttgaggcttaattcatagttgttgatgttattttgataatttgatcgcacgagcgggtccgtatgatgtttttggacgtgcgtgcatgtttggtttggatccccgagggctcgggtgagttttggataagccacgaagtgaatttggacttagaacataacagttgcaggttcagagaaagttgcaggtctctgaaaccaggctccgctgtcacgacccaaaatccactaaaggtcgtgatggcgccgaacactgctgttaggaaagctaaccaaaatacttaattaaattctcgttttaataattttgaaaagtatgattttccatcaaattttactagtaaaagataaactttacaatgtaaataaaagaatgtttagaaataaatataagatacccaataatcatcccagaacccggtgtcacaagtgcaagagcatttactaggaatgaaataaaatataataactatctggaataaaaagtggacagaaatgaaaatacagtacaacactctgaaagggactctactggctgcgggtcgtctcgacaaatgcagctcacctaagtctccgtatcaaccatgccgatatgccactaagccactagccacacatgaacatgtgcaacaaaaatgcacatcaaatgtagtatgagtacgaaaacaacgtgtacccaatgagtatcctatctaatcttgaagaagtagagacgagaggtcgactttgacacttactagtggtccaatgataatatagtgaaatgtgaggagatcatgggttttttataaaacaaacaattataattcataaaggtaaacaacttcccaaataacaatggatttccaaagaattacttttcatcttctttatcaatttatctctggccagggaaggaaaatataaacatttataagtctcaggcaaaaacacaagcatgcgcatatttgtcacgaccctaaaaccaacccggtcgtgatggcgcctatcatgaaactaggccagccgacacaactcccgaaaatttaaccatttaatcaataacagtaatttttaagcctttaattaaggtaagtctaaataaatagtgctgaataaatatacaagcctgacatcggagtgtcacaagtcacgagcatctactaaggtctgaatacaatgaagagtctcaaaatatcctaaatacaatataaggaagacaagagggagaaaagcagtgttgcgtacgtcggacaactatcttgctaactccgatgactttgtcattgagcaatcaacacccgttaccgggttcagaagttcctgaatatgcacacaaggtacagggagtaatgtgagtacgccaactcagtatgtaataaaagtaaatgaaaattgagcagtaagaaaatacgtaaaacacagcataacgctacagcaaacgcagtacatttccaaaatagtacagaatcattttcttagtaaatcaagcccagtttcaataaaacccttttaaacaacttccaatagcttcaagtaaatgataaaaatagtgagaaaaaaatagaaacataaacagcccctcgggcaaaatatgtaccataaaccacccttcgggcataatatcaatagaaccagcccctcgggctacctcacaatcactcgtaatcaactcctcgggcataacatgaatcaagaactgcccctcgggcaaaacatggatcaagaatagcccatcgggaaacaatatgaaacaacaacagctcctcgggctacattatataactcacactggataccctcgctcactaagggtgtacagactccgggagcggccccttacggcccaagcacaataacaagccatctaatggcctaatcaaacaggatctcggcctcatatcaagccacatcatagcgtaacaaatcaggccctctgcctcataatcatgaatcagtacaacactgctgcagcgcgcagtccgatccctcagtatcctcataacataggccctcggcctcacacagtcagaaatctctcaagacactcgggcaacagtaacacgtgatgctcagcccaaaatatcatttaaaatataaaaaatggagtaaatatgtctaagttatgaaataggtagaatacagcataattgagtacaaatatgaagtcaaaatagtgaggaatagtagtaaaaattccctaagggtccaaaacagttggcacgaggcccaaatatggcattcagcccaaaatatggtaatactttccaaaacacactgatatcaaatagttttcattcaaatacgcgacttagcactcgtacaggacggaccaagtcacaattcccaacggtgcacgaccccatgctcgtcatctagcgtgtgcgtcacctcaaagtagcacgacgatgtgaaatacggggtttcatatgcttaggacaaacatttacaatcattacttacctctatccggtccaaactctagcctgcgattcctttgccgctcgaatcggcctccaaatgctccaaatctaaccaaaatcagtatattatcatcaacatacactaaaggaagaaagaccaagcgaatattattaaattacatcaaaaatcccgaaattggcaaaacccaaccccgggcccacgtctcggaatccgataaaaatcacaaaatctgacaaccgattcaaccacgagtccaaccataccaaaattactaaatttcgataacaattcggccttcaaatcttcaaatcttattttcaaatatctaggttcaaatccctaatttacacctcaaaaacatgtaatctagtcggattattcgatgataattcaatattatggagtagaaatgatcacaagtgacttacctcaagatttctcatgacttctcgctcaaacatcgccccaagccgcattcttttcgtccaaaaatgtgggaatgagctaaaaaaacaagacaactcaataaaacacgattttggtcgccaaaagcccctttcccgtcgctacaagtgccacatctagtcgctaaaggtgccaccagatcctgctgcatcagtaatatttattttcactaaaaaggctctaactctaccatacgaactcggaattcgatgattcttattcctatgagtcacaaataataatacgaacatagtccttcaatcgaaactcaattcgaagctcatttgcgcagtacgatatccatttagctcgttaaacaattaactcatgtttcccttcgaaaacccaatcgcgacttgatgaaattagaccaaacttttcagatcactcctataattcattatcaaaattctggaattcttgaaatcaaatttcattctctagaactaaaaatggacctttggatcattacatgcttatgctcaaaacagcaaaatcctccaaaaactcttccaaaacttatccgagactcatgggaccccgaaaaatatgccaacacaccccataacatcattcaaacttgttccaactttcggaatgcaaaaaacaacatcaaaacatcgaatcaccctcagattcaagcctaagaattccaaaacttccgaattccgaattcgatcaaaaagtctatcaaacctcgtttgaatgacctgaaatgttgcaaacacgtcacaaatgagacaacagacctactccaatttccggaattccattccgaccccgatatcaaaatttcgactccccgaccgaaaaacgccaaatttccaatttcaccaattcgagcctaaatctaccacggacctccaaaatacatgccggatgcgctcccaagtccaaaatcacctaacggagctaaccaaatcataaaaatccaaattcgagattgaatactaaaaagtcaaaacttggtcaaacctttcaaatttaaagcttcaagttgagaattgtttttccaaatctattccgattatcctaaaaaccaaaaccaacgatttacataggccataatatatcatatggggctagtcatgccggagaactggcgagcaaagtgcaaatgctcaaaacggccgatcgggtcgtcacaagagcattgccgcaaaacacctgtagaaactcattacctcgtaaacacccaaaaaactaatcatatccttaccatgctgatccggcctactaccaagctatcccatctatccaaattccttctaatttaccttcaacttgatacttcttcttgccataacaccacaatcctcgacccagactcgccacacgagacccaagcataaagccacattgtcctatggttcataagccgctgactactctctcaaatatcccctaaagcgccacattcgaaatattttccctgaagagacatcatgcaaatctaaaggcattaccttcacctcctgatattgatgtatagaatccataatgatataaaaataccacgagtcttgacaccctccaatgcaaaccccagtttctaacctaatatacaacttgaaaatctccaattattaaatgtaacatcttgaacccattagaaccattctcaaaagtcatccactctactcaaaccgcaattagaccgatcaaacggaccgacgatctgtgctcattagcactctgacaccgcataatgtaacttcaccttaatgcaactaagaaacttcatgttctatgcaacatacatcctttaccaataacaactcaagtcattccgtgattctcatacacccataaagcataacaaaacctgtattgaaatttcctttactagagcccttctcgggatcaacctccataagccataactaattcaccagtacgcctcaaactagaaccaacatagcacataactgtgcaatcaactaattaattgcagactcccccacttgactcaaagccatagatgaaaacatacaataactcataatgcatatactctatcagtaccataataccataatgagattaaactccatacttcataagctcctacaacacagaccatctcgtacttcaaatcttctgcaaatctcacatttaccctcgcaacagtcaagcccactctcttaagtgacccaaattcaaattgcatacatatgtttcactggtaaaagagatcttccaacaaacaacataaggctcatacaaacttcagaacactctaaaggaggtaacccacctactttgcctcaaactaatagctcttcatacccttccaccgtcataaacattacgcaatcacttaatcttcctaagtctgaactcatatcataacatgaaatctactccactccccaactaaacaacatgaaaagattcttcacacacccataacttggggctatacatcaagttaagatgaaaatcaagcaccaattagttcttttatcctcaagcagacccttctcgttgcttccaaatcatatgaatacatctcgcagtcacatctcactcataacatagtcatccaaccatcacttccactaatagggacactaccggacatataaatttaaaagcacgtgctcacataatcagcacctcagtactcaagctacaggcaaaacccggcctcaagacctccaaattggcccaacatcaatacacagaaatcacatctcgcccctcgatcaggaaatcacaaaccatcaatgcacagctgataccgagcgctcatgcgcgcatcctcacgcatggaaggaattcaaagagttacatttcaagctgaatcaaggatgcacgataagaatataagaatgtgaagtttttcctaaaggttctgcagcctcccgaggataagtacagacgtctctgtaccgatccgcgagactctactaaacctgctcatgactcgtgagacctatgtaacctaagctctgataccaacttgtcacgaccctaaaattgacctggtcatgatagcgcctatcatgaaactaggccagccgacaatactcccgagatttaaccatttaatcaatagcagtcatttttaagcctttaattaatcaaatatctcataagataactttaaatgaatagtgcaaaataaatacacaagactgacattggggtgtcacaagtcacgagcatctactaaggtctgaatacacctaagagtctaaaaatatcctaaatacaatataaggaacacaagagggagaaaagcagtgctgcgaacgtcgggcaactatcttgctaactccaataactctgccactgagcaatcaacacccgctatcgagttcagaagttcctgaatctgcacacaaggtgcagggagtaatgtgagtacaccaactcagtaagtaataaaagtaaatgaaagctaagcaataagaaaatacgtaaaagacagcataacgctacagcaaatgcagtacatttccaaaacaatacaaaaatcattttcttcgtaaatcaagctcagtttcagtaaaacctttttaaacaacttccaatagtttcaaacgagtgataaaaatagtgagtaaaaatgatagaaacataaatagcccctcgggcaaaatatgtaccataaactactctttgggcataatatcaatagaaccagcccctcaggctacctcacaatcactcgtaatcagctcctcgggcataacatgaatcaagaaccgcccctcgggcaaaacatggatcaagaacagcccctcgggcaacaatatgaaacaccaacagcccttcgggctacattatatcactcacactaggtacccgcgctcatgggggtgtacagactccgggaggggccccttacggcccaagcgcaataacaagtcatcttgtggcataatcaaacaggctctcgacctcatatcaagacacctcgtggcgtaactaattaggcctttggcctcataatcatgaatcagtaaaacactgctacgacgcgcagcccgatcccacaatatcctcataacacaggccattggcctcactcagtcataaatctctcaagccactcgggcaacaataaaacatgatgctcagcccaaaatatcatttaaaatatcaaaaacggagtaaatatggttgcgttatgaaaatagtagaatacaacatgattgaatacaaatattaagtcaaaaaagtgaggaataatagtaaaaattccctaagggtccaaaatagttggcacgagacccaaatatggtattcagcccaaaatatggtaatattttccaaaacacaatgatttcaaatagttttcaatcaaatacgcgacttaacagtcgtacgggacgggtcaagtcacaatccccaacggtgcacgaccctacgctcatcatctagcgtgtgcgtcacctcaaagtagcacggcgatgtgaaatccgaggtttcatacccttaggaccaacatttacaatcattactttcctctataagtccaaactctagcccgcgatgtctttgcccctcgaataggcctccaaatgctccaaatctaaccaaaatcagtatattatcatcaacatacactaaaggaacaaagcccaagcgaaaattatcaaattacatcaaaaatcctgaaattggccaaacccgtcccccgagcccacgtcttgaaatccgataaaaatcacaaaatccgacaacccattcaaccacgagcccaaccataccaaaattactaaatttcaataacaattcggccttcaaatcttaaaatcttattttcaaatccctaggtccaaatccccaatttacaccttaaaaacatgtaatctagtcggattattcgatgataattcaatattattgagtagaaatgatcacaagtgacttatctcaagattccccatgacttcttgctcaaaaattgccccaagccacgttcttttcgtccaaaaatgtgggaatgagctaaaaaaataaggcatctcagtaaaacatgattctggtcgctaaaatccccattcctgtcgctaaaagtgccaaatctggtcgctaaaggagcgcaccagatcctgttgcaccaacaatttttatttccactaaaaaggctctaactccaccatatgaaatcggaattcgatgattcttgttcctatgagtaaaaaataataatgcgaacatagcccttcaatcgaaactcaattcggagatcatttccttagtatgatacccattttgctcgttaaacaattaactcatattttgcatcaaaacccaatcgcgacttgatgaaattagaccaaacttttctgatcactcctataattcattatcaaaatttcggaagtctcaaaataaaattttaatctccagaactgaaaatggacctttggatcattacatgtttatgctcaaaacggcaaaatcttccaaaaactcttccaaaacttatccgagccttatgggaccccgaccaaacatgccaacacaccccacaacatcattcaaacattttccaaccttcggaattccgaaaacataatcaaagcatcgaataaccctcggattcaagcctaacaattccaaaacttctgaattccgaattcgatcaagaagtctatcaaacctcgcccaaatgacctgaaattttgcacacatgtcacaaatgatacaactgacctactccaatttccgtaattccattccgaccctgatatcaaaatttccactgccgaccgaaaaaggccaattttccaattttgccaattcgagcctaaatcttccacaaacctccaaaatacattccggacgcgctcccaagtccaaaatcacctaatggagctaactaattatagaaatccaaattcaagttcgaatactaaaaagtcaaaacttggtcaaccttttaaatttaaagcttcaagctgagaattgttcttccaaatttattccgattatcctgaaaaccaaaaccgacgatttacataggtcataataaatcatacggggctagtcatgcccgagaactggcgaacaaagtgcaaatgctcaaaatgactggtttagtcatcacaatatcatgccgaggtcgtacggctcgatccaacataaatgtaaaatgtgcactgccgagggtcgaacgacacgaaccatagatgcatctattaccccgctcgcgaatcatacatgtgacacggtcacacatagatacacccattcaaacaactaattaagaatttatcggggaacgtttattcaaataaaagccaattctcttttactgattaagaaaatgaagttttaaaccttttagaaattcatttaccaattcaataggatttaagcaattcaactatcaataaaattacaaatattctaagtagagcatgcttttgggtcctagactacccagacttacacataatagtagctacgctcggactctcgtcacctcgtgagtgcatagcccccacaaatagaagcacataaccaattattttaccgatgaggacaattccctcttacaaggttagaaaagaactcacctcgctccgaagatccataaccggcattccttgcccttccgaagactcgaatcaatgcacaatgctccaaaactagccaataattattcaaatccattaatgtatgttaaattactcattacaatccaatttataacaattcctaaccccgatcgaaaagttgacaaaatcgccctcgggcccacatgcccggattccaaaaaatttcgaagataaagtttatccatgaactcacgaactcaaatatatgattttctctaaatttcataacaaaaatcgtggtcaaaatccaagaatatcaattctctagatttccctcaaaccccaagtttcgaccaattatttaactcaagataagtggggataacttaccctgtcgttgatcatgaaaaccccctctagaaaccttccaaaatagtccacaccaaatgaaaatggggaaaaaatgaccaaccccgacattaaaagaatacactgcctctaacctttccgcacatgcggggcataagccgcacctgcgaccatcgcttctgcggcacacgtaccgcttctgcggtcccagggccaggtccaaaagttgcttctgcggtctccttaacgcaggtacgctcccgcatctgcgtttagagtgtctcacctatggtcattgcaccccttcacccaaaccgcatatgcgacccccttggccacttctgcggctccgcacctgcggccaagacctcgcaggtgcggttacaccagatatcagctgcctcaattcttcctcaaattccaatattgatccgttagccatccggaatccaaccgaggcccccggggaccccaaccaatcatgcggactagtcccaaaacacattacggacttgctcgagatctcaaatcatatcaaacaaatcttaaaccatgaattgccctccaatccaagctcaatgaactttagaatttcaatcttcaacattcgatgccgaaacccatgaaatcacttccgattaacttcaaattttgcacacaagtcacatttgacatcacggacctactccagcttccagaatcggattccgacctcgatatcaaaaagtccacttccggtcaaacttctcaaaaaccttcaaatttctatcttaaggcaaatgacccacggacctccgaattcacttccgatcacgctcctaacaccagaatcatcatacgaagctaatcccagacacggaatccctaacggacatcgataacactgaaatgcacttcaacccaaacttatgaaattcttccaaaaatgctaacttctacaataggtgccgaaacgttcccgggtcttccaaaacccgatccggatatatgcccaagttcaaaatcatcacacgaacctataggaacctttgaatcctaattccgagatcgtttactcataaatccaatattagtcaattctttcatcttaaagcttccaaaatgagaattctctttccaattcaaccccgaacttcctgaaattcaattctgaccatgcatacaagtcatactacttgaagtgaagctgttcatggcctcaaactgctgaacgacgtgttaaagctcaaaatgactgttcgggtcattacattctctcccacttaaacatatgttcgtcctcgaacgtgctgagaactgcactggagttgtccgaaatcactttttaacacctcgaacacctacccgtgctaccacaactcaactgggaaccctagcttgatcaatctgaagataccctttttcacttaagcaaataagtcttagagcccaattccaacatccagaattctctgccatgcctgtttccaacatacactcaccgtatcaatcactgcatgcagcactaaaacatggctgcatacctctgctgaaatcacaccttgcactactttacttataggaccacaataacattctctaatcaaattagtcgaaattccacgaatacgacactcccaatgcatctcataacctatatacatattgctctgattcttaaaataccaccatgacggaagatgcacgtagaaattcataaacaactgccgaatcaacaaatcattagggctatactcacgacaagaatcattacctccttctgaaccaaataatggaatttactcttaaatattcttcatataatccgattgcactgaccttggttccgataatctcatctcacctagtacgaactgctcaggcaataagccacctagacatgaccaaaagtctcatatgatgctgcaatgtgccaataggctaccaacttgaacgtgatacacaaggaagacgaactctggaaaggactactcaactcacacaattgccattaactttcctcaaaaaatgaaaaacaaacacacaaaaacagaatatagaaactttactcaacatcatactgctgcggcgtgcaacccgatccaaacaacatacctatggcggtgtaacacccgatccacacataaaattccataaggagatacacacccagctaaattgctcattacaacaaaaataccaaatatctgtcacaagcacgctaagtgcttaataccatccctggggatacatatagcaccataagctaacaaacataagcacaactgaggtgcgatatatgattaaaatctcaagagtcatcctgctcacataacaccatcactatgtagaacctcaacacacaagaaatttatcaagctgttcacaactcacacggcacaatattgcattacaggaaatagccgacggcgaaataacatccaacatctgaatactattaaataaggagagttatgctgaaatgacacatctcacctgatatagagcccacattcatatttaaatccacccacagatctcaggtcgattctgatcgtaccaaattaggccaataatctttcctgggtccataacaaccccctcttttcccttaacagacaagaacaaccatcataaccggggctatcctccatagtccacaacccaataagtcgagtgccatccaggcataaattctcaaattaatgatgtcaccactatcttcatacttggtttaaattcttcaatcaatcaagtgactacctgccacacttatacaatcttcccgtggggcacgctcccacgaccttccgtaacagacaacaagtctgagcatctataccaccagtcgcactaacgctgagaaagcattcaagaatccataaccaggatgcaaagccctttaaacaccgatctcaggtgatgctgaagacaatgccagcttactttaaacattcaaatccctttcctgctcatccgagctcgtgacatccttgtcaacaccgaaccacaaccttaatcctcacttccaaatcccataacactcactgtacccaacatgccaatatacaatagaacacgattttcatcataactccggagccactaatagcttaacacttcatcatataaaaacttttcacttaacaaacttcaggagaaacatagcaacacataaatgaatcctcataatcatagaatatgcaaatcgtcaagtagtggtctaagaaaccatagaacttccgggatccgcctacacataacaggtcataacactggaatactcccaaataaaatcaattacggcagccgacaagcctcacacgtaccgccacaaatcacttgcataactcaatcacgctaaaggaactgatccctgccgccagtatgccgattcaaccatggtcaaccaatccaacttctcctaattcatcactaacttggcttatagataataatagctccattccttacatcaccaaccaaaatccgcacccatcttgagcgactccattctacgagaccaaattgtctccaaacccatgaaccgtttcataccctcattgcagacacattcacatctacaactgatacacccattctgataacttctccacgaatccgaagtcttttgctcatttttctcccaatgctacactgcaagtcaaacatatcatagaacattccgagcctctcgccatcatcttctacataagcttggttcttagtcgtacttataggctcgaaatcattaggcaccataccataacttttgaatcactaggaccgttgtggagagccacccactctgacttggtcccggatataatcaactccatgaatcttctagcatatgaccaccttctcgatgaagcactcggccaaaccactttcctttaaacccgcatctatacaaggcataaatcctaaatcctcccccaagtctaaagatgattcaatacggccaaccatagcacacctttaataattcctttgctcaaattacctcttatgctctctcccttagctgaaatgacttatcaatatgctaataaccggaaatctcattaataggcaaccatacattccaaccgtaggcggtgggactctcccacttagcttgaagccacaattacacaactcttgaatccaccaatattctttatctcttattgacatgaccttgcgcaattaaaccgccagattccttgaaatccttccattagcacttcataaatactctgaatttccatcaaaattcacatattcgacctcttaccggatggccattaaaatccttcgcagaagcttcgccaatcacgcgatcgctaacctactcacagggaataacccacctactaaaattacctaccgacttcttccaatgtcgttgcatggggtacaattactacgacatcaatagtccatcctgagcccgcgctcatccaccagctacacaagttcattcacttctcgtggacattaactaaacgtatgacaatatcttccaattcaaaattatgttgtatccttcttcatatcaagcagcttctttccgtcatatcaaatctcccgccgttatgctagtcagtaattcaaattaggcttgtaaacccaattaccgtccactaaaattcccccaaatcattccaaactttccttaaggtgcgtaatcatcctaccaccagacccatatgcaactccgccactctcccactttggcgaaacctactcctttaatcaactactcgaccttcgctactgatacctggctgccttaaaaattcaaccatcgcatgacacctcccacatgtacttcctcatccttcgctgcccaattattgccttaaataaaatctatcttcttagcacttgcacccacaaatcgctactaactttaaacctttccgaagatcatctttctcgccccgtcaacattggaagcactgattcaatcctgaaccaccgcaccccgcgatctctgacagccgcttctcaaatactatttcacaatatcctaccccaaaagcgaattgctaaaggccataacatcggcgaacttaacacattcaatcgaggacgatgacaccacattgtagatgaaaattccaccacgctcgaaaataccaagtctcgttacttcctctacccaactctggacgttcatgggccaattgttttttgtccgccgaaaataaaatattgaatctctgaatcatacactgagtagacttccattcaggtcattcaccaccccaacacataggcaagaaccttaccaacacgtccctactatgcaacaactgatcatgagcaatcatagaaatctgcgcatagactcaaagctctcaggatactgttactgagctgaaatgacaggatatccctccgcaaggcaacgacaatagcccaatcaactatgcagggagaaacatcccgcaccacatcaatagtaacattaaaattcttcaattctcgatttataataagcgcttcgcgtcgcataagattaagtaggaaggaaacaagggcataagcctcaaggaatcaaattggacgatgaggaatcaagaagggaggtgttcctaccagtcctgtagcctctctaggataagtacatgcatctccgtaccaatacgcgagactatactagacttgctcatgactcgtgagacctaagggaacctagtgctctgataccatgttgttatgacccaaaatccactaagagtcgtgatggcgccggacaatgctgtcaggtaagccaatcaaaatacttaattaaattcttgttttaataattttgaaaattatgattttccttgaaatttcactagtaaaagataaactttacaatgtaaataaaagaatgtttagaaataaatataagatacccaataatcatcccagaacccggtgtcacaagtgcatgagcatttactaggaatgaaataaaatacagtaattatccgaaatacaatgttgacaaaaatgaaaatatagtacaacgctctaaagtggactctactggctgtgggttgtctcgacaaacgcaactcacctaagtctccgtatcaatcataccgctataccactaagccactagccacacatgaacctgtgcaacaaaaatgcacaacaagtatagtatgagtacgaaaacaacgtgtacccaatgagtatcccgtctaatctcgaagaagtagagactagaggtcgacttcgacacttactagtggtccaatgataatatagtgaaatgtgaggagatcatggattttttataaaacaaacaattataattcataaagccagatagcaggtaaacaacttctcaaataacaatggatttccaaagaattacttttcagcttctttatcaatttatctccggccagggaaggtaaatataaacatttataaatatcaggaaaaacacaagcatgcgcatatctgtcatgaccctaaaaccgacccggtcttgatggcgcctatcgtgaaactaggccaaccgacaaaactcccgaaatttaaccatttaatcaataacagtaatttttaagcctttaattaaggtaagtctaaatgaatagtgcgaaataaatatacaagcctgacattggggtgtcacaagtcacgagcatctactaaggtctgaatacaatgaagagtctaaaaatatcctaaataaatataaggaagacaagagggagaaaagtagtgttgcgtacgtcgggcaactatcttgctaactccgatgactttgccagtgagcaatcaacacccgttaccgggttcagaagttcctgaatatgcacacaaggtacaaggagtaatgtgagtacgccaactcagtaagtaataaaagtaaatgaaagttgagcaataagaaaatacgaaaaacatagcataacgctacagcaaacgcagtacatttccaaaacagtacagaatcattttcttagttaatcaatcccagtttcaataaaacccttttaaacaacgtccaatagcttcaagcaaatgataaaaacagtgagaaaaaaatagaaacataaacagcccctcgggcaaaatatgtgccacaaaccaccctccgggaataatatcaatagaaccagcccctcgggctacctcacaatcactcgtaatcagctcctcgggcataacatgaatcaagaaccgcccctcgggcaaaacatggatcaagaatagcccctcgagcaacaatatgaaacaacaacaactccttgggctacattatatcactcacactgggtaccctcgctcactgggggtgtacagactccaggaggggccccttacggcccaagcgcaataacaagtcatctcgtggcataatcaaacaggctctcggcctcatatcaagccacctcgtggcgtaacaaatcagtccctcggcctcataatcatgaattagtacaacactgctgcagcgtgcagcccgatcccacagtatcctcacagcacaggccctcggcctcactcagtcagaaatctctcaagacactcgggcaatagtaaaacatgatgctaagcccaaaatatcatttaaaatataaaaaatggagtaaatatgtctgagttatgaaaacagtagaatacaacatgactgagtacaaatatgaagtcaaatcagtgaggaatagtagtaaaaattccctaagggtccaaaacagttggcacgaggcccaaatatggcattcagcccaaaatatggtaatactttccaaaacacactgatatcaaacagttttcaatcaaatacgcgacttaccagtcgtacgggacggaccaagtcacaattcccaacggtacacgacctcacacttgtcatctagcgtgtgcgtcacctcaaagtagcacgacgatgtgaaatccggggtttcatacccttaggacaaacatttacaatcattacttacctctttccggtccaaactctagaccgcgattcctttgccactcgaatcggcctccaaatgctccaaatctaaccaaaatcagtatattatcataaacatacactaaaggaacaaagcccaagcaaaaattattatattacatcaaaaatcaaactcaacccccggacccacgtctcgaaatccgataaaaatcacaaaatccgacaaccgattcaaccacgagtccaaccataccaaaattactaaattctgataacaattcggcctccaaatcttcaaatcttattttcaactctctaggtctaaatccccaatttacacctcaaaaacatgtaatctagtaggattattcgatgataattcaatattgtggagtagaaatgatcacaagtgactttcctcgagattttccatgacttctcgctcaaaaatcgctccaagccacattcttttcgtccaaaaatgtgggaatgagttaaaaaaacaagacagctcaataaaacacgattcgggtcgccaaaagcccctttcccgttgctacaagtgtcaaatctggtcggtaaaggtgccaccagatcctgctgcaccagcaatatttattttcagtaaaaaggctctaactctaccatacgaactcggaattcgatgattcttgttcctatgagtcacaaataataatatgaacatagacctataatcttatctcaattcagagctcatttgctcagtgcgatatccatttctctcgttaaacaattaactcatgtttcccttcaaaaactcaatcgcgacttgatgaaattagaccaaacttttcagatcactcctataatccattatcaaaattccggaagtcttcaaatcaaatttcaatctctagaactaaaaatggacctttggatcattacatgcttatgctcaaaacagcaaaatcctccaaaaactcttccaaaatttatccgagcctcatgggaccccgaaaaatatggcaacacaccccataacatcattcaaacttgttccaaccttcggaacgctaaaacaacatcaaaacctcggattcaagcctaagaatttcaaaacttccgaattccgaattcgatcaaaaagtctatcaaacctcgtccgaatgacctaaaatttttcacacacgtcacaaatgacacaacggacctactccaatttctggaattccattccgacctcgataccaaaatttccactcccgaccgaaaaatgccaaattttcaatttcgccaattcaagcctaaatctaccacggacctccaaaatacaatccggatgcgctcccaactccaaaatcacctaacggagctaaccaaatcataaaaatccaaattcgtgatggaatactaaaaagtcaaaatttggtcaaacctttcaaatttaaagcttcgagttgagaattgttcttccaaatctattccgattatcctgaaaaccaaaatcgacgatttacataggtcataatacatcatatggggcttgtcatgcccgagaactggcgagcgaagtgcaaatgctcaaaacgaccgatcgggtcgtcacaagagcattgtcgcgaaacacatgtagaaactcattacctcgtaaacacctaaagaactaatcatatccttaccatgttgatccggcctactaccaagatatcccatctatccaaattccttctaattcaccttcaacttgatacttcttcttgccataacaccgcaatcctcgacccagaatcgccacacgagacccaagcataaagccacactgtcctatggttcataagccgctgactactctctcaaatatcccctaaagcaccacattcgaaatactttccctgaagagacttcctgcgaatctaaagtcattaccttcaccttcctgatattgatgtgtagaatccataatgatataaaaataccacgagtcttgacaccctccaatgcaaaccttagtttttatccaaatatacaacttgaaaatctccaattattacatgtaacatcttgaacccattaaaagcattctcaagagtcatccactctactcaaaccgcaattagcccgatcaaacggaccgatgatctgtgctcatgagtactccgacaccgcagaatgttacctcaccttaatgcaaccaagaaacttcctgttttatgcaccatacatcctttaccaataacaactcaatcattccgtgattctcatacacctataaagcataacataacttgtattgaaatttcctttactcgagcccttctcggtctcaacctccgtaagccataactaattcaccagtacgcctcaaactggaaccaacacttggctcaaaaccatagatcaaaacatgcaataactcataatgcatatactttatcactaccataataccttaatgagattaaactccatacttcataagctcttgcaacacagaccatctcgtacttcaaatcttctgcaaatctcacattcaccctcgcaacagtcaagcccactctcttaagcgaccaaaattcaaattgcatacatatgtttcactggtaaacgagatcttccaacaaacaataaaaggctcatacaaacttcagaacactctaaaggaggtaaccctcatactttgcctcaaactaatagctcttcatacccttccaccgtcataaaaattacgcaatcacttaaccttcctaagtctaaactcatatcgtaacatgaaatctactccactccccaactaaaaaacatgaaaagattcttcacacacctataactcggggctatacatcaagtcaagatgaaaatcaaacaccaattcacatctcactcatcacatagtcatccagccatcacttccactaatagggacaacactagacatataaatttaaaagcacgtgctcacataatcagtacctaagtactcaagctacaggcaaaacctgaccttaagtcctccagactgacccaatatcaacacacagaaatgacatctcacccctcgatcaggaaatcacaagccatcaatgcacagctgataccgagcgctcatgcgtgcatacagacgcatggaaggaattcaaagagttatatttcaagttgaatcaaggacgcatgatatgaatttaagaatgtgaattttttcctaaaggttctgcagcctcccgaggataagtacagacgtctccgtaccgatccgcgagactctactaaacctgctcatgactcattgttgatacccaattttttccctatgtatttttatacaaaatactttcaaaatagcatgtacatgcacatataagcatgccccaagagttttggtatttttttccaaatttttaagatttttgaaataaatttattatctattttagtagtgcaaaatccataattattcccaaaataataagttttggtgaataatttatttattcccatatttacaccaaaatatagttaatataatttttgtatattttcacaaatttatttggtattttagaagctaaattgcatataattgcaattatagcctactttaagattaatagcattttataattgtaaaattggtttcaatatttttaaattgatatttatatattattaatttcgtcagtacttttaattttcttttcaaatcgttttaactattttatataaaataaaaaggaaaaactggctatttaacatttagcctcatttcattgcaattatagcccattcggattttaattttagcctcgatttaaccccaaaccagttaacccaagacctaaccaaatcctccccagcctaatccttaaattaacccggcctagttccgaactaatctgagtcattgatcagataaaatcaacggcccagatccccctttccataattaaaccctcacctacccccttccccctgtctcattcttttgagactcctcgtctctctatctctcaaactctctcgaaggttcctgaaactctagcctctctcatcccattttcagcatccgactcaccggaatccatggcctctcaggccatggacgacctatactcacctcctccggctcttgtatgcttgatgctcgaaggatcgaggccagacctcgaaggtcttcactcataccttcaccgattcgaagattccgaccatcgtcgaccttgctccggtggctcttgttcttctgagcctgtttctgacctcatccgacttagatcggactttcttccaagcctttctcatttctagggtttctctgaaaccctaaggtattcgaggttctttccctctttgttttcttatatctatgctacatctatgttctactagatttttttctgactctttttttttgtgaatctgtctatgttatgtttgtatgttctcttttctacctagcatgttcttctcccgtatctttatgtttgccttattttgcatgttcttctattgtgctccgttctttcttctactggtttctatatcatgctttcacacgtttatcttatgtgttcatctacccctatgttcctttactgtattttctactaagctcttaatttttattttccttcttctggactttgttctttctaaacatgtttcatctactgtttccttaagtttacactacctctttgtcttctgaacttgtttaagttccaagcttttcttaaaacatgttctttatgcttcaaatcagctttttcactatgtttgtttcgaacctgctattttacctgtttgttttctcatgagtctctgaaaaagacctctgagcctgttttagttatttgtcttctcgtctctacatctgattcgagtcgaaaaccctaggatttagggtttttggcaaatttaatcacgtgctcggactagggttctattatggaaccctggattctctcaaactaagtttgagtctatgtactgaatttgagcctctttgtttataactctgaacttttctatactagattctttctaattatcatgacagttctttcttgtttgacatgtttgtgtgctttatatatgaggaattctttcttcaaaaggggtttttccaactactaattgattgattctgaaatcctctaatgggtttgattgattgttactaattatctttgattaaacctttcttcaccttttctggttgggttcattcataccaaaactcaaattctgattctactgattgttgattgattgcctttccttatttgcacaaaccgtgttgctatcaaactctttccttaaatagttcctatgtattttcccttcttgtactactttggaaaagattatgatcaaattctttccttaattaccttctacccgtttgaaatcaaatcccttagctgaagggaaattctatgtgattgattgtaaactattttcttacatttcttacttgcttctttgcactataaaatggacaattcaatactttttacaagacacttcgaattgcatactattacacactactactactttcaaaacctgcattccctcttactctcttctctactgttgttctctgcccctgcttattattaactgggtgaaagtcaaggctaatatactactactactttgtctttgcatcctgctcttgctcttttacgggtatgtcttgattcagtccctagaaatcatcctaaggtgtttacttagaacctttatatctatgcctattacctgcaaagtttgacatgttcatatgctgctgtttgttttactttcttgtgaatgcttgatccctatacatttaccctctatgtgtttgtaaatggggattcagggcatggaaacatgagttattgtccatgaacggaattttaaccccaagtaaagggtgtcagtatgttttattgctgatcatgtcctttgcccacttttcctttgtcaactgtttctattatgaatcccctacccttatcccctatgtatgttgagttaaggctcatgatctggtagcctcttaaatggctgcccagtcctgagcctgggtttcaataagccctaactactctacttgaaatgacaagttggtcaggggtgtaccagtacttcaagttgcttggcatgaccaccagcttatcacttcccctcccctgcacttgcacctactcttagattttgagttatgcccccctcctatgagccttgctttgggaccttgagttccctctgaacttggtcatttgagggctggcccttccacactgcactatgtccttgattctgaaatatatttggggtgtaagcattgcccggagcccctttgagactcttgtgaactttgacacatcccaaataagagaaaggctttggaacttgatctttggagttggtttacttcatgcttcagacagaagtacgaatcatgctctccttggttgggacttttagttttctgatgtaatttttattttatttttcttttatcaattctggtttgtaataatcttgtaataaacatttggggtcggctagtgaaaaagggtggggaactatgcatgcaaggggtagatatcatgcctataggggttattatttataaaattctacatctcatctagagatcatgcctataggaattgatatgttttaaagttctgtattttataaatcattgaaactctgtattctcacatagataccatgtccataagatttttggcattctcatatagacaccatacctataagactttatgtattctgcatatgcatctatcattaggcaaacgtgtatataggtttaaataacaatcagtattttagacaccaggcctataggacttctgcacttctataaacgtttaaaatcagtaactcctagatatcatgtctataggattcttgcaactgtttaagatcaatgacacttagaaaccatgcttataggatcagttaattgaatcagcctcgtttcgaatctaaaactcgtcttaaaatctgcagatccctttttctaaaattagtaaagcttttccttaaaatcagtatactttgcattattagatatcatgcctataggtttcacctaggcaagctttagggtaaaagccataagtgcatcaatctttgacaattctaaccagcagctaggtctgattcagatttcttatctgaagtatgtaataaatcagtctacctcacagatttttttaagtttaattcagacctaatcagtacatgtaatacatgctaaactctatgcttttctgacttgaggaagtttatttgagcctttaaactgttttgtgttttcccatatctgttttatgtgttttgtttgtcgccctagaattttatccttttaaaaccataaaatccccaactccctccccttcaggattagtagtctcaatgcctccgagcttgataggattgggacgggtaatagcatgcaataagtaacgataccattccgcgctttaataccttaatggggtgggaagggtagaatatgaatatgatgaccggtgtgctaatatcacgtgcaacccctcttctgagaagtgattgctggatattgcattgaagtgatccatattaatcacaaacctaggacccccttttctttattcacttcctttaaagttgtttaaacttttcaaatccttgctctttttctacttacttttataagtttcaacctaattgcaatgttgtatgcaagtccttatttgagccttgattgtttacttgtaaagtcacaattgtagcatggtcgggaaccacacttgtggatcttgaggggtgcttcccctcgggataatttctagccattaccctaatctctagtctcttcatctcaaactcttctaaaaagtgtcctaatgcactataatcattatgtggcgattcttcaacttctaaacccaattctcgaaagggaatagagttgtcctcccaatgtcgtatacccgatttctgaccccacggttagagaaaaagggggcgtcgacagcatggcaactctgctgggaattctttaggcttttaccattgcatgttgcttgtgactttactatctcattaattgctttatttactatcttttattcgctacgaaactgacttggctcttcatgtcttttctttcctttagctaccttcctttactgctttatttcaatactgttgtaattattgcaattattgtaatcatttatcttatgaacgtgaaaatacatgttaatttgtttcattcttgtaaactgcatcttcaatatcatattccactcgtgccaaacaaataccatagcaacgcttataatgagtggttgcgctcttccaatattatcaccctttaaatttggcaaaggcgtatttgcggtaaaaccagtcgatcagcggtgcagtcaagggttctgtgcctttccatcttgagttgtcctctcaagggtacctgtctaataccccaatagaaaccttactctaactgtgcatgcatcatggtcaaacctagccgagtcagttatgttgtccacatatagccttgtccaaaggccattgggtttccctgaaacccaaacggacacctacatgttctgtgcatatatttggagaactaaatgttttttatgctaattattggtttaaatagtcgagtcgggaggggtaagggtctaacactctgttttgtagaaaataaggcacgaagtccccaaatttggcatggtaaccaacattcatccaagggtgttgaattggtgggaagatctccactccagtgattagacactcatccgcaaatacttagggaatctgccttctcttctagaaatccaacctaacaacaaaatcatagaggctgcaactctgttctgggacagtggcaggtccgtgtttcgcttcggggaccttgaaataactcctttgctcaaagaaataggaggcataactggcattccttgggagactccgggtttgcttatgccagaaaatcgcaagggtaggggtttccttaagatgatgggactgaagaagaacccagagttgacctatttgaaagactcctacatcccatttgactatctgtacgagaggtacaaccatagcaagtcataccgcacctactcagatgaatttgccctcacctcacttgggcatattcacaaaagggtcttcgtattcatgttttgtttcctgggaatgatagtgttccctatgaagaaggctaggatccacaccaaactggccatggtaactaagactctgatggaaggaattggcggacaacctttcagtatagtgcccatgattgttgctgagatataccgggctctggacaattgtcagcgaaaagcaagtcattttgagggatacaatttattacttcagctctggctcatggagcacctccagaaaggagaataccgacaagagatcttacgcagagactgggatgatcacattgccttccaccagccaaggcgtatgaattatatgcctaaaatgttcgctcagctagaagatgctggaagatgggtgaagctatttgagaatctaaaagaagaccaggtactgtggatggtcgaatggttccctatggaagaattcattgttcgatcccgagacgcaccatttctcatactcattggtctaagaggaacttatccctacattcccctccgagccatgaggcaggctggaaagaagcaaatcataccaagggtcgacaaaatgagtcactttagggctaatttctaggacgatgatatccctcacaaatgccaagctcaacacatgtggcattgcaagctcgttttggggaaagaatctattgagccagacaggtatcacgctggttgcatgccgcattattcgggttggttggaagataatcacaatggtatgtgtcagcccgggttcattcacgaacacagaatcatcgacgagaaagttgaagcacgggttaagtacaatcaactgcgcaagagaattcgagagtgttaaagtgagcatcgagaaatacaagaagcccatcaaaagttgatcgaggaatggaaggatatagatgtcagcactaacaagcgactagggcatttggagcggggtctagtggagctagaaggaaagttcctcaagaggattgaacattgtcgaaacgctgaagggaatgcaggcggacatttggcccaagcttatatgctgttaggactgcgtgagttggtgaagctgttcgtgggggataaagctaccaaatctggggaaggtccttccgggaccaagtagttaggagtcttttattttgcttttaatgatgtaataaggtcgatggccactagtgacattttattttctgttatttagagtcattttggatttgtcttatttttattaataaaataaaacatttagcattataagttctccaagttaatttgtcgctaggcctacctcgggcacaatgaggcacccaaattaggacgcgatttatattcttgcacaatgtgtttaaatattgcaacattttttcttcataatctgcactaacttgttaccttttttgtttttcttttcttttattattcccctccacaaaggttagttcgtgcattctggcaccatcatcatacagtacgaggtccaagggccctccttctccccctcctccgattcctatccggaacaaggacaaaggtagaatgggatattcaagcgccagaaaggaaattgaaagaattgagattcctcagggtaccccggttgctaaggaaactgctgcccaacttgagcaaaaaatgttgaagttccaagaagaactggatcaagttcggaacttggcaaatttatcattcactctcaccgctcctgatgtcaacttttcaaatactcaaaatcccgcacctccacagaacaccccacaaccacagatgcaacccactcatattcaacattgcaacatatgtcacactccactacccattcctgaaccactgaacaccacaaacgaccacccccacaacactcccatctacatagataccataccccactacactcaaccaatctcaagtgcacctgagtctgatgacaaggactctcttattagaaacttggtggcagaactcaagaaattgaccagccgagtctagggcatggaaggaaacaaaggcatagaggggctgaattatgaggacctctgcattaagccagatgttgaacttccagagggatacaaacctcccaagttcgaaatgtttgatggcatgggagatcccagagtccatttgaggacatattgtgataagctggttggagtcggaaggaatgagaaaattcgtatgaaactcttcatgagaagcctgaagggggatgcttcatcctggtacatcagtcaggaccccaagaaatggacaagctgggtaggtatggcatcgaatttcatggataggttccgattcaatacagagaatgcaccggatgtattctacatccagaatccgaagaagaagcctaccgatacattccgcgagtatgctactcgttggagatcagaggctgttaaggtcaggccgtccctagaagaggaacaaatgaatagattcttcgtccgagctcaagacccacaatattatgagaggtttatgctaatcgagggccagaaattctccgatatcgtcaagatgggcgaaagaattgaggaaggcattaagaatggtatggttactaatcttgaagcattgcagtccactaacaaggctttacagtctggtggcacgtcaaagaagaaggatgtcaatgccgtgatagtcgcacagggagccaaatcaccactaaaataccacacttacttgtcacctccacttacatatcaacctatcctgaattaccaagcacacacaccctcttaccaaaatcctccacccgtttaccaatcatctccacctctcacatatcaacccacttcacccagatactctcaacatgtacctgtttaccaagcttataatgcccaaccctctcactaccaatcacctcccactcgcctaaatttccctaaacccagaccaaattttgaccgcagaactcccaggcaatatacagccatcgctgagccaattgaccagttgtataagaaacttaaagctgctggttacgtctctcctatcccagccataactctagaaaatccttcccagtaggtcaaccctaataagacctgtgcgtatcactccggcatgaaaggtcacactattgacgaatgccgctctgatcgacaataaggttatcgtagcaaaggagactgctccgaatgtccgcaacaaccctctgcctgatcatagaggcggggacattcacatgattgagatcgaagatgactgggaccccgagggatcgataggactgattgctgaggataatgagccaaagaaaccatcagtcacacttaacccgattattatgcagaaccagtcctctaggggaaatgaagtaaacatgtctatgcctctcgaatttgaagaaccttcttctgcgaagctggccgggacaattgaggttgagtttggggctccaaaggcacctgtactctttgaagttgatatgttaccatcgagggtacccatccctgtagcaatgtcagacataacaccattccacttaaatgacataccatgggattacacagctgaagcaaagaggaaaggaaagaccaagatgaattattgtgcagggtatgaccagaacaggcagggtttacactctatagcacctagctgagtccagtaagcaagcctcgggacggactactgaaactggtcttgatgatatttggaggaaaatacaagctaaggattattcggtcgttgagcagttgaacaaaacaccaacatagatctccatcctagctcttctacagagctatgacgcatacaaaaaggccttgatgaagatattgagcgaagcttatgtgtccagcaacataactgggggcgaaatggcaaatatggtaggacaaatactggaaagccacaaaatcaccttctatgaagatgagctgccgccggaaggactgagtaacaacatggccctacatatcaccgttcaatgcgaggattactttgtctctagagtcttgatcgatggaggctccagcctcaacatttgtccgttgataactctcaggacattgggaaatagcatacacgagatcaaagatggggccatcaacgtcaaagcctttgatgggtcccaaaggtatactatcggggaaatcagcctatgcttgaaaatggggccaacctggttcgacattgactttcaagtgatagatgtcccagcatcctacaattttctgctaggacgaccatggatccatgccgctggagctgtagcatcgaccctgcatcaggcagtgaagttcgaatggaatcaccaagaggtgatcattcatggcgatggtagcaaccccatatatagtcgccagaccatcccgatgattggaggaagaaggaaaatagggggaaaaacataccaccacattgaaagagtcaacgctgtagacaaagataaatggtgggataacaagattgaaagtatcctgaattggtatggatacgaacctggaaagggactcggcaaaaccctccagggaatcaccaaacctatcaagctgaagaaacatggcactacattttgtttggggtatgagtacacttgggaggagttaaatcactggtcaccaccatggcacggtccctactacccactggagcatccgataccttacctaaagcagactttccagccggcagatattatatatgggtcgaaggaagaagaagcataggcagccgtgaagaatctgttcctggaggatgatgatatggactgctgtgttattttcgaggaggaaggggaggaaggcacttctatataagttgtgaaccgaggagagcacctcatcaattggtcaattagaaccaccagggaccgaaaagcttcggggtagcaaggctaaacaaaagcaccatgcatcacattttactttttactagatgattttatttccgcattgtctttaattctgaaaagagctttgatactcaaaacaattacaaatttaatcgaagcatttcagtttattatatatctcgctcttattatttttctatcattcactttattttacacaacattactattacttgccttgacgatgaaccaataattgtgacttgcaacgagacaatgcaacaaacggatacggactcagaagaggataatataccagaagaggtcgtcagaggagttgagaattttgaaaataggacaaagtctaacttggccgaaactaaggtcgttaatctggaagatacagggaatgtcaaagaaacgcgcatcagtgttcacctgtcaccatcagaaaagaaagagtacacggagttcctgaaggaatatgaagacatattcgcctagtcatatgatgatatgactggtctcaacacatccattgtagctcacaaactgccaagaaatccaacatgcccactggcaagctcgccaagtggcagatccttctaagtgaattcaacattgtttacgtgacccagaaagcaatcaaagggcaagccttggcggaccatctcgccgataatcccgtgaatggagaatacgagcccctaaaaacgtattttccccatgaagaggtatctttcataggagaagatattgcagaatcctatgatggttggaggttgtttttcgacggagctgcaaatttcaaaggagttggcataggagcagtcttagtatcagaaactggccagcactacccggtatccgccaagctcaggttcccttgcaaaaataatgtggccgaatatgaagcctgcatcttagggctcaaaatggccattgacatgaacgttcaagaattgctagtgatcggggatttagacttgctcatacattaggttcgaggagactgggcaaccaagaactctaagatacttccctacttgcatcatatacaggagttgaggaaaaggttcataaagacagaatttcagcacgtccccagagtccagaacaagtttgctgatgcattagctactttatcgtccatgatccagcatccagatacaaatttcattgaccctatcccagtaaagattcatgatcagccagcttattgtgcccacgttgaggaagaagcggatggaaagccatggttccatgacatcgaggagtacttgacaacaggggaatatccaggacttgccaacgctacttagaagcgcacacttcgtaggctatccagcaacgttttttcacagtagaggaatcctatacagaaggactcccgatttgggtttactaaggtatgttgaagcaaaaaaagcatccaggctattggacgaagtgcatgcagggacctgcgggctgcacatgaacggttttgtcttagcaaagaagatactccgagcagggtatttttggatgactatggaaacagactatatctagtatgttcgcaaatgccatcactgtcagatacacacagatatgataaaggcacctccaaacgagcttactacaacaagctcaccatggccactcgtcgctttaggaatggatgttatcggacctatcgagcctgccacatcaaatgggcacaggttcatcttagtggcaatcgattattttaccaaatgggttaaagcagcatcatacaaggcggtcactaagaaggttgtggcgggtttcgtccgcgaccgcattgtttgttggttcggagtttcggagtaaatcatcaccgataatggttccaatctcaacaacgacttgatgaaagcaatgtgtgaaactttcaagatcaaacacaagaactctacaacctacaggcctcagatgaacggagctgtggaagcagccaacaagaatatcaagaagatactaaggaagatggtcgaaagacacaaacaatggcatgagaagctatcattcgcctttttgggataccgcactacagtctgcacatcgaccggagcaactccttacatgctggtttgtggtacagaggcggtcatccccatcgaggtagaaattccctccttaaggatcatacaagaagtagaattggatgatgtagaatgggtaaaaggtcgctacgagcagttagcccttattgatgggaaaaggatgaatgcggtttgccacagttagttgtatcagaacagaatatccagagccttcaacaaaagggttaagctaaggaagtttacaccggggcagctggtgttgaagaaaatattcccacatcaagacgaatccaaggggaagttctctcccaattggcagggtccatacattgttcaccgggatctaactagaggagcccttattcttacagagatggatggagaagtctggccgaagccaatcaattcagatgcagtgaaacgatattatgtgtaaccacttatgattcccttaatgatgtaatttgaactacgcctcacccgattcccgtttaagaggggatacgtaggaagccctatgggttcggtcataatttaataaaaaatctattttccccgctattggaactggggcagaattttgaggaggaccctcaaaatttcgaggttaattttagttcatgcatcgccagaagcgccagcccagtaaactggggtagaattttgaggaggaccctcaaaattccaaagatgttttttagtcattcagcacagtcgtcagaaatgtccgctcagcaaactggggcagaattttgaggaggactctcaaaattccggagaaaaagaggctgcaatgtcttcaaccacgtcgcagtcattgattcatctaaagaaaactatttttgattatatatttactagagcatgcataactattatccgaattgctattgtttagcgatgctaccccaataacaaacaatgtcaagagcccagggaagacgaactaacctttccccttacagaactaacctttccccttacagaactcaattcgcaatatcattaggtatatttatgcactctcaagaatacaacttctcagaatcatcacttgtccacaatttctatccgtatacaatctccccagcagtcatattgtcgtaatcatcctcttgcactgcataaggctacctttctaccttccgaggttaagctctacctccatctgcatcgcataaggctacctttctgcctttcaagactaagctctgtctacatttgcattttgcataaggctacctttctgccttccgagactaagcaccgtcttgatatgcatttttgcattgcataagtctacttttctgccttccgaggttaagctctacctccatcatcatctgcataaggctacttatttgcctttcgagactaagcaccgtctccatatgcatttttgcattgcataaggctaattttctgccttccgaggttaagctctacctccatcatcatctgcataaggctacttatctgctttttgagactaagcaccgtctccatctgcatttttgcattgcataaggctacttttctgccttccaaggttaagctctacctccatcatcatctgcataaggttacttatctgcctttcgagaccaagctctatctccatctgcatttcctgcattgcataaggctaccattctgccttccgagactaagcattgtctccatcctgcatttttctgcattttgcataaggctacctttctaccttccgaggttaagctctacctccatctgcatcactaagctctgtctccatatgcattttgcataaggctacctttcttccttccgaggttaagctctacctccatctgcatttctctgcattgcataaggctacctttatgccttccgaggttaagctctacctccatctgcatcgcattaagctacctttctgcctttcgagactaagctctgtctccatttgcattttgcataaggctacctttctgccttccgagactaagaattgtctccatcttgcattttctgcattttgcatagggctacctttctgccttccaagactaagctctgtctccatcctgcatcggctgaaagattgccaccttatctttctcgcatggctaaaatatcgccatcttttatttacgtctggcatcggctgaaatatcgctgaatcctacatttcatggtctgaaagatcgccaccttctgcatttcatgggctgaaagatcgccaaattgtccaaaggtgtcattgttcggaggcaccatttgtatagcccgagaacgtcatgccatggcctgaggaccccattttatcttttgcatatcattattcaaaggcatcatagttcagaggcatcattctcatagcccgagaacgtcatttcatagcctgcgaatcctttatcatacgcttcatggcccaggacatcatggtccgaggacagcatcctacccgtctgaagatagcattcattgtccaacgggaacttgcatcacgtttaagtttatgcacgatatatgtttgtattgctcacttgcaggtacactgactatcaacggccatctcagcaggagcgatcccgctctggttctcgcagtctattagatttcaaccacctttcgcaacataaacatcgcgtctgttcctttcgaaaatctcaatcggcatattccatcaatggatcctgaactacatatggcctgattcctctgagaccagggatatgtaggcagcgcaggaaccagagctcggtcaaaactcctttcaaatcgccacttccggtcaaaattggtcatcttatctttacccgacaactctttcatccttaccgggtaaagagggccaactgttgatacccaatttttccctatgtatttttatacaaaatagcatgtacacatataagcatgccccaagagttttggtattttttcctaatttttaagattttcaaaatcaatttattgtctattttagcagtgcaaaatccataattatttccaaaatcatcagttttggtgaataatttattttattcccatatttataccaaaatatagttaatataattttttcatattttcacaaatttatttggtatttagaagctaaattgcatataattgcaattatagcctactttaagattaatagcattttataattgtaaaattggttccaatatttttaaattgatatttatatattattaattgggtcagtacttttaattttcttttaaaatcgttttaactattttatataaaataaaaagggaaaactggccatttaacatttagcctcatttcattgcaattatagcccattcggattttaattttagcctcaatttaaccccaacccaattaacccaagacccaaccaaatcggcccaacccaatccttaaattaactcgggccagttccgaactaatctgagccattgatcaaataaaatcaacggcccaaatccccctttccataattaaacactcacctacccccttccccccgtctcattcttttgagactcctcatctctatatctctcaaactctctcgaaggttcctgaaactctagcctctctcatcccatcttcaacatccgactgaccggaatccatggcctctcaggccatggacgacctatactcatctcctccggctcttgcatgcctgatgctcgaaggatcgaggccagacctcgaaggtcttcactcagaccttcagcgattcgaagatttcgtccatctccgaccttgctccggtggctcttgttcttctgagcctatttctgacctcatccgacttagatcggactttcttccaagcctttctcatttctagggtttctccgaaaccctaagctattcgaggttctttccctctttgttttcatatatctatgctacatttatgttctactggagttttgaaacgtttccccaatcttttctttcaaaatttgtttctcctcgattttgagtttctgaaaaaatcttaaaatgttttctgactcttctttttttttatgtgaatctgtctatgttatgtttgtatgttctcttttctaccttgcatgttcttctcccatatctttatgtttgccttattttgcatgttcttctattgtgctccgtgctttcttctattggtttctatatcatgctttcacacgtttatcttatgtgttcatttacccctgtgtacctttactgtattttctactaaactcttagttcttatttgccttcttctggactttgttctttctaaacatgtttcatctactgtttccttaagtttacactacctctttgtcttttgaacttgtttaagttccaagcttttcttaaaacatgttctttatgcttcaaatcagctttttcactatgtttgtttcgaacctgctattttacctatttgttttctcatgagtctctgaaaaagacttctgagcatgtttcagttatttgtcttctcgtctctacatcttattcgagtcgaaaaccctaggatttagggtttttggcgaatttaatatcgtgctcggactagggttctatgatggaaccctggattctctcaaactaagtttgagtctatgtactgaatttgagcctctttgtttataactatgaacttttctatactagattctttctaattagcatgacagttttttcttgtttgacatgtttgtgtgctttatatatgaggaattctttcttcaaacggggttttgtcaactactaattgattgattctgaaatcctctaatgggtttgattgattgttgctgattttctttgattaaacctttcttcaccttttctagttgggttcattcataccaaaactcaaattctgattctactgactgttgattgattgcctttccttatttgcacaaatcgtgttgctatcaaactctttccttaaatagttcctatgtattttcccttcttgtactactttggaaaagattctcatcaaattctttccttaattaccttctacccgtttgaaatcaaatcccttagctgaagggaaattctatgtgattgattgtaaactattctcttacttttcttacttgcttctctacactataaaagggacaattcaatactttttacaagacacttcgaattgcatactcttacacactactactactttcaaaacatgtattccctcttgctctcttctctactgttgttctctgcccctgcttattattagctgggtgaaagtcaaggctaatatactactactttgtctttgcatcctgctcttgctctttactggtatgtcttgattcagtccctaacaatcatcctaatgtgtttacttagaacctttatatctatgcctattacctgcaaagtttgacatgttcatatgctgctgtttgctttactttcttgcgaatgcttgatccctatatatttaccctctatgtgtttgtaaatggggattcagggcatggcaacatgagttgttatccatgaacggaattttaaccctaagtaaagggtgtcggtatgttttattgttgatcatgtcctttgcccacttttcctttgtctactttttttgttattaatctcctacccttaccccctatgtatgctgagttaaggctcatgatccggtagcgtcttaaatggctacccaggactgagcatgggtttcaataagccctaactcctcaacttgaaatgacaagttggtcaggggtgtgccagtacttcaagttgcttggtatgaccaccagcttatcactccccctcccctgcaatttcacctactcttagattttgagttctgcccccatcctatgagccttgctttgggaccttgagttctctctgaacttggacatttgagggttggcccttccacactacattatgtccttgattctgaaatatatttggggtgtaagcattgcccggagcccctttgagactcttaggaactttgacacatcccaaataagagaaaggctttggaacttgatctttggagttggtttacttcacgcttcagacagaagtacgaatcaggctctccttggttgggacttttagttttctgatgtaatttttattttatttttcttttatcaattctggtttgtaataatcttgtaataaacatttggggtcggttagtgaaaaagggtgggaaactatgcatgcaaggggtagatatcatgcctataggggttattatttataaaattctacatctcatctagaggtttatttgagcctttcaactgttttgtgttttcccatatctgctttatgtgttttgtttgtcgacctagaattttatccttttaaaaccataaaatccccaactccctccccttcaggattagtagtctcaatgcctccgagattgataggattgggacgggtaatagcatgcaataagtaacgatacaattccgcactttaataccttaacggtgtgggaagggtagaatatggatatgatgaccggtgcgctaatatcacgtgcgacccctcttctgaggagtgattgctagatattgcattgaagtgatccatattaatcacaaacctaggacccccttttcagtattcgcttcctttagagttatttaagcttttcaaatccttgctctttttctacttactttcataagtttcaacctaattgcaatgttgtatgcaagtccttatttgagccttgattgtttacttgtaaagtcacaattgtatcatggccgggaaccacacttgttgatcttgaggggtgcctaacaccttcccctcgggataatttctagcccttaccctaatctctggtctcttcatctcaaactcttctaaaagttgtcctaatgcactataatcaataggtggcaactcttcaacttctaaacccaattctcgaaagggaatagagttgtcctcccaatatcgtatacccgatttctgaccccatggttagagaaaaagggggcgtcgacactcatgagacctatgtaacctaggctctgataccaacttttcacgacccaaaaatcgacctagtcgtgatagcgcctatcatgaaactaggttaggtgacaatactcccgaggtttaaccatttaatcaatattagtcatttttaagcctttaattaatcaaatatctcataagataactctaaatgaacagtgtgaaataaatacacaagtctgacattgggatgtcacaagtcacgagcatctactaaggtctgaatacaatgaagagtctaaaaatatcctaaatacaatataaggaagataagagggagaaaagcagtgctgcgaacgtcgggcaactatcttgctaactccgatgactctgccactgagcaatcaacacccgctacaaggtttagaagttcttgaatctgcacacaaggtgcagggagtattgtgagtatgtcaactcagtaagtaataaaagtaaatgaaagctgagtagtaagaaaatacgtaaaagacaacataacgcgacagcaaatgcagtacatttccaaaacaatacagaaatcattttctttgtaaatcaagctcagtttcagtaaaacctttttaaacaacttccaacagtttcaaacgagtgataaaaatagtgatttaaaacgatagaaacataaacagcccctcgagcaaaatatgtaccataaactacccttcgggcttaatatcaatagaaccagccactcaggctacctcacaatcactcgtaatcagctcctctggcataacatgaatcaaaaaccgtccctcgggcaaaacatggatcaagaatagcccttagggtaacaatatgaaacaacaacagcccctcgggttaaattatatcactcacactgggtacccgctctcactgggggtgtacaaactccgggaggggccccctacggcccaagcgcaataacaagccatatcgtggcatagtcaaactggctctcggccttatatcaagcttgtggcgtaacaaatcaggccctcggcctcataatcatgaatcaataaaacactgatgtggcgcgcagcccgatcccacagtatcctcacaacacaggccatcagcctcactcagtgagaaatctctcaagctactccagcaacaataaaacatgatgctcagcccaaaatatcacttaaaatatcaaaaacggagaaaatatggatgcgttatgaaaatagttgaatacaacatgactgagtacaaatattaagtcaaaacaatgagaaatagtagtaaaaattccctaagggtccaaaacagttggcacgaggcccaaatatggtattcagcccaaaatatggtaatactttccaaaacacaatgatatcaaatagttttcaatcaaatacgcgacttcgcagtcgtacggggcagaccaagtcataatccccaacggtgcacgaccctacgctcgtcatctagcgtgtgcgtcacctcaaagtaacacgatgatgtgaaatccgaggtttcatacccataggacaaacatttacaatcattactttcctctatccagtccaaacattagcccataatgcctttgcccctcgaattggcctccaaatgctccaaatctaacaaaaatcagtatattatcataaacatacactaaaggaacaaagcccaagcaaaaattatcaaattacaaatcctgaaattggccaaaccagacccgcgagcccatgtcttggaatgcgataaaatcacaaaatccgaaaatctattcaaccacaagccaaaccataccaaaattactatattccgataacaattcggcctccaaatcttcaaatcttattttcaaattcctaggtccaaatccccaatttacacctcaaaaacatgtaatctagtcggattattcgatgataattcaatattattgagtagaaatgatcacaagtgacttacctcaggatttcccatgacttttcgttcaaaaatcgccccaagtcgcgttcttttcatccaaaaatgtgggaatgagctaaaaaaacaagacagctcagtaaaacatcattctggtcgctaaaatccccattcctgtcactaaaagtgcgcaccagatcctgttgcaccagcaatatttattttcactaaaaaggttctaactccaccatacaaaatcggaatttgatgattcttgttcctatgagtaaaaaataataatacgaacatagcccttcaatcaaaacacaattcggacatcattttcttagtatgatacccattttgctcgttaaacaattaactcatgttttgcgtcaaaaacccaatcgcgacttgatgaaattagaccaaactttccggatcactcctataattcattatcaaaattccagaagtctcaaaataaaatttcaatctctataactaaaaatggacctttggatcattacatgcttatgctcaaaacggaaaaatcttccaaaaactcttccaaaacctatccgagcctcatgggaccccgaccaaacatgccaacacaacccataacatcattcaaacatgttccaaccttcggaatgctcaaaacataatcaaaacatcgaatcaccctcggattcaagcctaagaatttcaaaacttccgaattccgaattcgatcaaaaagtctatcaaatctcgtccgaatgacctaaattttgcacacatgtaacaaatgatacaatggacctactccaatttccggaattccattccgacccgatatcaaaatttccactgccgaccgaaaaacgccaaatttacaatttcgccaattcgaaccaaaatctaccacggacctccaaaatacattccggacgcgctccaaagtccaaaatcacctaacggagctaaccaaattatagaaatccaaatttgacttcgaatactaaaaagtcaaaacttggtcaaaactttcaaatttaaagcttcaggctgcgaattgttcttccaaatctattccgattatcctgaaaactaaaatcgacgatttacataggtcataatacatcatacagggctattcatgtccgagaactggcaaacgaagtgtaaatgctcaaaacgaccggtcgagtcatcacaatatcatgtcgaggtcgtatggcccgatccaacataaatgtaaaatgtgcactgccgagagtcgaacggcacgaactatagatgcatctattaccccgctcgtgaatcatacatgtgacgcgggcacacatagatacacccattcaaacagctaattaagaaattatcggggaacatttatccaaataaaagtcaattctcttttactgatttaagaaaatgaagttttaatccttttagaaattcatttaccaattcaataggataagcaattcaactatcaataaaattacaaatattctaagtagagcatgcttttgggtcctagactacccggacttacacataatagtagctacgctcggactctcgtcacctcgtgcgtacatagcccccacaaatagaagcacataaccaattatttcaccaatgaggacaattccctcttacaagtttagaaaagagactcacctcgctatgaagatccataaccggcattcatcgcccttacgaagactcgaatcaatgcacaattctccaaaactagccaataattattcaaatccattaatgtatgttcaattactcattacaatccaatttataacaattcctaacccgatcaaaaagttgacaaaattgccctcgggcccgaattccgaaatttttcgagataaagtttatccatgaactcacgaactcaaatatatgatcttttcttaatttcataccaaaaattgtggtcaaaatccaagaatatcaattttctaggttttccctcaaaccccaagtttctaccaattttcatgctcaaatccgcacacaatcaataatttaactcaagataggtggggatagcttaccatgtcgttgatgatgaataccccctctagaaactttcccaaattgtccacaccaaatgaaaatggggaaaaaatgaccaacccccgacattaaaagaatacactgcctccaacctttccgcacctgcggtgcataagccgtacctgcgaccatcgcttctacggtgcatgtgccacttctatggtcccagggccagggccaaaatccgcttctgcggtctcctcaatacaggtacgttcccgcatatgcggttaaagcatcgcacctgtggtcattgcaccgcttcgcccaaacagcatatgcgacccccttggccacttctacggctccgcacatgcggccaagacctcgcaggtgcggttacaccatatatcagctgcctcaattcttcctcaaattccaatattgatctgttaaccatccagaatccacccaaggcccccggggaccccaaccaatcatgctaactagtcccaaaacacattacgcacttgctcgaggtctcaaatcatatcaaatagctcctaaaccattaatcgccctccaatcgaagcttaatgaactttagaatttcaatcttcaacattcgatgcagaaacccatcaaattacgtccgattaacatcaaattttgcacacaagtcacatttgacatcacgaacctactccaacttccagaatcggattccgaccccgatatcaaaaagtccacttccagtcaaacttctcaaaaaccttcaaatttctatctttagccaaatgactccaaaatgacccacgaacctccgaattcactttcgatcgcgctcctaacaccagaatcaccatacggagctaatccagactcggaatctcaaacggacatcgataacactaaaatgcacttcaacccaaacttatgtaattcgtccaaaaatgctaacttcaacaataggtgccgaaatgttcccgggtcttccaaaatccaatccggatatatgcccaagtccaaaatcatcacacgaacctactggaaccttagaatccccattttgagatcgtttactcataaatccaatattagtcaattctttaatcttaaagcttccgaaaagagaattctctttccaattcaacaccgaacttcccgaaattcaattctgaccacgcatacaagtcataatacctgaagtgaagctgctcatggcctcaaactgctgaacgccgcgttagagttcgaaacgaccggtcgggtctttacattctctcccacttaaacatatgtttgtcctcgaacgtgctaagaactgcaatggagttgtccgaaatcactttttaacaccttaagcacctacccgtgctaccacaactcaattgggcaccctagcttgatcaatctgaagattccctttttcacttaagaaaataagtcttagagcccaattccaacatccagaattctctgccaggcttgtttctaacatacactcaccatatcaatcactacacgtagcactaaaacatgactgcatacctctactgaattcacaccttgcatcactttactcacaggaccacaataacattctctgatcaaactagtcgaaattccacgaatctgacactcccaatgcatcttaatacctatatacatattgctctgattcttacaataccaccatgacggaagatgcacgtagaaattcataaccaactgtcgaatacaaatcattgggactatacttatgacaagaatcattacctccttctgaaccaaataatggaatttactctttaataatgttcaaataatccgattgcactgatcttggttccaataatctcatctcaccgtacgaactgctcaggcaataagccacccaaacatgaccaaaagtctcatatgatgccgcaatgtgccaataggctaccaactcgaatgtgatacacaaggaagacgaactctggaagggactactcaactcacacaactgccatgaactttcctcaaaaaatgaaaaacaaacacacaaaaacaaaatatagaaactgtactcaacatcacattgttgcggcgtgcaacccaatccaaacaacatacctatggcggtgtgacacccgatcgacacataaaattcaaataaggagatacacacccaactaaattgctcattacaacaaaaataccgaatatcggtcacaagcatgctaagtgcttaataccatccctaggagacatatagcgccataagctaacaaactcaagcacagctgaggtgcgatatatgattagaatctcaagagtcatcctgctcaaataacaccatcactacgtggaacctcaacacataagaaatttatccagccattcacaactcacacgacacagtattgcattacaggaaatagccgacggcgatataacatccaacatctgaatactcttccataaggagaggtaggctgaaatgacacatttggcctgatgtagtgcccacattcatatttaaatccacccacggatctcaggtcgattttgatcgtaccaaactaggccaataacacacaagaaaaaccatcataatcggggcaatcctccacagttcacaacctaataagtcgagtgccctctaggcataaattctcaaattaatgatgtcaccactatcttcatacttggtttaaattcgttaatcaatcaagttactacctaccacccttatacaatattcctgtggggcacgctctcacgaccttccgtaacagacaacaagtctgagcatccataccaccagccgcactaatgctgagaaagcgttcaagaatccataactaggatgcaaagccctttaaacaccgatcttaggtgatgctgaagacaatgccagcttactttaaacattcaaatacctttcctgctcatccgagctcgtgacatccttgtcaataccgaaccacaaccttgatcctcacttccaaatcccataacactcactacacccaacatgccaatatacaatagaacatgattttcatcataactctggaaccactaatatcttaacacttcatcatatagaaacttttaacttaactcacttcaggagaaccatagcaacacacatgtgaatcctcataatcatagaatatgcaaatcgtcaagtagtggtctaagccaccatagcacttccgggatccgcctacacataacaggccataacactggaatactcccaaataaaatcaattatggcggccaacaagcctcacacgtaccgccacaaatcacttgcataactcaatcacgctaaaggaattgatccctgccaccagtataccaattcaaccatggtcaaccaatccaatttcttctaattcatcactaacttggcttatagataataatagctcaattccatacataaccaaccaaaatccgcacccatcttgagcgactccattctacgagaccaaattgtctccaaaccaatgaactgtttcataccctcattgcacacacattcgcatctacaactaatacacccattctgataacttctccacgaatccgaagtcttttgctcatttttctcctaatgctacactgcaagtcgaacatatcatagaacattctgagcctctcgccatcatcttctacataagctcggtttttagtcgtacttataggatcgaaatcattaggcaccacaccataacttttgaatcactaggaccgttgtggagagccacccactctgacttggtgccgaatataatcaactccatgaatcttctagcacatgaacaccttctcgatgaagcacccagctgaatcactttccttgaaactcgtatctatacaaggcataaatattgaatccttccccaagtctaaacatgtgtcaataaggccaaccataacacacctttaacaattcctttactcaaattacctcttattctctctctcttagctgaaataactcatcaatatgctaataaatggaaatctcgtaaataagagaccatgaattcaaaccgtaggcagtggaatctccctcttagcttgaagccacaattaaacaactctggagcccaccaatattctttatctcttattgacatgaccttgcgcaattaaactgccagactccttgaaatccttccattagcacttcatgaacactctgaatttccatcaatatacacatattcgacctcttatcggatggccaataaaatccttcgcagaagcttcgccaatcacacgaccgctaacctgctcacagggaataacccacctgtggaaattacctacctcatcttccaacgtcactgcactggggtacaattactacgacatcaataatccatcttgagctcgcgctcacccaccaactacacaagtccattcactcctcgtggacattaactaaatgtatgacaatatcttccaattcaaaattatgttgtatccttcttcatatcaagcagctcctttccgtcatatcgaatctcccgcggttatgctagttagtatttcaaattaggctcgtaaacccaattatcgtccactaaaattcccccaaatcattccaaactttacttaaggtgcgtaatcatcctaccactagacccatatgctactccgacactctcccactttggcgaaacccgcacctttaatcaactactcaaccttcgctactgatacttggctgccttaaaaattcaaccatcgcatgacacctcccacatgtacttcctcatccttcgctgcccaattattgccttaaataaaatctatcttcgtagcacttgcacccacaaatctctactaactttaaacctttccgaagatcatctttctcgagccgtcaacattggaagcatcgattcaatcctgaaccactgcaccccgcgatctctgactgccgcttctcaaatactatttcacaatatcctaccccaaaagaaaattgcagaaggccataacatcggctaacttaatgcattcaatcgaggaagacaacaccacactgtagatgaaaattccaccacgctcgaaaataccaagtctcttacttcctctacccaactctggacgttcacgggccaattgctttttctccaccggaaataaaataccgaacctctgaatcatacactgagtagacctccattcaggtcattcaccacccaacacatggccaagaaccttaccaacaggtcaatactgtgcaacaaccgatcatgagcaatcatagaaagctgcgcatagactcaaagctctcaggaatactattactgagctaaaatgacaggatatccctctgcaaggcaacgacaatagcccaatcaactatgcagggagaaacatcccgcaccacatcaatagtaacattaaaattcttcaattctcgatttataataagcgcttcacatcacataatattaagtatgaaggaaacaagggcataagcctcaaggaaacaaattgcacgatgaggaattaagaaggaaggtgttcctaccagtcctatagcctctcgaggataagtacaggtgtctttgtaccgatacgcgagactctactagacttgctcatgactcatgagacctgagggaacctggtgctctaataccatgttgtcacgacccaaaatctactaagggtcgtaatggcgccggacactgttattaggcaagccaaccaaaatacttaattaaattcttgttttaataattttaaaaactatgattttccttcaaattgtactagtaaaaggtaaactttacaatataaataaaagaatgtttagaaataaatacaagatacccaagaatcatcccagaacccgtgtcacaagtgcatgagcatttactaggaatgaaataaaatacagtaaatatccgaaatacaaagtggacagaaatgaaaataaagtacaacgctctgaaggggactcagctggtagcgggtcgtctcgacaaatgtagctcacctaagtctctgtatcaaccatgccgctatgccactaagccagtatccacacatgaacctgtgcaacaaaaatgcacggcaagtatagtatgagtacgaaaacaacgtgtacccaaagagtatcacggtctaatctcgaagaagtagagacgagaggtcgacttcgacacttactagtggtccaatgataatatagtgaaatgtgaggagattatggattttttataaaacaatcaattataattcataaagccagatagtaggtaacaacttcccaaataataatggatttccaaataattacttttcatcttctttatcaattaatctcaggccagggaagtaaaatatcaacatttataaatctcaggcaaacagtacaagcatgcgcatatcatgtcgaggtcgtacggcccgatccaacataaatataaaatgtgcactactggtcgaacgacacgaaccatagatacatctattaccccgctcgctaatcatacatgcgacgcggtcaacataaataaacgaacaccacgctcgcaaatcatacatgcgacgcaggcacacatagttacacacattcaaacagctaattaagaatttatcgaggaacatttatccaaataaaagccaattctcttttactgatttaagaaaataaagttttaatccttttagaaattcatttaccaattcgataggatttaagcaattcaactatcaataagattacaaatattccaagtagagcatgcttttgggtccttgactacccggacttacacataatagtagttacgtacgaattctcatcaccttgtgcgtacgtagattccaaaaatagaagaacataaccaattatttcacctatggggacaatttcctcttaaaaggttagaaaggagactcagcttgctccgaagatcgaaaaccgacattcctcacccttcggaagactcgaatcaatgcacaatgctccaaaactagccaataattatgcaaatccattagtgtatgttcaattactcattacaatccaatttataacaattcctaaccccgacaaaaagttgacaaaatcgtcctcaggcccacgtgcccggattccgaaatatttcgaagataaagtttacccatgaactcacgagctcaaatatatgattttctcttaatttcataccaaaaatcgtggtcaaaatccaagaatctcaattttctaggttttccctcaaaccccaagtttctaccgattttcatgctcaaattcgcacataatcaatgtatttaaatcaagataggtggggatagcttaccctattgttgatgatgaaaaccccctcttgaaactctccaaaatcgtccacaccaaatgaaaatgggggaaaaatgaccaacccccaacattaaaagattacactgcctccagcttttccgcacctgcggtgcataagccgcacctgcgaccatcgcttctgtggcgcacgtgccgcttctgcggtcccagtgtcagggccaaaatccgcttctgcggtctcctcaacgcaggtgcgctcccgcatctgcggttaaagtaccgcacttgtagttagtgcaccccttcgcccaaaccgcatatgcaactcccttggccgtttctgcggctcccaactgcggccaagacctcgctggtgcggttacagcagatatcagctgcctcaattcttcctcaaattccaatattgatctgttaaccatccggaatccactcgaggccccccggaccccaaccaatcatgacaactagtcccaaaacacattacggacctgctcgaggtctcaaatcatatcaaacaacacttaaaccatgaatcgctctccaattcaatcttaataaactttagaatttcaatcttcaacattcgatgtcgaaccccatcaaatcacgtttgattgacctcaaattttacacacaagtcacatttgacattacagacctgctccaacttccgaaatcggattccgaccccgatatcaaaaagtccacttccgatcaaacttctcaaaaaccttcaagtttctatctttagccaaatgactcaaaaatgacccacgaacctccgaattcactttcgatcgcgctcccaacaccagaatcaccatacggagccattccaagactcggaatcccaaacggacatcgataacactgaaatgcacttcaacccaaacttatgaaattcttccaaatatgctaacttctacaataggtgctgaaatgatcccgggtcttccaaaacctgatccagacatacgcccaagtccgaaataatcacacgaccctgctggaaccttcaaatctcgatttcgaggtcatttactcaaaaatccaatattagtcaattctttcaacttaaagcttccgaaatgagaattcgctttccaattcaaccccgaaattcaattccgaccaaacatacaagtcataataccagaagtgaagctgctcatggactcaaactgctaaacgacgcgttagagttcaaaacgatcgttcgggtcattacattctctcccacttaaacatacgttcatccccgaacgcacttagaactatactagagttgtccgaaatcactgtttaacacctcaagcacctacctgtgctaccacaactcaactgggcaccctagatcaatcaatctgaagataccctttttcacttaagcaaataagtcttagagcccaattccgacatccgaaattctctaccaagcatgtttccaacatacactcactgtatcaatcactacatgcaacactaaaacatgacttcatacctctactgaattcataccttgcaccattttactcacaggaccacaataacattctatgatcaaattagtctaaattccacgaatttgatgctcccaatgcatctcatgacctatatacatattgctctgattcttacaataccaccatgacggaagatgcgagtagaaattcataaccaactgccgaatcaacaaatcattggggctatacttatgacaagaactattacctccttctgaacgaaataatggaatttactctttaatattcttcattaatccgattgcactggtcttggttccgataatctcatctcacccagtacgaactgctcaggcaataagccacccagacatgaccaaaagtctcatatgatgctgtaatgtgccaatgggctaccaactcgaacgtgatacacaaggaagacaatctttggaagggactactcaactcacgcaactaccataaactttcctcaaaaatgaaaaacaaacacacaaaaacagaatatagaaacttactcaacatcacactgttgcagcgtgcaacctgatccaaacagcatacccatgttgctgtgccacctgatccacacataaaattcatatacggagatacataccgagctaaattgctcattacaacaaaaataccgaatattaccatccctggggagacatatagtgccataagctaacaaactcaagcacaactaaggtgtgatatatgatctgaatctcaagagtcatcctgctaacataataccatcgctacgcggaaccacaaaatacaagaaatttatcgagccgctcacaactcacgcagcacaatatagcattacaggaaatagccgatgatgaaataacatccaacgtctgaatactcttccataaggagagttatgctaaaatggcacatctagcttgatatagagcccacattcatatttaaatccacccacagatctcaggtcgattttgatcgtaccaaactaaaccaataatctttcctgggtccataacaaccccgtcttttcccaaaacacacaagaacaaccatcataattggggcaatcctccaaagtccacaacccaaaaagtcgagtgacctccaggcataaaatctcaaattaatgatgtcaccactatcttcatacttggtttaatttcttcaatcaatcaagtgactacctgccacacttatacaatcttcccgtggggcacgctcccatgaccttccgtaacagccaacaagtctgagcatcaataccaccagccgcactaacgctgagaaagcattcaagaatccataaccaggatgcaaagccctttaaacaccgatctcaggtgatgctgaagacaatgctagcttgctttaaacattcaaatccctttcctgctcatccgagctcatgatatccttgtcaacaccaaaccacaaccttgatcctcacttctaaatcccataccactcactgcacccaacatgataatatacaatagaacacgattttcatcataactccggaaccactaatagcttaacacttcatcatataaaaactttcacttaactcacttcaggagaaccatagcaacacacaagtgaatcatcataactgtagaatatgcaaatcgtcaagtagtgatctaagccaccattgcccttctaggatccgcctacacataataggccataacactggaatactcccgaattaaatcaattacggtggccgacaagcctcacatgtaccaccacaaatcacttgcataactcaatcacgctaaaggaactgatccttgccaccagtatgccaattcaaccatcgtcaaccaatccaaattcttttaattcatcattaacttgccttagagataataatagctccattccttacatcaccaaccaaaatccgcactcatcttgagcgacttcattccacaagaccacattttctccaaacccatgaactgtttcataccctccttgcacacacatttgcatcttcaactaatacactctttctgataacttctccacgaatccgaagtcttttgctcatttttctcccaatgctacactgcaagtcaaacatatcatagaacattccgagcctctcgccatcatcttctacataagcttggttcttagccgtacttataggctcgaaatcattaggcaccacaccataacttttgaatcactaggaccgttgtggagagccacccactctgacttggtcccgaatataatcaactccatgaatcttctagaacatgaacaccttctcgatgaagcatccggcttaatcactttccttgaaactcgtatctatacaaggcataaatcctgaatcctcccccaagtgtaaacatgagtcaataaggtcaaccataacacacctttaacaattcctttgctcaaattacctcttattctctctcccttagttgaaatgaatcatcaatatgataataaccggaaatctcgtaaataggagaccatgcattcaaaccgtaggcggttggatctcccacttagcttgaagccacaattacacaactctggaacccaccaatattctttatctcttattgacaagtccttgcgcaattaaaccaccacattacttgaaatccttccattagcacttcatgaacactctgaattaccatcaatattcacatatttgacctctaccggatggccagtaacatccatcgcagaagtttcaccaatcacgcgactgttaaccttctcacaaggaataaccaacctgtcgaaattacctaccgacatcttccaatgtcgctgcacggggtacaattactacgacatcaataatccatcatgagctcgcgctcatccaccagctgcacaagtccattcactcctcgtggacattaactaaatgtacgacaatatcttccaattcaaaattatgttgtatccttatttatatcaagcagctcctttccatcatatcaaatctcccgtcgttatgctagtcaatatttcaaatttggctcataaacccaatcactgtccactaaaattcccccaaatcattccaaacttcccttaaggtgcatagtcatcctaccaccagacttaaatgcaactctgccactctcccactttggcaaaacccgctccttaatcaactattcaaccttcacttctaatacatggcctcgttaaaaactcaaccatcgcatgacacctcccacatgtaattcctcatccttcgttgcccagttattgccttaaataaaatctatcttcgtagcacttgcacccacaaataactactaactttaaacctttccgaagatcatctttctcgagtcgtcaacattggaagcaccgattcattcctgaaccactgcaccccgtgatctctgatagcagtttctcaaatactatttcacaatatcctgccccaaaagtgaattgcataagaccattacatcggcgaacttaacacattcaatcgaggacgacgacacaatattttagataaaaatttcaccactctcgaaaataccaagtctcgttacttcctctacccaactctggacgttcataggctattgctttttctctgtcgaaaataaaataccaaatctctgaatcatacactgagtagacctccatttagttcattcaccaccctaacatatgggcaagaaccttaccaacacatccatattgtgcgacaaccgatcatgagcaatcataaaaatctgtgcatagactcaaagctctcaagaatattgttactgagctgaaatgacaaaatatccttccgcaaggcaacgataatagcccaatcaactatgcagggataaacatcccataccacatcaatagtaccattaaaattcttcaattctcgatttataataagcgttttgcgtcgcataagattaagtaggaaggaaacaagggcataagccttaaggaataaaatcgcatgatgatgaatcaagaagggacgtgctcctaacagtcctgtagcgtctcgaggataagtacaaacaactctgtaccgatccgcgagactctactagacttgctcatgactcgtgaaacctaagggaacctagtgctctgataccatgttgtcacgactcaaaatccactaagggtcgtgatggcaccggacactgctgtcaggcaagccaaccaaaatacttaattaaattctcattttaattattttgaaaactatgattttccttcaaattttactagtaaaagacaaactttacaatgtaaataaaagaatgtttagaaataaatacaagatacccaataatcatcccagaacccagtgtcacaagtttatgagcatttactaggaatgaaataaaatacagtaactatacagaataccaagtggacagaaatgcaaatgcagtataatgctataaaggggactctactggttgtgggtcgtctcgacaaatgcatctcacctaagtctccatatcaaccatgccgctatgccactaagacactagccacacatgaacttgtgcaacaaaaatgcacagcaagtatagtataagtatgaaaacaatgtgtactcaatgaatgtcctgtctaatctcgaagaagtagagatgagaggtcgacttcgacacttactagtggtccaatgataatatagtgaaatgtgaggagatcatggatttttttttatcaaacaaacaattataattcataaagccagatagcaggtaaacaacttcccaaataataatggatttccaaagaattacttttcatcttctttatcaatttatctccagccagggaaggcaaatatcaacatttataaaatcttgggaaaacaatacaagcatatgcatataatgccgaggtcgtacggcctgatccaacataaatgtaaaatgagcactaccgagggtcaaacggtacgaaccatagatgcatctattacccccgctcgcgaatcatacatgcgatgcggtcaacataaataaacgaacaccccgctcgcgaatcatacatgtgacgtgggcacacatagatacacacattcaaacagctaattaagaatttatcggggaacatttatccaaatacaagccaattctcttttactgatttaagaaaatgaagttttaatctttttagaaattcgtttaccaatttgataggatttaagcaattcaactatcaataagattacaaatattccaagtagagcatgtttttgggtcctagactacccggacttacacataatagaagctacgcatggactctcgtcacctcgtgcgtacatagctcccacaactagaagcacataaccaattatttcacctatggggataattccctcttacaaggttagaatggagactcaccacgctccaaagatccataactggcattcctcgcccttccaaagactcgaatcaatgcacaatgctccaaaactagccaataattatgcaaaaccattaatgtatgttcaattactcattataatccaatttataacaattcctaaccctgatcaaaaagttgacaaaatcgccctcaggcccacgtgtacggattccgaaattttttgaagataaagtttacccatgaactcacaaactcaaatatatgattttctcttaatttcataccaaaaatcgtggtcaaaatccaagaatatcaattttctaggttttccctcaaaccccaagtttctacgaattatcatgctcaaatccgcacataatcaatgtatttaactcaagataggtagggatagcttaccttgtcgttgatgatgaaaaccccctcttgaaacactccaaaaccgtccacaccaaatgaaaataggggaaaaatgaccaacccccgactttaaaagaatacactgcctccagcctttccgcacctgcggtgcataagccgcacctgcgaccatcgcttctgcggtgcacgtgccgcttctgcggtcccagggtcagggccaaaatctgcttttgtggtctcctcaacgcagttgcgctcccgcatctgcggttaaagtgccgcacctgcggtcattgcaccccttcgcacaaaccgcaaatgcaacccccttggtcgcttctgcggcttcgcacctgcacccaaaagctcccaggtgcggttcaccagatatcagctgcctcaattcttcctcaaattccaatattgatccgttaaccatccaaaatccaccccagtccccccgggacaccaaccaatcatgccaaccagtcccaaaacacattacggacttgctcgaggtctcaaatcatataaaacaacgcttaaaccatgaatcgccctccaaaccaagcttaaagaactttagaatttcaatcttcaacattggataccgaaacccatcaaatcacgtctgattgacctcaaattttgcacacaagtcacattttacattacgaacctattccaactttcggaatcgaattccgaccccgatattaaaaagtccacttccggtcaaacttctcaaaaaccttcaaatttctatctttagccaaatgactccaaaatgacccacggacctccgaattcactttcgatcgcgctcccaacaccagaatcaccatacggagctattcccaaactaggaatcccaaacggacatcgataatactgaaatacacttcaacccaaacttatgaaattcttcaaaaaatgctaacttctacaataggtgtcgaaacgttcccggatcttccaaaacccgatccggacatatgcccaagtccaaaattatcacacaaacctgatggaatcttcgtatcccgattctgaggtcatttactcaaaaatccaatattagtcaattctttcaacttaaagcttccgaaatgacaattctctttccaattcaaccctaaacttcccgaaattcagttccgaccacgcgtacaagtcataagaccagaagtgaagcaactcatggcctcaaactgttgaatgatgtgttagagctcaaaacgaccgatcgggtcattacatcccgatctatggtggggtctttgtgaccacggtgcagtcttcgtgaccgtagtgggatttatgcggtccgcaatgagcaaggccatgtcttcgcggctgcgctagatatttcacggtccgcggtggagctccgcggccgcggtcctttttatgcgttctgtggtgagggtctgagagaagtatatataaacgagacttttcagttatttttcaatttttaaaaccctaaaacataagaggcaatttttcaagacactctttcttctccaaaacacaagtaagtgatttttaacttatttatttcactccttaacttccttttacaagatttaatcctagaatctagggttttcgtggtggaattgggaattttgggtagaacttaggaatatcggaatttggggatttagacctcaaattgaggtcggattccaaaaccaattatatatccgagcttggggtgaatgggtaatcaggttttggaccgaatttcgggtttggaccaagcgggtccggggtcgatttttgactttttggggaaatctttataaaacctatttttatgcattagagttgattcatttagcatttattgatatcgttaagtaaattatggctagatacaagcgaattggtggtggaaataagaggtaaagcggtagttgaggcttgaatcgtgttcaaggcatcgaggtaagtgcttggtctaaccttagcttgagggattgggagttgtatcttatttgctatgtattaattgttgagtacgacatataggcatggtgacgagtatctatgtgttggtgtcaagcatgcttgtgagtcttatactattattaatgtgactctatttcatattattcatgccttatatgatgattactattgttgaacaaggcttgtggaactattattggtaattgaacattatagagcgttggctcaagttgagaattgagttgtgaagtaaatgtgggaaagataagagatttatgatattgtctcccttgctaggatgttattgcttttgatattatctcccttgtcaggatgttattactcatgatattatttcccttgccgggatatagttgatatgctattgttcccttgcgggattttattgttatattattgattccctagcccaaattactttgtaattgttgcttgggttaggaagagtgtaaagtatgaagggtgatgtcgtgtatgattttaagagtgttaatgcacgaagggtgatgtcgtgccaatattgtgaggtaaaagcacgaaggtgtcatgaccccggttctccctccatgaaccatcgtgacggcacctagtatctacgactaggtaagcctaacaatgctgaaaataaacaaaatttgcggaagaaataattaaaaccaaaatagtgaaataaaatagtgtttaaaatgccgctcgacatacacaatagcaactctcaaaactaatatcttttcccaaaactcgaaatctcatgatcacaagcttttaaatgtctacaagaatctaactccagaatatctaacaaagagacaaaagtacagaagggctaatacaaaaagggagagtagaaatggactcttcggtctgcagatatacctcggagtctctacaagcgccttgtctcaagcgtgataagtctgagtgaaagtacctagatctgcacatgaaaaacatgcgcagaaagggcatgagtacaccacagcggtacttagtaagtgccaagcctaacctcagtcgggtagtgacgaggaaggttagggccctactgatgttaaatgaaatataaggtatgacagtatagagtaagacagtaaatattaagtgcaacagtaagaaataatatagaatagaaagaacaataacaattataacagagacgaggaaattcatggaaagaagtacagctcaacaaggagacaacaaccggggatctctcagtatctcgaggatctcttagtatcctcaatatatgtgtcggggatctcttggtatccagaggatctcttagcatcctcaatatttatgttggggatctctcggtatcccaaggatctcttagtatcctcaatacgtgtcggggatctcttggtatcccgcactacagtctaaatcaatatatctatatgcagtgggatctctcgggataccgtcccgtagtcccaaagtaaacatgcagcaacaacaggaagaacactcaactaaattcaattttacaacaaggtaaataggtaattctagcctagcatgcttcacgtagtccaaataagacagtttgagcaaataaagcaattaagtcaattagccatgattctctaatctaacaacaggcttaaaagtgcaagtagaataaataggaagggaaaacacaattaaagttacttaatgaaaccaggatttttcaacaattagcacaagtacgcgctcgtcacctcatgtacatgacatttcaaatatcaacaataccaatcctaagaggaatgtcccccataaaaggttaagcaagcgacttacctcgaaccagctcaaaatcaacgtgaaaccacgctcttgtcacgagtactcaactccaaattgcccgaatctattcaattcaattgcataatgtaaataacacttcaagtaactgattttacaaataaattctaagctaatatgccaaattaggtaaaatgaccaaaacgccactcgggcccacatctcggaatcgggtaaaatttgtattctcataatccccatactctcacgagttcatgtataccaaaattatccaaatccaaggtcaaattcctaataaaaattcgaattctaggtctaagaactttcttccaattttttcccaatttcatctccaatccgaaattaaatgataaaactaacaatagattagtggaatacaactagaaagggttaagttactcaataatttcctcttcaaattcctcccaaaattgccttctcccgtgctccaattttatttttccaagttttgaactaaaccctcgattcggtcccttttctgaccagtgaaacggcacctataatcccgcttctgcgaagaccctgtcgcatctaagacatttcattaaagggggacttccgcacctgcgattgctctaccacagatgcggtgccgcttctgctgtacctgaccacatttgcggtcaattgccttttgcctcaaaccgcttctgcggttgctcgaccatttttgtggtctcatacctgtggtctccaagtcgcaactgcggttatgacagcagccttgaagcttcagctgtaactcacaactccaaacctttccgtcaaacatccgaaatcatcccgaggcccccgggacctcaaccaaaagacgaacaagtcctataccacgattaaaacttatgccaatccttaaaacacccaaaacaacatcgaaacatcaaattaaccatagattagagcctaagaactccaaaaactctcaaaatatgctttcgatcaaaaaatctatcaaacctcgtccgaatgacctgaaattttgcacacacgtcacattcaacactacgaagctacattaacttccggaattccattccgagcctcagatcaaaatctcactatcgaaccggaaatttcaaaaattcaactttcggcatttcaagcctaaattagctacggacctccaaaactcaacctgaacacgctcctaaacccgaagtcactcaacgaagctaacggaaccatcgaaactccattccgaggctgccttcacactattccgaccacggcccaaattccacaacctaaactctcatttacggactaagtgtcacaaaactctctgaaactccaaataattcctcctggcaactcacaatagtagaaacaaacacgggaaaaacagttaataggggatcggggcgttaattcttaaaacgaccggccgggtcgttatagaagggtgataccatgccgcacgatataaaatgtcgtgtcgtgatatgagtgataatgcacgaaggataattccttgccatgatcttcgtgccaaatatattgattcttatggtgaggacgagagtaaaagtatgaagaatgatgccgtgcacttgtcttttatttctaattcttgttgatagttgaactatggtgttctttacatttatctgttgttacttgttgttccccgcagcatgtttccccccttctatccataactgtaaatttgttgcctttatttcccgctgtatatgatttaactgcagaggtttatttggtagtcttgtcctagtctcgtcactacttcgccgaggttaggctcggcacttaccagcatatggggttggttgtactgatactacactctgcactgtgtgcatatcccagtgctgcagcttttgggccacattgaggttgctaccttcagtccatcaggtgatccgaggtagtcctgcaagcgtccgcaggccttggcgtctcattctatccttccatattatttcttttatatattttagaaacaactttgtatttatctttcaaaccattatttgtagtactcttagacagtctgtgaaattatgacaccaattctgggtagtttatgtttaaggatttgtgtcggtattattattaaattgttacatttcgttcttccacttatttaattccgctgtttatataatgttagttcacaactgttaaaggattacaaatagaaaaggtaaaatatccgaaatgattggcttgcctagctttcactagtaggtgccatcacgactcccgaaggtgggaaatccgggtcgtgatattcttaaattttttcataattttattttttaacgtattattttaaatgtggacttataattttttagtgctacaataagctttatagtcaatattaatgctaataaaagatattcaataaattatattaggaaagacaatagtattggatatctatttttttttagttttttcatgattagataaaatgcacaaattatttttttagtgtttagtcatgtaaaaataatacttattttagcattttagtgattttagattatatttattttcattatggcttactaataatatttagtttatgcgattttattatctttattgttgaatattttagtataatatcatgactcatcacatattttatattattttcttgaaaaatatcttatatagttatgtcttactaggatcaaagaaatatttgaagcacaaattctatgatttgtgctatgaagactttatggagagagaaaaaaatcgaaataacccaaaaactcgagaaaaatcaaaatttaaaaacctgacttttattgctttggtttggtctttagatttaataatccagcactattggtttggtttggtaattgaaaaattcaaaccaacccgacctatgtacacccctaccactagcaatgcaaggattgttacacaaatagtcggctagattcaatgtttattttttcaagtcggtatacataaattatactttgatcacacacacacacacacacacacacacacacacacacacacacacacacatatatatatatatatatatatatatatatatatatatatatatatatatatatatatatatatatatataatatatatatatatatatatatatatatatatatatataaattatatatatattatacattgggtgaccattttaagattaagagattagatgggcggctatacggtataattcttcaaaatttcaaaactgtttctcattttcactgacgggctaagcccctagttctgcttctaggctggctcaatcttttgggctaattaggatccattaggctagactagcccatgattcaattgacaggcttccacccgcttcatacttatcactttggggtattatcacttttagtctgcgccaaaaattatttacatctcgtaatcgaaaaaatatataatttttgtatataacatacaaaatgtgtatgtatatatacaaaactatttacagaatttgtgtgtgtgtgtatatatacaaaactatttacagaatttttgtgtgtgtgtgtatatatatatatatagagaaagtaactaaatttttttataaaatatatataaattcggtcaaaatccacaatttatttacaacttgaatatatttttttttgtacaaaaatgctatcaaaatttgtaatttacatataacttatacataacatgtatgcagttatgtttattgtatatattttgtatgccttctctacacccgacatacaaaatatatattatttgtttatgtcttcttcttcttcgagttttaatttgaaattcctaatcaaaaccatctcgaatcttcaccatattccctcaaaatttagatataaactccaaaggatattctcaataatttgcaacaacgtccaatccaaacaaataacaatcttcaaaaattcaattttcgaattcaaagcttcgaaactttttaatggttgtcaatgaattttaagtctatgtcttcacggtccaatttagtttttgattttaaatttctgtttagtgtcaattatagagttaattataggaatttttacattccaatacactatatgaaactatattactcatcctactcaagttttactataattacattttatatacccaattaccatttatgtacattttaagggaattaatgataataattagtgtcctaaattactctaacatatcttccactccccatgtttctctctccacatcccaccccctcccccacgtatcttgcacccacccacgattccaccattgacaaccattaaaaagctttgaagctttaaattcgaatttgggttttcaaaaaacattgtttgttggaattggatgttgttgaaatgaattaggaattctctctacgtctctctctatctctcaattcctaatttcagtaatgtaaagcaaaggaaaagagaacagcaatttcaccattgacagtcattaaaaagctttgaagctttcaattcaaatttggattttcaaaaatcattatttgtttggattgggtgttgtttcaaacaattgggaatatggtttggaatttatatctcaattttgaggggttttggtgaagattagacttggttttgcctaaattttagattaaactcgaagaagaaaaagaagaagaagacatgatataaattatatttgcgaaaatgtagaaaaattgtattatgttgtttaaatatttttaatgttttaagcttcaataccacacaagagggggggtgatttgtgtggtacccaattttcgctatagaagaacctggttcttctaggtgttttaactactactgtttgcggaataataagtgcataaaataaagaacacagagatttttacgtggaaaacacctggctcaaaaggtgaaaaaaatcccgacctactactaagtaggattttcccaaacttccactaaaatcactgtgccaaaacagcatttacaaaaactctttgtaaacataaggattaactctaatcctgttgtggcacacagcctcaactgttacgacaacttcaagttagctataacttgaacactctaggtacctaatacaattgcttctatgaaagctgaaaggtacaacattaagctacctactacaattgaactagagtaaaagatagacacaatggaactggttcttctatctcgttcaagtagctttaggagtgcacactcaaatcacacctaaattacttgcaaaatcacattgctttttgctctcaatttagtttcacttctgcgtatgtgcaatacttataaaagagaataatcattgtcatttaataggttagtaatcagagtttgatcgggactcaattgctgaacttctatcgtagaagagttcatgatgatctcaaacactaacactatctttatcctggatcatgttctcttcatataaggagactttctccccttatctaatatgcaaccttttttatcagatcaggagattgttgcttgatcagcaggacttatctccttcacgtgcatctcacattcatagattgatcatgattgtgcttcacaagatggacctggtccatgactgagttcatttgtcattctttaaaacttcacctgttcttgggccaataaattttccctttttgatgatgacaaactttgtgctttttactgatttgaatcatgtaagaactcaggttaaccatcaatactaaacttagaaaattcacttatcatcaaggaccaggttaattaggttataacaatcacttattttcagaatgtgtaaagtacaatatttcttcccccttttggcatcatcgaaaagttgcatacgaagtgtgatacccagattttaataagtactcatggccactagggcaactgcaagtgcaatcatcagtaatcaaacaaacatatttaaactatcaaggacagattaatcattgaacaagagaaaataacagttatcattgaagagatatgttgccacctacaatccacaaaaagaaagaaaaacattaaaaccatgagcaaaaaatagaaaaatccctaatctgggtcactggggtactgaacaagttcaggagacagaagctaggaatcataaggcttggagaaactggagggttgggtttgagtttggagaagattcagcatattttgaagaattccatcattcttctccttttctttggaaagctcagttctgataccatccctcttagtttccacttcaaccacacgagccttgagcctaacaatttcagcatccttggctgcacattcctgaaccatagtcctaactttgctgttgatgggtgtcttctgggatgaaccaggttcaatggggatggcattaactcaatagtcacaggcaagaagagtttgatgccaaagtgttccttgctcgaagccatttcccatttctttagaggaacatttaacctgtacagaactgtaatcagaatgaagccatatggagtagcatgagctttggagctatttatgaccctgtctagcagtttgataatgaaggcatgccagtagatttgctttcctctctccaggaactccataagaactagatccatatagttatcagtgtgccttctctcctgtctggacaataagcacttattgacaaattcaaacacaaccttgtgctcagacctcatttcactcttctgcacagccctggcttcagtcacatcttttgaatcacaaaacctcttggtgatttcaagggtagtagggagggagtccaggcatggccacctttgctttgtatagtcatcaaacccttcagagggtatgtccggatctctcccagtttctctgcatcaatgtgcacttgaactcctttcaccaggctactaacgactccatccttaacagtagcattggccataaattcaatcagcttatttctggctagcctaccatccatctaaaggaccatttccttccatccctaagcagctaaagcatccaccattctcatcattcctggttccactaggtccttcaacagtctaccctttaaaatatttcttctgccaaaattggcaagcttgtcctgttccttctcagaatcattttcttcttattctccactccagtcatcatcatcagaaacttttgattgtttggttttcactacagatcttgtgctcttggctagtgtgggttcaacagctacaggcacagaggaagacttcttggaagaggtcttgggctttttaggcatgggtgtaggaacctctactattgtacccctatcttgatggaccagttacatatcctcttcctcaacagcctctgaggaatctgcaatttttccctttcctttatcctttatctttttcttattttattctaaggccctttgtaaattagcttcagtctgtttcacactgcttcttgtggatctaccccttggcaatgaggagacagtaggtgttggagatgaagactttcttttcttggaagtctttggaatatttggggcttttgttgtgggagttctgtatttctttgggtcatagcatgctccaacctttttcagtagatcagttatggtctcttcagtatatgaaacaggttcatctctctgtgtgctcagatgaaccaacccttagcatcttccccagaaccacttccccttgacttcatgccactctcttctactctttcatgttcaaccccacagatggcaggcactataattttctcaattcccatatcttcaccacaagcaccctctctatctttttctttttcaaaattctttttacctccactcctatgtttctcaggaacttcaacatctctaattggtccaaccagaacaaacctaatctctaggttttcaatcatagatgaacttacctcagaaggagattcttgaatcttttcaaagtcagaagacccatgtccttccccctcagctgcggattgataggattcagactcagagctggagtcggaatttggagcttgtctttctttaacttggcttgctttcaacctttcatttaaagccttcctcagagccccagatgatacaaccattcgagcaagcattttcacccttcgtagtctaggttttggggatacactgggtcgagtagatgaggatgaatttaagggagttccaagattttcttctgggttagacatgattgtttgtttcttgagagaatctgggaattttggagaagaggacaagtgaaagtgaaggaaagtttttgacggtttggagttatgatgaaggctgtaaaaaagatgtgtatttaaaggaattacccatttaataagaagcggcagccttttgcagtggtcaaataggagtctaatcaacctaaaattccagattttgaatgatctatttggcttccctagatattaggcaaaaattacggtttagagttctaggtggacggaactggttcaatgctaacgaatagaattttctaggaattttataagtataggacttctgcgcatgattgaattattaatctttctaattgtgccgagtatagaaaacatacctgagctttcatatgaactcatactgatgaaccaggttcttcatttagaactctcttgaacatgactcaaatgccataatatagaaaatttcgtaagagatcagtgagtcatataaacacatggcacaggagtatactaattaaagtatgaagctgagtaagaattaatctagatatttacacgagttcagaattcctagccaaaattttttttttatatattttttttcattgtgcattctcagttggacctattaggtgatcttaatcatccctaattccaacattttcctctcaaagttttctgtactcagtgttgtagtgaagatgtcagcaatttgcttatcagtagcacagaattctatagagatcaatcctttctcatagttatctcttaagaaatggtgtctaacatctatgtgcttagtcctcttatgatgaacagggttctttgtcatacttatagcactagtgttatcacataatataggaatgcaaccaacttcaatgccaaaatctaccagctggtttgatccataacaattgagcacaacaagatgcaacaatatattcagcctcagcagtggataaggcgactgaattttgctttttagtggcctaggatacaagacatgaaccaagaaaatgagccatacctgaggtgtttttcctatccacaaggaaacctccataatcagcatcagcatatcctactagattgaaattactacctttgtgatacaaaaaacacagatcagtggtgactttcaaatatcttagcatcctcttgacaacagtcaagtgagactcttttggattggcctggaagcgagcattaagccctacactgaagactatgttaggtctactagcagttagatataagagtgaaccaatcattaccctatacaacttttgatcaactgatgaaccgggttcatcaatgtctaattttgtggcagttgcaatgggggtgtctatttcttttgattcctccattttaaactttttgataagctcttttgtatacttctgttgatggatcatggttctatttaggctttgtttgatctgtaagcctaagaagaagttaagctcacccttcatactcatttcaaactcactccccattaattttgcaaaatccttacttagcttatcagtggtggccccaaatattatgtcatcaatatatatttgtaccacaaggagatctttacctttttcccttaagaataaggtactgccaattttacctcttttgtacccatgttcaagcagaaatttggacagtcgttcattccatgctcttggagcctgcttgagtccatagaaatccttgtctaatttgtacacatgatcaggacattccttgctctcaaaacctggaggttgttttacaaacatttctgctttcaggtagccattcaggaaggcacttttgacatccatctgatgaagagtaaatttcatgtgtgctacaaaggctataaggagtcttattacctctagtcttgcaactggagcaaaagtctcatcataatctatgccatcctcttgactgtaaccttggaccaccagtcttgccttgtttcttgtaactgttccatcttcatcaagtttgttcctgaagaccaattttgtaccaataactggtctgtccttgggtcttggaactagatgccaaacttgacttctctcgaactgattgagtttatcttgcattgcattcacccaatctgcatcctgcaaagcctcaacaacatttttaggttcaataagagataaaaaggcatcaaaagcacacagattctttaattgtgatctagttttgactccagattggatcggtgataatgttctcaataggatgagaactttgatacttgtgatgtttcacaactaactgtttctgctagatgtttctcctatattctattgctaaggaacatggtcatgaacaggttcttttaggggtttttttcaattcctctttgatcagtttcccttgtcaggtttccctgagtggaagaacctgttccattatatgttccttcttttggtgccactttatcttgtgctgaggcttcagtcaaatcctttaccaatccaatagcttcatcttcatattcctgtctctcagaaagaatgttagtttcatcaaacactacatgaacactttcttctacacacaaagttcttttattgaacactttatatgctttgctatgtgaagaatatcccaggaatactccctcgtcacttctgggatcaaacttacctagggagtcttttccattattgtgcacaaagcacttgcatccaaattccctaagatgggatatatttggttttctccctttaagtaactcatagggagtcttctctacaagaggtctagtcatgcatctattgataatgtaacatgcagtgtttacaacctctacccagaagttgtggggtagtttactagaaagaagcataatcctagccatgtcttcaagagtcctgttctttctttcaactactccattttgttgagaagacttaagggcagagaagttatgatctataccattttcatcacagaattcaacaaacttagcattttcaaattcagttccatgatcaaacctaatggatgcaagttgatttcctaattatttctgagtttttctaacaaaagcagtaaacatgtcaaatgcttcatttttagatgttagaaatattacccaggtatccatctagaataatcatcaacaagtaccattacatatttctttccacctctgctcaaggttctcattggaccacagagatccatatggaccagttccaatgacttggttgtgcttaacattttcttgcttttgaaggatgatcttacctacttcccccttgcacaggcctcacaaactttgtcttccttgaacttgatgttaggtaaccttatcaccaagtccttagagactaatttgtttagctaattcagactagcatgaccaagtcttttgtgctacaggaggggatcattatccaacacacttagacaggtgagtttagaaagagtagacaaatctacaatgtaaatattgttaactctttttccctgcaaaacaatcttatcagtgataaggttaatcacaaagcatttagtagaggtaaatgctacaaggttacctctgtcacacagttgtgacacactgattaagctgtatttcaagtcatatatcaagtagacattctcaatggagtgagaatctgtcttacatacctttccaaccccaataatctcacctttattcccattccaaaggagacattacctccttttaggtcctcaagttaaagaaactggttcttgcttctagtcatatattttgagcagccactatccatgtaccatatttggctacttcccttcacttggacctgcaaaacgaaatcaagggttagtcttaggaacccaaactagtttgggtctctttctataggcaaagggataaatcaaattccttttagcccacccaggcagcctatttatatcttgaacaaaagttttgttcttttgactggccttttcttttgcattatattcatttttgtaatggccagtcttaccacattgtgtgaatattttgttctcaggaagagtgagatacttgattttaggatcccacttaggtgcttgaattccatagccaagtcctcttttattgccactgtgatgttcttgtagccagaaaagtacatcagaagccttgttccatttgcaagttctgtctagttcatgttttaccttctctagatctttttttaagacttttatctgctcatccctcctgtacaactcatctttaatttttcccaaagttttcttctagagtgagatgtgtgtggtcagctttcttcttacctgtccctagtttcagttttaagttctcagacctaagttctaggatactggcgtcaagttcaagaacctggttcttcaactcagcatttttactctcactctcattagccctagactctaggtttttgcacttggcttttagtagcacacattccctagacagatcctccttctcattgttaattatttcagactcatcaatgaaatctagcaataactcagacaacctttctttagataggaatgtaatcttatctttgagattaaggatacttacctcttattcattatctgattctccgatggccataaatgcttattcatctccagcttcatcttctgagtcctcatctgatgtttctccccaggcagcaaccatagcctttgttgatcatttgttcctttttggttgaacctgttccttcttcttgtcccttcgtttagccctttccttcttctactcaatttcccattgagggcaattcttgatcatgtgatcagtcttaccacacttgtagcaaccctcattggtatgtttctcaggagcccttagtttgttaaaggttgtacctcttgaagaaccctttcctctcatcaggtactttttgaaatctcttgtgatcatatccatttcatcattctccagatctgaaccttcagcaattctaagagccagacttctttccttcttaggtgcatccattttcatggtttgccttctcagttcataggcagtgaggtttccaattagttcatctagcttgagggtagcaatattctttgattcctgaatagcagtgattttgctttcccaagagactgacagaacccttgtcaaaatcttctcaactttttcttcttcaagaataacccttccaagagacttaagttcatttgccagtgtggtgaaccttgtatacatatcttggatggtttttccttccttcatggtgaaattctcatactgagaatacagcagagttcctctggacctcttcacttgaggtgtaccttcatgggccacttgaaaagtgtcccagatttccttagcagtggtacagctttgaattcaactatactcatgtggacccagtccacacacaagccatttcttggacttggcattcttctcccatttcttcaaatctttagcagtgcagtcagctcttgtctttggcacatccactccttcagcattcttctttgtggttgctagaggacaattagtgactatatcccagagttcatagtcttctcctctgatgtgatccctcatcctgttcttccaccaagaatagtactgaccattaaaaggtagaggcctagcagtggattgcccttcctagttcccaggtggtgcactcattttgatattttcctaaggtgttagcctcttcaaggataacctgctctgataccaattgatgttttaggcgtcaataccacacaagagcgggagtgatttgtgtggtacccaattttctctatagaagaacatggttcttctagatgttctaactactactgtttgcggagtaataagtatataaaataaagaacacagcgatttttacgtgaaaaatacctggctcaaaaggtgaaaaaaaccacgacctactactcagtaggatttttccaaacttccactaaaatcactaagtcaaaacaacatttacaaaaactctttgtaaacctaaggattaactctaatcccgttgtggcacacagcctcaactgttgcgacaacttcaagttagctataacttgaacactctaggtacctaatataattgcttctacgaaaactgaaaggtacaactttaaactacctactacaattgaactagagtaaaagatagacacaatggaactggttcttctatctcgttcaagtagcttcaggagtgcacactcaaatcacacttaatttcttgcaaaatcgccttgctttttgctctcaatttagtttcacttctgcgtatgtgcaatatctgtaaaagagaaaaatcactgtcatttaataggttagtaatcagagtttgatcgggactcaattgctgaacttctatcatagaagagttcatgatgatctcaaactctaacactatctttatcctggatcgtgttctcttcatataaagagactttctccccttatctaatatgcaaccttttcgatcagatcaggagatattgctgcttgatcagtagaacttatctccttcacgtgcatctcatatatatagattgatcatgactgtgcttcataagatggacctggtccatgactgagttcatttgtcattcttcaaaacttcacctgttcttgggccaataatttttcttttatttatttcactattgtatgaaagttgaacaacattgtataaaaattatatttaagttgtatgatattgtagttgtatataactgagtagaaataatatatgaaaattgtagataagttgtataatatataattagttgtatgaatttttttttactatgtataaatcagatacaaaatatacaaaagacatattgtataaattttgaataaaatttctatttaagttgtatgttattgtagttgtatttaactagatagtgcacgaaaaagttcacatgaataaattgtgtgcatataaatgaattcataatatgttaacaaactgacaactgaatattccattactacccattgacattgtgacaactaaatttcgctcctgaaaaataataatcaagacaagaaatatagcgataaatattatattcaatttcaagtgatggggttacaatctctaaaatatctctgaatctaaatagatgtagtcctctaattcttctcctcacggatgatggttcaagagcttgaaagcttgattttgaacttgacgaatttcagatttgtagtacgtcacaaacaatttgaagcttgtcacgaaccaggatttgatgttgggttatcacgaacggaagatttgaagccgcccgcctatgacttgagttcgcctttggaatttgaccacagacgacgattgcagatatggatgaagaccttgatgctattcttcagagcttctttagtctttccttctgcttacttgcttcttctttagccttctcttttgactcctttatataggtgtggggtggagtagtctccaagaaaaccctagtaaattattaggcttgaggcttatgggccgacccatttgatagaagaccaattgacaggctagcccaataatatattggacctttatttaaatcaatttggttggatttaaataacaaacccaattataccagtccatgttacttaattggaccaatatatatttaatttgtggtaaaatccaaatttcttatggatttaaatttgacacaattttaattgtctacaaatgcccctacttcaaggcttggtgggatgtaagcttgcgaaaatgaatggcgagacttaaagtaccgttgatgatgacaatacttcccccatcattttgtaagacaccacactgataattatttacatgttctatttccgaagagtgaattgacgttatcaatgattggaattggccactcttttacttcattcaaagtgagccaaaatgacccctaatagcaagctgggctcttgtagcttaattccccttcttcaatgagaaaataaatttggtggcctttcttatgtagtatcaacttgattaaagaataactaagttcatattgaactaagtcaaacacatccacccaggacaaattaaaatttaaaccgcgggatttacgagaaacatttggtttattcacttgcatcccagttcaaaggatatgctttccttggaacatttactcaaagaaaactctcacaacatagcgctcctccaatttggctgctacgataatatatttcccttacttgttatttcctcgtatgaattggagagacttcacattggccagcattagtagtaccacagaatgatctttattacctagatggtgatcaattagcagattttatggccctttttttttactaagaggtgaagcaggcaacataggccttgacaagagcataagaggcaaggcaacatcctgatcaacaactctttgcctaagcttcttggctatatcttccccaagttgcaagtccttttctctaattcacattatttggctatgaatatacacactcacattcttttcactcaactttttcgaaggagatgagctcactctttcttgatgcgtctccatctcacgattttcaaatgagtatataattgtggcaattatggattcaactatatattcacgacagaataaggatgaagttttgaggcaagtaaagtgatgataaagaaaacaaaagtatgccgctatatagttgtcatgttagattggaaagtatgccgctatgtagttgtccgatggcatcaaacatggaaaattttaaagcttttttttaactttcccgtaacaatacttgggctgacaataattttccttttctactttgatttcctagtttcaaacctattcatgtacaaatcggacatgatatttccttatttgcatatgtcagtagcttgaacaccaagaatttccttaatttctttcttgttggttcttataaattcgccactttctccttgtattgttgttatagcagcagtcctccacttttgatgaaagcagtagtactcttcaatagttggtattacgcaatcctcgtcgctcaattctcctggagcagactaatgttttttttctttttgctgcagctgctgccaggaattatcagcattgcgcgtcttaaccaaaacaaattatatctcggtgtaggagcatcgaaatcatgagcgatttgcggctaccaaaactagactcggagtactacaacatatcaaaatttggatttaaattcgtattgtatcatcccaggtgagcttcataatcttggttcaagttctgtcacgctcgacatttcagttttgcgcgtcataatcaaaaaaatcatatcttggtgtaggaatgccggaatcacgagcggtttgtggaaacagaaactagacttccggagctacgacataggtaaaaatcattatcagaatatgcagatgtattcccagatgttttctcaaatttaggcaacgtattatgacatgctgccccattctgtcttgctgtttttatttttcatagattcttccccttttttttcgcagactctcggagcagcacatagggctgtgaattccatcaacaaggatgcgtttcatcgaccatgatacaccatacccacaccttgagattattagcgacaagcagagtccgcgcgcccaagttctaactttaaaagttcatcctccggtgataggtgctttcccgctcgctagaaagccgcttgacgcctcccttgatcttgcagaatggtcgactagagagacgaaggatgcattggacagattttcgggcaaagcaaccaacatgaaggtcctacttttgaagtcctccacccatcaaaaggccgcgtctactagtcctcttcatcgtgattatgatggacgtcttgccacttggagtgttcctccttccggatttggtgaagtttgctatacatccaaataatgggagtgggtagaagatgttcttgcccgcaacaagttgactttgtatggaatcaaggtctatgacgccatctttgcttcgttgttcacatatgactacaatgagaatgtcctccgtgccttttgtgagctttggcgttcatctaccaacacaatttctacctccattggtgaactctccatctctttatgggacttgcgagaaatcggaggccttccggtgcatgggtctttctacgacgaagttatcccctcggctaaggagttgacacaagaagacgatcaaggaaaacctttcctcccaagaagttgtctgcacctgttctcggcattctacaaactcatgaaggatcatgtccacaaggtctccattcgtgattgggtggagttttgttttcgaggaccgagtaggtatgccaagcctccgcaaaagtcatcaaggaatcggactacaaggccgaagttgaatcataatccttctgggaatattgacgcgagcttcctaccacgaaccgatgaggagaatgacccctttattgagcttggcgtggaggagtcacttagagctgagacttatttggcggctttccttgcatgttggctttgcaaatttgtgttccccaacaagaagatcgactacatttgtgctagtgtcttcaaaatcgcgagtctgatggctcatgtagagaagttttccttggcggttcccgtccttgcaagtatttatcacggcttgaatgaggtctccacttctcaagatttgggtgcctgcaaagcactctttcctattcattacgtatatggatggataggagcatattttgacacctactatcgtgttaagcgtccacaacgaggtccgcaaatgtgcaaggtttctggcgagaagatggacaagcattttgaccttagtaatgcccgtgagttgtttcaacaagttagtgcgcgacagcttcaccatttggctatgctacaagggagggaattgcatcttaccgatcgtgacgaacaatcgaattcttggagtgacttttttataagtctccgctcaagcttcatcacccttaggcatgacgacattcatattgtggaatcttatagcctgcataggtttagtcgtcaattcggcttttgtcaagatgttcctggcaacctcatagagcgaccctataacggctcactgagaatgctagtgcaattctgggactcctgtgttcgtcttggaggttcatcaaaggttattgtccctacgtgtccatcagaggagggacctctaatgactcgtgagtatgcagattggtggtaagctcatcgagtgcactcttcccgacaaagtactcatatcattttgaaagttccaaggaaagatgatattcctttatcctccaaagatgatcaacgtcaaaagaacactcacgaagggtcttccaagtccaagttaagatcgaaagatccttcgccaagcaccaagaccttcccatagaggctttcttcaagacgtacgcagattacgatgctttaagatcgtccaagatgactaaagaatttcaccaagagtcactttctgatgcacgacgacgcctcgatgatgcaaaacaggaatatgaaaaagtgagcgagtccgtagaaaaacttcaagccagtcttgcgaatgttgaataacagctagcttccttggcctctagaaagaagaagatcgtcgcactcttggacaaacaacaggtgaagttggctaaaagtcaagagaacgttgacgttaccgaaggggagatttataccattgaagccaatcatccattatctgacgatgaagcagagaaattatccctcctgaaaggggcagttgagacaagccgccaacaaatccttagcttcaaaccttttccatgattttagagttttttttttctcttttttttttttgcttaggattctcgacttgcgaattttttttacaactaatatcatgtaatggagtacttatatcttggtgcaataaaagtatctttattttttttaatatgtgatatttctctttgagacctggattccctctgttactaccaattatttccttcttaaattttagcatatgtcttgtatgttggttttgttgtttcgcgaaaaagaattcatattttgctgtaggagacttcaaaacataagccacttgcttcaactgaaactagactcataggactgaaacgtatcaaaaaattagcacgaatctccttttgtatcagctggaattaattttcaaagtcgatctacacgtctggcccgtgtttagctcacatctttgcgcactctgcacaaaataaatcacatctcgagattggagcattcaaatcacaagccgtttgagatgtcataaaatagaccggagatctaaaacttgtataaatttcataacagaactcttttcggactgtgaacagaaaattcacgaagtcgactcaactgcagtgaattttcagatttgcgtaccttcggcgaaaataattgtatcttgagcttggagtgtcagaattgcaatccgtctgtaccgttagaaagaaggcctggagatctaaaaactcatataaattttataacagaattctttttggactgtgaacagaaaatccacgaagtcgactcaactgcagtaaattttcagatttgcgtaccttcggcaaaaataattgtatcttgagcttcgagtgtcgaaattgcaatacatctgtaccattagaaagaaggaccggagatctaaaactcatataaatttcataacagaactcttttcggactgtgaacagaaaattcacgaagttgacacgactgcagtgaacttccagattcacatgaatcatgtattccacacattgttttcttgaagcttaagcgactgaacttagaataaaactctatgttgccaacgtacctcggtgaagaggatcaagtcctaacgtagttaaaaataggtgagtttttttttgtatcctaacttttgcctaggccgcctctttcgaggtttttgacctagcggactcctttttttgggtgtcgttcacaatttaggctcatgcgggccaggagaattgcaacatgcagtttagattcttgtgtcaaggagcgtagcagcatgcagtttaggctcgtgcattaaggagcttcatgacttgcagtttaggcgtgtgagtcgaggagcgtagcagcatgcagtttaggctcatgcattaaggaaattcatgacttgcagtttaggctcgtgtgtcgaggagcgtttattcttcaaggatagtacctattcaaaaatttcccattgatagggtcagttctcatgtcatttgcatcaactaacttgtaagctccacttgaataggcttcttgtacaacatatggaccatcccactttgaagtgaatttgcccccagatttgcgagaggtgataataggtcttcttactgcaagaacttgatcgccaacttggaaggacctcaagcgaacctttttgttgaaagcacgagaaagacgagcttgataacattcaagactttgttgagcttctagccttttttcatcaagggattcaagttcttcaaggcgtaggcgagcgttttcttcctcaataagaccttcttggacagcgagtcgcaaggatggtatttgacgcttaagagggaagaactgcttcaactccataaacaagagaataaggagttgcttgtatcggcgtgcaatgtgtcgtacgatatgcccacaaagcttcttccattctgtcatgccaatatcttttagacttggagacaaccttctttaacaagttgcaaagcgtcttgttaaatgcttcggctagtccatttgcagcagcataatacattgacgaattacgtttcttgaagccaaaaagttcacagatcttggtcatcaatttgttatcgaacggtttgccattatctattattatataactaggaatgccaaaacgatatatgatgttcactcgaatgaagtttgcaacattctctttcttcacttccttgagagcgacggcctctgcccattttgagaaataatcagttgcagccaagatgtatagatgtcctccagaagattttggaagtggtccaacaatatctaatccccaagcatcaaatggccaagatgcaacggtagggtgtaacatttcaggaggttggcgtataaaatttgcgtgaaactggcaagccttgcatctccgagcataatctaagcaatctttcaccattgtcggccagtagtaacccatcctcttaatgtggaagtggagcttcagcccggattgatgtgatccacaaactccagagtgtgcctcttgcatagcttgagttgcttcatcttcccctaaacaacgcaagagaactccctcaaatgatcttcgatacaaagtgtctttgtagtaaaggaagcgaggggcacaccaacgaatttcggtctttcttcttggatcttctagaagtatcccataacataagtagtcgatcatggtttgtcgccaatcaaccttcacagcttcagcgacggctaccaaatgctcgagcttgctttcttcatcctcgttctcatctggcggtactatccatttttggtagatagtgatttgtgtctggctagagtaggtagggcgtcagccttcttattttcctttcttggcacatgctgaagagttacattgccaagccatccaatcaatttctgcgcataatcataataacgacgcaattctggctttttgacctcgtagctacctagcaattgattgatcactaactcagagtctccaaaaatatgtaattggagttgtctcatatcaacggccatctcaagcccaagtataagtgcttgatattccgcaacgttgttggtgcaatgttgtgttaaggtgaaggaatatggcataacttccccttgagaagtgacaaacacaacacctccaccagctccctcacgatgtgtggcaccatcaaaatacattttccacggtggttgcacttcgatgaccatcgtatcctcatcaagtagttcatcagtcaacttccaatcatcgggaattggatgatctgccaagaaatctgccaaagcttgtcctttcacagctttttgtgggatatacacaatctcgaattgttgaaattggagataccaccttgctaatcgatcattgaggacgggttttgacataacaaacttgatcgggttcgcccttaagacaagacggatgacatgagcttgaaagtggtgcttcagcttttgaatagcgaaaaccaacgccaaacacaacttttcgatcatagaatactttagcttatttggtcatcatcctactcaggtagtattgggaattttctttattttcaccattttcctgggtcaaaagggctcccactgacctttcttgggctgcaatatatagaatcaatggctttcctggtataggggcttccagaactggaggtttcatcaagtaggatttgattctttggaatgcattgctataagcttggtcccattcaaaaggtatacccttcttcatgagccggctaaaaggttggcacttccctactaggtttgagatgaatcttctaaggtacgccaattttccttgtagacttttcagttcatgtatatttttgggtacgaacttgctccatttattgacttcttgcttatctcttcccttgagaggtttgtagaaaaacttcaagccagtcttgcgaatgttgaaaattcactacagttgagtcgacttcgtgaattttctgttcacagtccgaaaagagttctgttatgaaatttatacaagttttagatctccgagtctattttctgacatcgcaaacggcttgtgatttggatgatcctatctcgagatgtgatttattttgtgcagagtgcgcaaagctgtgagctaaacacgggccagacgtgtagatcgactttgaaaattaatttcagctgatacaaaaggagatttgtgctaattttttgataagtttcagtcctataggtctagtttcggtagaagcaagcggcttatgatttgaagtctcctacagcaaaatatgaattctttttcgcgaaacaacaaaaccaacatacaagacatatgctgaaatttaagaaggaaataattgggagtaacagagggaatctaggtctcaaagagaaatatcacatattaaaaaaaataaagatacttttatttctccaagacataagtactccattacatgatattagttgtaaaaaaaatcgcaagtcgagaatcctaagcaaaaaaaaaagaaaaaaaaaactctaaaatgatggaaaaggtttgaagctaaggatttgttggcggcttgtctcaactacccctttcaggagggataatttatctgcttcatcgtcagataatagttgattgtcttcaatggtataaatatccccttcggtaacgtcaaggttctcttgacttttagccaacttcacatattgtttgtccaagagtgcgacgatcttcttctttctggaggccaaggaagctagctgttgttcaacattcgcaagactggcttgaagtttttctacggactcgctcactttttcatactcctgttttgcatcatcgaggcgtcgtcgtgcatcagaaagtggctcttagtgaaattctttagtcatcttagacgatcttaaagcattttctttcttaaaggtagaagtatcaataacattttctttcttaatttcctcaagactcaaagcaatactttcctccaactttgtgaagctatccagagaatcaagagagaactcttcgatccattcacacaaggtatgccatattgtgttaacaaaagaaagtttaatacgtgaaataatctcttgtggcttaaagtttggagcatcaagatgcaacggccatggagtaggctcgaaggtttttagacgttttgcttgacttgcggcaacctccatcttactcgtcatggctggcttggaaagcacaacatcttctggaagaacgaggtgcagttctttgggtagactcaaatctgtcgacggagcattgtttgcagcatgatgttcaacaccatcaaataaagtgtgaggactttttgtggccacaccgaggggatttgggcttgtaacacagtcttccaccgtgtcttcaccaagtacatcatcatacaactcattgacgcccaactgcaaaaaaaatagcaactttagtgttcaaaaaaaagggagtaaatttgaacgaaataatatttactcgtttctccagttcagacaacggcatcgttgagctagggtcaccgtctacgaaaaatccagtatcgatactaagggcatccaagtcagcaaattcactatggctcgtgttcttagccttcttctttgaacgattccaatgtatgtcttgactaacatcactctcgttcgaactggaagtggaactaacattcaaaatctcattgggcaaagcagaagcttaagtcctttcctcgtttgttggcacgacattggttgtcttcgcaacatttgtgtttggtgaagtagcaggcgctttccttttgcaaggattgttcgtcacctctacagtggcagtagttgtcttggaagtcaacaaaacatgtttagctcctttgtccacatggtttccccgccccatcgaaggggtagacttgggtaagaccttggtgcttggcgaaggatctttcgaccttaacttgggcttggaagacctttcgtgagtgttcttttgacgttgatcatctttggaggataaaggaatatcatctttccttggaactttcaaaatgatatgagtactttgtcgggaagagttcactcgacgagctgaccaccaatctacatactcacgagtcattagaggtccctcctctaatggacgcgtagggacaataacctttgatgaacctccaagacgaacacaggagtcccagaattgcactagcattctcagtgagccgttatagggtcgctctatgaggttgccaggaacatcttgacaaaagccgaattgacgactaaacctatgcgggctataagattccacaatataaatgtcgtcatgcctaagggtgatgaagcttgagcgaagacttataaaaaagtcactccaagaattcgattgttcgtcacgatcggtaagatgcaattccctcccttttagcatagccaaatggtgaagctgtcacgcactaacttgttgaaataactcacgggcattactaaggtcaaaatgcttggccatcttcttgccagaaaccttgcacattttcggacctcgttgtggacgcttaacacaatagtaggtgtcaaaatatgctcctatccatccatatacgtaatgaataggaaagagtgctttgcaggcacccaaatcttgagaagtggagaccttcttcaagccatgataaatacttgcaaggacgggaaccgccaaagaaaacttctctccatgagccatcagactcgcgattttgaagacactagcacgaatgtagtcgatcttcttgttggggaacacaaatttgcaaagccaacatgcaaggaaagccgccaaataagtctcaactctaagtgactcctccacgccaagctcaataagggggcattctcctcatcggttcgtggtaggaagctcacgtcaatattcccagaaggattatgattcaacttcggccttgtagtccgattccttgatgatttttgcggaggcttggcatacctactcgggcctcgaaaccaaaactccacccaatcacgaatggagacctcgtgtacatcatccttcatgagtttgtagaatgctgagaacaggtgcagacaacttcttgggaggaaaggttttccttgatcgtcttcttgtgtcaactccttagccgaggggataacttcatcgtagaaagacccatgcaccggaaggcctccaattgctcgcaagtcccataaagagatggagagttcaccaatggaggtagaaattgtgttggtagatggacgccaaagctcacaaaaggcacggaggacattctcattgtagtcatatgtgaacaacgaagcaaagatggcgtcatagaccttgatgccatctagagtcaacttgttgcaggcaagaacatcttctacccactcccaatatttggacgtatagcgaacttcaccaaaggcggaaggaggaacactccaagtggcgagacgtccatcgtaatcacaataaggaggactagcagacgcggccttttgatgggtggaggacttcaaaagtaggaccttcatgttggttgcttttcccgaaaatctatccaatgcatccttcgtctctctagtcgaccattctgcaagatcaagggaggcgtcaagcggctttctagcgagcgggaaagcacatatcactggaggatgaacttttaaagttagaacttgggcgcgcggactctgcttgttgctaataatctcaaggtgtgggtatggtgcatcatggtcgatgaaacgcatccttgctgatagaattcacagccctatgtgctactccgagagtctgcaaaaaaaagggggggaagaatctatggaaaaaaaaatagcaagacagaatggggcagcatgtcataatactttgcctaaattcgagaaaacatctgggaatatatcagcatattctgattatgatttttacctatgccgtagctctggaagtctagtttcttttgccgtaaaccgctcgtaattccaacgttcctacaccaagatatgattttttcgaaagaggcggcctaggcaaagttaggacagaaaaaaaaactcacctattttgaactacgttatgacttgatcctcttcaccgaggtacgtagatgggcagcccttcgtttcccgcagaagccatgctcaactccatatcatgagcatgggtggaaagttcttcaaatgtcctgggcttaattccttgaaagatgtaacgaagtccccaatgcattccttggatgcacatctctatgccagaagcttcgcttagcctatctttacagttaaagcttgcattcctccatcgattgataaagtcaataactggttcatctttttgttggcgagtgtttgtaagttccacgatgctcacagtacgcctcgtgctataaaagagattaagaaactcttgctccaattggtcccaactatcaatggattcagcctcgagatcggtgtaccaatcacaagcattcccctttagtgagcggacgaactgcttgacaaggtaatctccataagtccctgcattgttgcatgtctcaacaaagtgcgcaacatgttgctttggatttcccttgccatcgaactgttgaaatttgggaggttgatagccgccaggcatcttcaggctatcgattattgcagtatacgactttgcgtacgtgagagaagactttgaagtgacctcatacttatccttgatagttcccataatgaattccttcaattgttctatgggaattgatccttcagaggagacatgaagttctttggcggatgacccttgttttgttggaggatcagccttctcgtggacttcaggaatctttccaggtgcatgacttgattctccatccatcatgctttcaactatgcctgacaattttgcgatacggacatcttgatcttgagcatactttgttaacccatcaatcgcctttgtcaggtttgcaagttgctcctccattgtcgaagtgttagtcatcattgcctccatgattattgcaaatgaccttcccaaggattgaactcagtttggaacatgtcatgtggcgagattggcgtaaagccaacacttaagacttcatcatcaggttgggtaagctgactcttggtattgtataaagtaagttgagcaagaactttctccataacttctacaatattatctcctctctctgacttgctagcagaggacctttcttcttcgaatgatgaagatctcaaagcatgcattggtgcagacgacacttggagtgcttgttgccccaagacgctcgccttgctccgggtgattggcccaagactcctcatagtaacgttcaggatactttcaacgtcagaagaaaacttggagtcagcaacttcgatcttctttgaagccatcttagtgatcttgaatgttgagagttgagaagagatgggaggaagagatggtcccactgggcgtgccaaaatttgtgacaactaaatttcgctcctgaaaaataataatcaagacaagaaatatagcgacaaatattatattcaatttcaagtgatggggttgcaatctctaaaatatctctgaatctaaagagatgtagtcctctgattcttctcctcacggatgatggttcaagagcttgaaagcttgattttgaacttgacggatttcagatttgtagtacgtcacgaagaatttgaagctcgtcacgaaccaagatttgatgttgggttatcacgaacggaagatttgaaaccgcccgcctatgacttgagttcgcctttggaatttgaccacagacgacgattgcagatatggatgaagaccttgatgctattctttagagcttctttagcctttccttctgcttacttgcttcttctttagccttgtcctttgacccctttatataggtgtggggtggagtagtctccaagaaaaccctagtagattattgagcttgaggcttatgggtcaacccatttgatagaagaccaattgacgggctagcccaataatatattggacctttatttaaatcaatttgattggatttaaataacaaacccaattataccaatccatgttacttaattggaccaatatatatttaatttgtggtaaaatccaaattttttatggatttaaatttgacacaattttaattgtctacagacatattcatacccaactggaaattttatgtaaaaaggcttcttgagtgtttgagctaacaaatttattttgcgctgactgcatgttaggaaatcaaaaggaggagacaaatgcccttcctctgtcaaagaaattgctatttatgatgtactatagctggtactcattcatccttgctacttgcatgtgctcttatcatttgtttatttcttttagttgcgaaataagcttgatgactaaggttgagaagtgaagaataaactgaaagaagaattacagtcaatacaatttcggtcataaataaggtttgctggttagtactgttataagagtgattacccagaataggtgtgttccaattggctttcagtgttaaatattaatttgacagtttgtaccagcatatttaacctgttttagatgtttgatgtcctctcacattcacaaaggcatcaaaattggagggaaataaaagtaaatatatactggagatcattggttatcgaaaatttaaaagcacacatgcttgcttggtagtttaggccaattcttctttcttttataaggtggttgaggccagttcttgtccagaataaaagcttatgcacaagtcagaacaccaagcaggcttcccatagaagtagtattttttttatttttttttttggtaagtattattggaataatgcttaccaattaggagtagtattattggaattcaactccattatcatattgcgaagaaagaaaagaaaatgcagtaaaacagaattatctcataacagaaaatcagaaacatattggaaagttcctaaaccgacaacaacagtgacttgtatatttcgctcactgatcttgtttgttgtaagaggggagatgagagaaaaaaggaaaagaatgtaactaaattccttgattaaaggcacaaataatggattaggagcctttttaaggtagattgtatagattttgtaactaaaatatgtttaggtcgggtaaataccaaaacatgaacatttttcgtaacaagattttaaatagtgtataggaatacttaataaataaagtggagatggaggtgaagaagaactcttgggatttttgcgggacagagatatgggtacaaatctgtatataatacattgtgcttgttgtgaatgatggatcctaacttacaaaaaaatgtaattacgagttactactaagggtgtgtttggaataacaaaaaatgttttccgtaaaaaatgtttttcaagaaaatgttttcttcgaaaacaagtagtaattttattcatttttcggtgtttggtacgcaaattaagaaaaataacttttcaagagtattcatatataatttagatataataaacatgaagctagaaactttcaaaccaacaaccttccgaacccatatttttcataaacttttgaatcgctaaatttttgaaatcgcggaatttcgaactcgtaaacttccaaacacataaacccctgaactcataactttggaacttgtaaaattttgaacttttaaaccgataaataaaaaaactaaaactgaaaaatatattaaaaatatatttttttcgggaggggagaggaggggcagggacgggggtgggggtgggggtgcagaaaaatgaaaaaaatagaattttcaaattgcaaaaaaaaaaggtaaaaaaaataattctttttgtcggagggaggatggggatggtgtggagtggggtggaggagtagtagggtgggtggcaacagaaaaactgaaatttgaagaaaaaaaaatcttttttggagagagggggtggtgtagggaaggtgcagaaggagttttggaaaatgttttcccttctcttgataaggaaaatattttcctccgattggaggaaaatgagtttataaaaaaaatattttccaaaacattaaagccaactaaacatggcaaaactgaaaaacattattcaaaaaatattttccttagtaccaaacacaccctaagacatcttaattctatataaaatatcttttaaagctttctaataatggaagtcatagatgaggatcctaggtgagaaagaggaatatttggctcctccttatacctaaaattgtaaaattggattttaatttattattttttatataaatggtaaattgtatatactaatgtgattacgtgataacctctctacgaggggtaaataaatttataatgtatatataggtaaaaattccaacatgaaaatcatattcttactctaaccgagctcccagttccaacatctatataaacaagaaacttcaaatattatacagtcattcttaatattttcaattgaaaaaatcatgcattgtaacaaatattaatagagcttaaattttgtcttaacaattatttaaatattgaaaaaaaattctgacttgacaccagtattgacgtgtttgtactctcacaaaactaggaaatagtgagagacatacaatttggcccttgaaaaagtttaaaacatagagtaggtagcatgcttgcatgcatccatttaaaacttagattattttattccaaaaattttgacactatataaaataatcaaaaataggacaaaaaattgacgtacgagtctaagtaacttaactgctctaaaaatcattcaacttttattataattcttgtgttcaaaaagatgggacatacttaaaattagaatggagctaaaagctagttgtaattgtttatttcttcaattgtggctgtgagtgagctaagaaattaccaaaaggtgagtcacatagtaaactttcttcttcttgtctgttttaaaatattaccaaaagtagaataacacaaccattttctaaaaacaagagtaacacacagcaaagcaaagtgaattactaataacttaatagaaaatatattatttcagcgcatcgcttaaaaaagagtaatcctcatgtgaatccttaaattttttctaacacaacggtaacaagctctaacgcccaacaacaataaaaaaaaactcttatagacacattaaaaagacttaaatccccatgtcatctatcactaaaaaagaaaagacatgaatcagcacaaataaattatatcataatcagacaaaaacattatttattaaaatacctcattttctatattgtttccaacacgtggtggtcccttttcctcgtgaaacagcaattgtgggactgaataaatggatgggttgtgttttcaaatattttagcttttaaattagtattttaattttttttcttaaaattaatttttatcatgtcactaaattttaatgaaaagcacataatccgacaaaaatgaccatttaaatgaactataagttatgtgattattgagaaacaaaaaaattacatgactgtaatggttaattaccaaaaatgagtaaccatcaaggccatccgtcgtacgtcttataagttataagaccacaatcacaaatgaccttctttaagtaattcaacaaaatgcatttcactttattttttgcgccgaataaatatacaaaaggccgaatccgaattattccaagagatgttggaaaatattagtttgtccgcttaatgaagcaataatttggctttgtcaccactacaaacttgtagagaaaaagatatgttaatattttcaggataatacatatagagagagagtcgtacctttctataacagcctcgttagttccgaatatttttgtatgttatagcgaagtgttataatagagaacatatattataaaataacatgaaatttggttccgaaaaacttgatttttatagtgaagtattgttatatggggttgttgttatagagaggtatgactgtatgtatgacttatttgtataaaaaatgatctagaagataaatgtgggcgaaaataatttagtagtcaaataatacttaaaaaaaaccatagcacatacaagcaattgaagtattaaaatggtgaaagggttagttgaggtgcatgtctgatcgttggggacaacttaaagagtccgtttaaatatttcgtcgttttaatactacagggttatatttggccgtttcctaaattaaatggtttaaattttgaaacacttcaatgagtaaaaaacccttgtcagcttgtatgtgctgttgcattgctattacgtcttttctcccaccggactattttcttacgcattaaacaagcaaaattattttattgaagatcttttgaaatgacccggattagaataattcaaggaagttatttactaatcaattatagaactataaagtattatttcatttgtgttgtcttatgcgcatggttgttaggaagaattattatttttaaaaataatgaaaactcgaaaaagtttaatgattcatatgatttgggtcgtcgtagaaaaatattacaactactccatcagtaatatattttatcttatagcctattagtctctttcgtgtaataaaatcacatgtgatgtataaattagctagggtttaaaatataaaataaatatcatccgtacgttttaagatatgttttttttctatatgctaacatactatattcaaattaaatgtcttaataatacttttgccaagtctgttcagacgtccaataccaataattgtgagatatttcttgaaaattaaccacatttcaacaaattaggaatttgtgatgaccttttgtcatcacttgttttaaaagtaaattctgcgttccgatgcctcaaaaatatctttctatctcacatcgatttgtgtgcgcagtctgagcgcgtagccggaaaaccaatatgtgaaaatctgtgaaaatgatgaattttgactttaaaatgaattaagttgacttcgctcaacattttggttaaacggacatagacccgtgattcgacggtcccggagggtccataggaaaatatgggacttgggagtatgcctggaatcaaattccgaggtcccaagcccgataaatgaatttttaaagaaaattattttctggaatatttatgaatttttgaaaatgaaatgtgtttgaaacttgatggtatcgggtacgtactttggttccggcgcccggtgcaggtcttatatgtgatttaagataagtctgtgaaatttggtaataaacggactcgagatgacgtgaatcagatcgtatttgagaaaattggaaaatttgaagtttttaagaaatttcatgattttgatgctaaattcatagttgttgatgttattttagttatttgaatgcacgagcgagtctgtatgatgtttttaggttggtgtgcatgattggtttggagctccgagggctcgggtgagttttgaataggccacaaggtggattttggacttggaaagttgcagacttcagctgttgtattgcaggcctgcaggcttcgcatttgcgaagcctggctcgcaaatgcgaaggctatgtcacaaatgcgaaaatagccccggccagccttcctcgcaattgcaaggaatttatcgcaaatgcgatatttcccccttttggtcagtcgtcgcaaatgcgacgtgtagttcgcaaatacgaacttagcagaagtctgggttcgcaattgcgaaccttggtagcaattgcgacatctgcaacctgcaattttataacttagccgaaaatctttcatttttcacactctttcaaaaccaaaaccctcttgggcgatttttcaaagacaactcttcttccaaatcaattgtaagtcaattttaactcgttttcttcaatcattaacatcttttcacatgatttcaactcagaatcaatgatttttatgggggaaattgggtgttttgggtagaacctaggtttttcaaaaattggggatttagacctcgatttgaggtctgatttcaaaacaaattatatatttgagttcgtgggggaatgggtaatcgggttttggttcgaacctgggttttgaccatgtgggcacgggggcgatttttaactttttaggtaaaactttagaaaaattatttcatgcattagaattgattcatttagcatttattgatgtaattaagtaacttgtgactagatacaagcgaattggtggtggaatcaagaggtaaagcgatactagagacttgaattgtattcgtggcatcgaggaaagtgtttggcctaaccttagcttgagggattaggagtcgagtcctattttctatgtggtttttgttgagtacgacgtataggcatggtgacgagtatctatacgttggtgtcaagcatgaccgtgagtcttatattgtgattattatgacttcgttgtattattcatgctttggtgatgatttatattgttgggcaaagtttgtggaagtaattgtgacatttgaacattgaggagcattggctcaagttgtataatgaaatgtgaaagtataagtggtaattgaaccttttagagcattgactcaagttgtgaggtgagttgtgaagtaatagtgagaaaaagaaaagaattattatgtggcctcccttgccgggatattgttgcttttgatgttatctcccttgccgggatgttgatgtttcttttgatgttgttcccttgtcgggacttgattgttgaactattgttcccttgccaggattcttattgtaatttcatttactcccttgccctattgtttgtgattgttgtttgggtgaggaagagtgttaaagcacgaagggtgatgtcctgtattgtttggtgagagagtgttaaagcacgaagggtgatgccatgtatgatttgtgaggaaagagtgtaaagcacaaagggtgatgtcgtgccgcacgatgtaccattccatgccgattatattgattatacagtaaggacgagagtaaaagcacaaaggatgatgccatgcacattttcattacttgattgctttggtgaggacgagagtaaaagcacgaaggataatgtcgtgcacttattgattcctaattctttgttgatatctgagatatgtcgtttcttttaattacccgttgtcttttattctaaattgatagttctccgcagcatgttacccatctcatactttactatataatattgttcttcttttccactgtatataattaaattacacaggtttatttggtagtctggtcctagcctcataactgcttcgtcgaggttaggttaggcagttaccagcatatagggtcggttgtgatgatactacactctgcactgtgtgcagatcccggagcagcagcttttggaccgtagattgggtggctgccttcagtccacacggagatccaaggtagtcctgtaggagttcgcaggccctggcgtctccctctatccctttgctcctatttcatttacttagttcagaaacagtgtatcttttatctttcagactttgtatatagtattcttagatcgtctgtgaaactgtgacaccagttctgggtggtcgaggctcaaatagttgtattagatacatatttaggatagtttactacatttcttccgcttattgtaattttcgctgtctacacgttattgctttataattgttaaagaatataaattggtaaaaaggtaatttgttcaaacagtcgacttacctttctcacattagtaggcatcatcacaactcccgagggtgggaaatccgggtcgtgacaagttggtatcggagctctaggtaacatgggtctcacagttcaaagacaagcttggtagagtctgagggatcggtagagagacgtctgtatttatcccctagaggctacaaagttagaaaaaacttcacatttattctttcttatcgtgcggtttggtttctcaatgctaattggatttctattgtattctttcgcagatggcaagaacacgggcttcctcatccactaaccaacagctcgagcccccagcagtagctcccacgaggggtagaggttgaggtcgaggaagtgctagaggccaaggtaggggcagagctcagcctagagcagcagcaccagtggcggagcctcaagttgactttgatgatgaggttccggcctcggcaattccggtgggcccaactcaggtcctagaggggtttatggctacccccatactctaggatgctctggtctgtctagtgggctttatggagagtgtcacccgggcaggctttcttcctatagcactaaccgtctctcaggctggaggaaaagcccagactcctggtactcacactccagagcaggtagctccctagtttcaaactccaacagttcagccagttggagcagtttagccgggtgtggtagctctaaccggtgatggagcagctttgtttgccgatgctttgtggaggttagacaggttcaccaagctcttcactactactttcagcggtgcatcttctgaggatccccaggattatctagacaactgtcatgagattctcaggaacatggggatagtggagaccaatggggtcgattttgctatttttcgcttgtctagatcctccaagactttgtggagagattattgcttggctaaaccagtcgaatcaccaactttgacttgtgagcagtttactcaactatttctggagaagtttctccctatcacacaaagagaggcctatcggaggcagtttgagcgtctccagcagggttctatgaccgttactcagtatgagactagattcatcgacttggcttgtcatgctcttatcatacttcccaccgagagagagagggtgaggaggttcatcgatggacttattcagccgattcgacttcagatggccaaggagacatggagtgagattactttctaggaggcggccaatgtggcctggagagttgagatggttttatcgcagggaggtagtcaggggtctaacaagaggcctcgtcatttaggccgattcagtggtacctcgtctggaggtagagattcgtatggtaaaggccatcctcctaggccttttcagtcagcacttcaggtttctcacagtgcttcagttggtcatggttcccatatgcagtattctgatcagcagtcctatagtgcaccaccagctcctatcagtgcaccgtcgctttagagtttttggggtggtcattcaggtcatcagggtcaatagtctcagcagccgagggcttgttacatatttggtattgctaggtttttctctcgagcaccgagtagctctcaacatcagggttcttgtaccatggttcaggtattgagtgttccacagcctgtccagccagttagaggtgggggtagaggtgctagaggaggaggtagaggtattagaggtggagctcaggccactagaggtggagaccagccagcagcaggccatcgtagagatgtagttcagggtggtggggcccagccccgttgttatgctcttccagccaggatcgaggctgaggcttccgatgcagttatcacaggtactgttctagtttatagcagaaatgcttcagttttatttgattcgggatctatatactcctatgtggatcttattttgcaccatatctggtcatgcctagtgattctttgggtgctcctgtttatgtgtctacacctgtgggtgtatctattgtggtagatcgagtccatcgttcatgtatagttgtggttggaggtcttgagactcgtgtagatttgcttcttctggacatggttgatttcgatgtcatattggggatggactggttatcacgctatcttggattgttatgccaagactgtgaccttagtcttgccgggtttacctcgtttagagtggagagggactcttggtcattctatctgcagtgttatctcttatgaaggctcgacgtatggtcgggaatgggtgtttggcctatttggtctaagttcgtgattctagtgttgaggttccttctattgattctgtacccgttgtttatgagtttcctgaggtattcccttcaaacctgccaggtatgctacccgacagggataccgacttttgcattgatttagctctgggcactcagcctatttctatctcgccgtatcgtatagccccgcttgagttgaaagagttgaaggagcagttgcaagacttgcttgagaaaggtttcattagaccgagtgttttgccttggggtgcgccggtgttgtttgttaagaagaaggatggatcaatgaggatatgtattgattaccggcagttgaacaaggttaccatcaagaatacgtatccattgccgaggattgatgatttgtttggtcagcttcagggtgccaaggtattctcaaagattgacttgagatctagcttccatcaattgaggattagggcatctgatgtccctaagacagctttttgcactcagtacggggattatgagttcttggtgatgtcattcgggttgataaatgccctagcaacttttatggatttgatgatccaagtgtttaggccttacttggatttgttcgtgatagtcttcattgatgatattttgatctattcccatagacaggaggagcacgagcagcatcttagaatggttcttcagactttgagggatagtcaattatacgccaagttttcgaagtgtcagttctagttgagttcagtggcattcctgggtcatactgtatcagcggaaggtattcatgttgatctgaagaagattgaggcagtcaagaactggcctagaccagcatcagcaatagagatccagagtttcttgggattagcaggctactatcgttggtttgtggaggggttttcatctatcgcagccccgatgaccaggttgacccaaaagggtgcccagttcaggtggtcaaatgagtgtgaggcgagctttcagaagctcaagacaactctgactacgacaccggtgttggttttttccacaggttcagggccctacacagtttattgtgtgcatctcgtattggacttggtgcggtgttgatataggatggcaaggtcattgcctatgtttcgtggcagttgacgattcatgagaagaattatctggttcatgatttggagttagcagccattgttcacgcattgaagatttggaggcattatttgtatggtgtggcatgtgaggtattcatggatcacaagagtctgcagtatttgttcaagcagaaggagctaaatttgaggcagagaaggtggttagagctactaaaggactatgatatcaccatcttatatcatccgaaaaaggccaatgtggtggccgatgctttgagtaggaagtcagccagtatgggcagtcttgcttatattccagtcggtgagagaccgcttgctttggatgttcaggctttggccaatcagttcatgaggttggatgtttctgagcccagttgtatgttagcttgcacagtcactcgtttttctttattggagcgtatccaagatcggcaatatgatgatccttatttgtgtgtccttagtgacacggtacaacacggaggtgccaagcaggttaccttaggagatgatagagttttgagactgtagggtcgagtttgtgtgcctaatgtggatgggcttcgggagttgattttagaagaggcccatagttcccggtactctattcatccgggcgccgcgaagatgtatcaggatttgcggcagcattattggtggagaaaaatgaagaatgacatcgttgcatatgtcgctcgatgtttgaattgtcagcaggttaagaacgagcatcagagacctggtagtttgttccagaagattgagattcctaagtggaagtgggagcgaatcactatggacttcgttattggactcccatggacttagaggaagttcgatgcagtatgggttattgttgataggctgaccaggtcagcacatttcattcctgtagcagtctcctattcttctgagaggttagctgagatctatatccaggagatagtccgtcttcatggtgtgcccgtgtctatcatttcggaccgaggtacgcagtttacctcccatttctagagagaagttcagtgagagttgggcacacgggttgagttgagcacaacatttcatccttagacggacaggcagtccgagcggaccattcagattttggaggatatgctccgagcttgtgtcattgactttggaggctcgtgggatcagtttttacctttagcagagtttgcatataacaacagctaccagttgagtatccagatagctccttataaggctttgtatggtaggcagtatcgatcgctggttggatggtttgagccatgggaggctcggttgttgggtacggatctagttcaggatgccatggataaggtcaggattattcaggataggcttcgtacagctcagtacaggcaaaagaattatgccgaccataaggttcgtgatttggcattcatggtcggtgagcgggtattgcttcgagtgtctcctatgaagggcgtgatgagatttgggaagaagggcaatcttagccctaggttcattggcccgtttgagattcttgatcgagtgggagaggtggcttacagacttgcgttgccgtcgagtttatcagtcgtgcatccagtgtttcatgtgtccatgcttcggaaatatcacggcgatccatcccacgtgttagatttcagcactatccagttggataaggacttgtcctatgaagaggagccggtagctattttagaccattaggttcgtcagttgagatcgaagagttttccttctgttcgtgtttagtggagaggtcagcctaccgaggatctacctgggagtctgagtctgatatgcggagccgttatcccatcttttccccgactcaggtacttccttcttctgtctgttccaggacgaattgttgttttagaggtggagaataaaaggtcatcacttgtttgaaaagtaaattctgtattccaaagcctcaaaaacctctttatgtctcaccttgatttgcgtgcgcagtccgggcacgtagccggaaagccaatatgtgaaaatctgtgaaaatgatgaattttgactttaatatgacttaagttgacttcggtcaacattttggataaacagacccaaactcgtgatttgacggtcccggagggtccgtaggaaaatatgggaattgggcgtatgctcggaatcgatttccgaggtcccaagcccgagaaatgaatttttaaagaaaattattttctggaatatttatgagtttttgaaacttgatggtaacgggcccgtactttggtttcgtcgcctggtacaggtcttatatgtgatttaagataagtctgtgaaatttggtaataaacggactcgagatgacgtgaatcggatcgtatttgagaaaattagaaattttgaagttcttaagaaatttcatgattttgatgctaaactcatagtttttgatgttattttagtgatttgaatgcacgagcgagtccgtatgatgtttttaggttggtgtgcatgattggtttggagccctgagggctcgggtgagttttggataggccacggggtacattttggacttggaaagttgcagacttcagttgttgcattgcaggcctgtagtctttgcgaagcctggctcgcaaacgcgaaggctatattacaaatgtgaaaatagcccaggctagccttcctcgcaattgtgaggaatttatcgcaaatgcgatgtttcccccttttggtcagtcgtcgcaaatgcgatatgtggttcacaaatgcgactttgcaaatatgaaggtctcctcgcaaatgcgaacttagcagaagtctgggttcgcaattgcgaaccctggtcgcaattgcgacatctgcaacctgcaattttataacttatccgaaaatctttcatttttaacactctttcaaaaccaaaaccctcttgggtgatttttcaaagacaactcttcttacaaatcaattgtaagtcaattttaactcgttttgttcaatcattaacatcttttcacatgatttcaacttagaataaatgattttcatggggaaattgggtgttttgggtagaacctaggtttttcaaaaattggggatttggacctcgatttgaagtctgatttcaaaacaaattatatatttgagttcgtgggggaatgggtaatcgggttttggttcgaacctggtgttttgaccatgtgggcacgagggcgattttgactttttgggtaaaactttagaaaactcattttcatacattagaattgattcatttagcatttattgatgtaattaagtaacttgtggctagatacgagcgaaatggtggtggaatcaagaggtaaagcgatagtagagacttgaattgtgttcgtggcatcgaggtaagtgtttggtctaaccttagcttgagggattaggagtcgagtcctattttctatgtggtatttgtttagtacgacgtataggcatggtgacgagtatgtatacgttggtgtcaagtatgcccatgagtcttatatcgagattattatgactttgttgtattattcatgctttggtgatgatttctattgttgggcaaagtttgtggaagtaattgtgacatttgaacattgaggagcgttggctcaagttgtgtcacgacccaaattccactaagggtcatgatcgcgccgggcaccgctgtcgggcaagacaaccgaaatacttgattaaattctcgttttaatatttttgaaaactataatttccttcaattttactagtaaaagataatcatttagaatcaactatgaatgttaataagttaatacaagacaccctataatcatcccaaaactcggtgtcacaagtgcatgaacatttactagagaatgcaataaaatacagtaactgcccggaatacaagtggacagaaatgaaaaacacagtaaaatactctgaaggggactctgctggccgcgggtcgtctcgataaatgcaactcacctaagtctccgtacaaaccatgccattatgccactaagccactagccacacttgaacctatgcatcaaaaatgcacaacaagtgtagtatgagtacgaaaataatgtgtacccaatgagtatcccatctaatctcaaagaagtagagacgagaggtcaacttcaacacttactagtagtccaatgataatataataaaaaaaattgggtggagatcatggattttataaagcaattataaactcataaagccaaatagcaggtagagaacttctcaataataaaagggtttccaaagatttacttttcattatctttatccatttatctctggccaggaaaggcaagaatcaacattaaaaattcttaggcaacaatataagtatacacatatcacgttgaggtcgtatggcccgatccaacataaatgtaaaatgtgcaatgtcgatggtcaaacggcacgaaccatagatgcatctattaccccactcgcgaatcatacatgtgacgtggtcaacataaataaacaaatacccccgctcgtgaatcatacatgcgacgcgagcacacatagacacacacaatcaagcaaccaattaagaatttatcggggaatgtttatccaaataaaagccaattctcttttaatgatttaagaaaatgaagtttaatccgtttagaaatttatttaccaattcgataggatttaggcaattcaaatgtcaataagattacaaatattccaagtatagcatgcttttgggtcctagactacccggacttacacataatagtagctacgcacagactctcgtcacctcgtacgtacgtagcccccacaaataggagcacataaccaattatatcacctatggggacaattcccttttacaaggttagaaaggagactaaccttgctccgaagatccataactggcattccacgcccttccgaagactcgaatcgatgtacaatactccaaaactagccaataattatgcaaaatccattaatatatgctcaattacccctaatgatctagtttaaggccgatccgggtggaagacattgtcaggtggggagtttggctggggcagcacatctgttaaaagataacgcatgtgtcctaagatgagctcaacgagaacagaaatctcgtgtggaacagaagggtaaaagctcgtttaataatttctaaccccgatcgaaaagttgacaaatgggccattgggcccacgtgcccggattccaaaaatttttgaagattaagtttacccatagcctcacaaactcaaatatataatttactctcaatctcatacccaaaatcgtggtcaaaattaaagaatatcaaatttctaggccttcctcaaaaccccaaatttctacaaatttccttgtcaaaatccatatataaaccttgtatttactcaaaactagtagaaatcacttacctcatgcttggtgatgaaacaatggcactccaaagttgctctaaaatcggctcccatggaaaaatgaagtgaaaatgagccaaaactcagattttaaaaaaacactgcccaggcgacccttcatcgcgaacgcggaacatccctcacgttcgcgaagctcaaaatttcacgcccagaaaattcttctcctagtttgcaacccgctgatcgtgtttgcgaaagccagctgcccagacccatcgcgttcgcattatcctctacgcgttcgtgtaggttaaatggccttgggcgcagctctcccttaccttgttcgtgctcgcatagccttggttgcattcgcgaaggctaaactcagcagccttatctactcctcttcacgaacgtggcactcccttcgtgttcgcgaagaaggaaactagacaccagcaaacatctgttcaaaaacagcccgtaatgctccgaaacaaccccgaaacacacctgaggcccttgggatcccgtctaatcataccaaccagtcctataacataacacggacctgatctaggcctcaaatcacatcaaacaacatcgaaatcatgaatcaccctccaattcaagcttaatgaactttagaatttcaaacttctacatttgatgtcgaatcctatcaattcacgtccgattgacataaaattttgcacacaagtcatattttacattacggacatactccaacttccgaaattggatttcgaccccgataacaaaaagtccacttccggtcaaacttctcaaaaacgttcaaatttctatctttagccaaatgactccaaaatgacctacggacctctgaattcacttccgatcccgctcccaatagcagaatcaccatacggagatattcccagactcagaatcccaaacggacattgataacactgaaattcgcttcaacctaaactcatgaaattcttccaaaatgctaacttccacaataggtgccgaaacgttcccgggtcttccaaaacccggtccgaacatacgcccaagtccgaaatcatcatacgaacctactggaaccttcaaatcccactttcgaggtcgtttgctcaaaaattcaatcttagttaattatttcaacttaaaacttctgaaataagaattctctttccaaatcaactccgaattccccagaattcaattccgaccatgtgtacaagtcataatacttgaagtgaagctgctcatggcctcaaactgttgaacgacatgctagagctcaaaacgactgatcgggtcattacattctctcccacttaaacatacattcgtcctcgaacgtgctaagaactatgttggagttgtccgaaatcactgtttaacacctcgagcacctacccgtgctaccacaactcagctgagcaccctagctcgatcaatctgaagatatcctttttcacttaagcaaataagccatagagcccaattctaatatccggaattttctgtcacgcctgttccaacatactctcaccgtatcaatagctacacgcaacaccaaaacatgactgcataccttagctaaattcacaccttgcaccactttactcacaggaccacaataacattctctgatcaaattagtcgaaattccacaaattttatgctcccattgcacctcatgacatacataggtcttgctctaactcttacaatactgccacgaaggaagagatgtgtagaaattcataaccaactgccgaaccaacaaatcattgggtctatactcctgtcaggaaccatcacctcattctgaaccaaataatggtctttgctccttaatatacttcatataatcagattgaaatgatcctaaatccaatgatcttgtctcacccagtacgaactactcaggtaataagccacaccggacatgatcaaaagtttcatatgatgccacaatgtgccaataggctaccaattcgaacgcgatgcaaaaggaaaacgaactctgaaaaggaaacccaattaccccgctcgcgaatcatacatgcaatgcagtcaacataaataaacaagcaccccactcgcaaatcatacatgcgacgcggacacacagctaatatgagttttcctcagaaaaaataggaaacaaaacacatgaaaacagatatagggaactgtactcaacatcacactgttgcggcgcgcaactcgatccaaacagcatatccatggcagcgtgccacccgatccacatgtaaaattcacataaggagatacataccgagctagattgctcattacaacaaaataccgaatgtcgctcacgagcacgctaagtgcataatactatccctggggagacatatagcgccacaagctacgaactcaagcacaactgaggtgcgatatacgatctaaatctcaagagccatcctgctcatataacatcatcactgtgtggaacctcaacacataagaaattcgccaagccatctcacaactcacatggcgcaatatatcattacatgaaatagctaaagacgaaataacactcccactactctcccataaggagctcattgctgaaatgaacacatcttgcctgatattgagcccatattcacatttaaatccattcacagacctcaagctgattctaatcgcactgaactaggctaataacctttcaaaggtccataataaccctccttttctcataacacacaagaactaccatcataaccagagtaatccttcacagtccacaacccaataaaccgagtgccctccgggcatcaattctcaaattaacgacatcaccgaaatcttcatacttggtttaactcttcaatcaatcaagtgactataccacacttatacaatcttctcgtggggcacgctcccacaatcttccatgacatataacaggtctgcatctccaaacaactggtcgcactaacgctgaaaagcgataaagaatctataaccaggaggtagggcctctttcacaaaacaccgatctctggtgaggctgaagacaatgccatcttactctaaacattcaaatcatctttcctgctcatctgagctcgtgacatccttgtcaataccaaactgcgaccttgatcctcacttcaaattccataccactcactgcacccaacatgccaatatgcgacagaataagattttcatcataacttcggaaccactaatagattaacacttcatcatataaaaacttttcacttaactcactttaggagacccatagcaacacacaggtgaattctcataactgtagaatatacaaatctctaagtagtggtctaagccaccatagcctttccgggatccgcctacacataacaggccaaaacagtagaatacttctgaataacatcaattaccgcggccgacaagcctcgcacgtaccgtcacaaatcacttgcataacttgatcacgctacaggaactaatcactacaccaatatgccaattcaactatggctagcaaatctatcttcgtccaatttatccttgattgcctttgaaataataataacaccattcaacacatagctcactccatccgtactcatcctgagtgaccttgaatcatgagaccatgctgtctcaaattccacgaactatttcatacctcccttgtacgcacatttgcatcctcaactagtacgcccactatgataatctctctacgaatccgaagtcctttctcattcctcccaaatgcagcactgcaagtcaaaatatctagaacattttgggcctcttctcataagctgctacaaagcttgatccttaaccatatctataggctcgaaatcattaggtaccacactttacccctttgaatccaccaggaccgttgttgagagccacccgctctgacttggccccgaatataatcaactccatgaatcttctagcacatgaataccctctcgacgaaacacccagcagaatcactttccttgaaacccacatctatacaaggcataaatcctgaatccgtcccaagtctgaacataagccaataaggccaaccatagcacacctttaacaattcctttgctcaaattaccacttatgttctttttctgtagctgaaataacacattaatatgctaataaccagaaacctcggaagtagttaaccatgcaacccaatcataggtggtgagactctcccacttagcttgaagccaatattacacacctctggaattcaccaggattctttatcttttattgacatgaccgcgcgtaatcaattgccaaaattctcggaatctttctatgaaacctcattcttatactctgaatcatcaacaatatttgcatgaccgatctctttgttgtataatcaatagaaatcttcgcagaagcttcgccaaccatgcgaccaccgatctgctcactggagataacccacctatggaatttacgtgcctgcatcttccaacgctgctgcatggggtacaatcactatgacatcaataacccatcccgagtctgagctcactctctagctgcacaagtccattcacccttgttgacatcaattaaatgtgcggcaacatccttccaattcaaagttatgttgtattcttcttcatttcaagaagctcctttccgttatatcaaatctccttccgcataatagcctatacttcaaattaaatctgtagacaccaatcaccaatcactaaattcccaaatcattccaaactctccttaatgtgcgtagtcatcctaccacaaagcccatatgcaactccgccactctcccactttggtggaactcaccccctttaatcaactactcaacctttgcctcttatacttggccttctcgaaattttaaccatcgcctgacactccctacatgtctttcctcatcctttgctgctcagttgttgccttaaataaaatctaccttcgtagcgcttgaacccacgaaccactactaactttaaatctccccgaggtcatctttcttagaccatcaatactagatatactgattcaatcctgaaacaccgcacatcgcgatctctgacagtcgcctctccattattatttcacaatatcctgccccaaaggcgaattgaagaaaaccataacaccggagagctcaacatattcaatcaaggacgacaataccacgtcacagatgaaaattccaccacgcttgaaaataccaagtctcattactccatcaagccaaacttgaacatctatagcctgattgcctcacttccgcccggaaataaaattctgaagctctgaatcttgcattcagtaaacatccttccaagtcattcactgcttcaacacatagacaaacactctaccattacaccaatattgtgcgataacaacgcacgaatcgtcataacaattaattccaaatctcaaaaccttaggtaatattgaaattgagctgaaacgatagaacgaccttccacaaggcgacgacaatagcccgatcaaatacgcaggggggaacatcccgcaccacatctgtagtaccattacattttctcaattcccaatttataataagtgcttcacgtcgcataagattgagtaagaaataaacaaaggaataagcctcaaggaatcaaatcacacgatgaggaagcaagaagggaggtgctcataacagtcctgtagcctctcgaagataagtacggacgtctccgtaccaatccgcgagactctactagacttgctcatgaatcgtgagacctaagggaacctagtgctcagataccatgttgtcacaacccaaattccactaaaggtcatgatggagccggacaccggtgtcgagcaagccaaccgaaatacttgattaaattctcgttttaataattttgaaaactataattttccttcaattttactagtaaaagataatcatttcgaatcaaatatgaatgttaagaagttaatacaagacaccccataatcatcacagaactcggtgtcacaagtgcatgagtatttactagagaattcaataaaatacagtaattgtctggaatacaagtggacagaaatgaaaaacacagtaaaatactctgaaggggactctactggcagcgggtcgtctcgataaatgcagctcacctaagtctctgtaccaaccatgccattatgccactaagccactagccacacttgaacctgtgcaacaaaaatgcacagcaagtgtagtatgagtacgaacacaacgtgtacccaatgagtatcccgtctaatcttgaagaagtagagacgagagatcgacttcgacacttactagtggtccaatgataatatagtaaaaacaattgggtggagatcatggattttataaagcaattataaactcataaagccagatagcaggtagacaatttctcaataataaaagggtttccaaagatttacttttcattatctttatccatttatctctggccaggaaaggcaagtatcaacattaaaaattctcaggcaaacaatataagcatgcacatatcatgccgagttcgtacggcccgatccaacataaatgtaaaatgtgcactgccgaaagttgaacggcgcgaaccatagatgcatctattacccctctcgtgaatcatacatgcgacgctgtcaacataaataaacaaatactccgctcgcgaatcatacatgtgatgcgggcacacatagatacacacagtcaagcagccaattaagaatttatcgggaaatatttatccaaataaaagccaattctcttttaatgatttaagaaaataaagtttaatccttttagaaattcatttaccaattcgataggatttaagcaattcaaatgtcaataagattacaaatattccaagtatagcatgcttttggatcctagactacccggacttacgcataatagtagctacgcagggactctcatcacctcatgtgtacttagcccccacaaataggagcacataaccaattatatcacccatggggaaacttccctcttacaaggttagaaaggagactcacctcgctccgaagatctataaccggcattccacgcccttccgaagactcgaatcgatgtacaatgctccaaatctagccaataattatgcaaaatccattaatatatgctcaattacccctaatgatctagtttataataatttctaacctcgatcgaaaagttgacaaatgcgccctccggcccacatgcccggattccaaaatatttcgaagattaagtttacccatagcctcacaaacacaaatatataatttactctcaatcccatacccaaaatcatggtcaaaattcaagaatatcaaatttctaggtcttcctcaaaccccaaatttcaacaaatttccttgtctaaatccatatataaaccttatatttactgaaaactagtagaaatcacttacctcatgcttggtgatgaaaatgacactccaaagttgctccaaaatcggctcccatggaaaaatgagtgaaaataagccaatactccgattttaaaagaacactgccaaggcgacccttcatcgcgaacgcggaacatctctcgcgttcgcgaagctcaaaatttcacgcccaaaaaatccttctccgcgtttgcaacccgctgatcgcgttcgcgaaagcgagctgcccagacccaacgcgttcgtgttatcctctacgcgttcgggtaggcgaaatggccttgggcccagctctcccttaccttattcgcgttcgcgtagccttggtcgtgtttgcgaaggctaaactcagcagccccatctactcctcttcgcgaacatggtattcccttcgcgtccgcgaaaaaggaaaccatacactagcaaacagcagtcccaaaacaactcgaaatgctctgaaaccatcccgaaacacacccgaggcccttgagaccctgtctaatcacaccaaccagtcctataacaaaatatggacctgttcgaggcctcaaatcacatcaaacaacatcgaaatcatgaatcaacctccaattcaagcttaatgaactttagaatttcaaacttctatattcgatgtcgaaacctattaattcacgtctgattgacctcaaattttgcacacaagtcatatttgacattacggacgtactctagctttcagaattggattccaaccccggtatcaaaaagtccacttccggtcaaacttctcaaaaaccttcaaatttctatctttagccaaatgactccaaaatgacctacggacctccgaattcactttcgaatacgcacccaataccacaatcaccatacggagatattcccagactcggaatcctaaacggacattgataacactgaaatgcacgtcaacccaaattcatgaaattcttccaaaatgctaatttccacaataggtgctgaaacgttcctgagtcttctaaaacccggtccgaacatacgcccaagtccaaaatcttcatacgaacccgctggaacctgcgaatcccacttctgaggtcgtttgctcaaaaatccaatcttagttaattcattcaacttaaagcttccgaaatgagaattctctttccaaatcaactccgaattccccggaattcaattccgaccatgcgcacaaatcataatacctgaagtgaagttgctcatggcctcaaactgttgaacgaagcgatagatctcaaaacaattggttaggtcattacaagttgtataatgaaatatgaaagtataagtggtaattgaaccttttagagcattggctcaaattgtgaagtaacagtgagaaaaagaagagaattattatgtggcctcccttgctgggatattgttgcttttgatgttatctcccttgccgggattgtcacacctcctttttccgccttgcgaggggtgaaggagttttttccaattaaaggacaatcgaaacgggatttgtttatttatttcagagtcgccactggagagatttatggtgtcccaagtcaacggttgaatcccgaatcgaggaaagaatgactctgtttaacagtccgcgaatcagaaatccggataaggaattctgttaacccgagagaaggtgttaggcattcccggattccgtggttctagcacggtcgctcaactattatatttggcttaattatctgatttttttttaacaattaaggacttatatgcaaatttaactttgacccgcttttataattattgttattattattattttatacaataattgcaacgttgggaaaacgtatctcgaatcacgtcacaaccagtgtacacgtgatttgttgacgcattttgactccgccaagattgggatttgggctacataaatgcacacccatatttaagaaaatacctttattaaatacaaaactaaagactacggttatactttgtattgtttatatttgtttatttttttttagcgaaatcttcccttattttatgaatatcttaaaatgactacatttttcattattaagtttgtctataaatataaaatcaatctttacatacttaaaaataacatattaaatatcagtttaaaacaaatattagcggaaaggaatattactaaaattgtaattataaatacaatatggaattgtcaaataattttttttttaaaaaaaactaattatcccataaccggattaaaatcatattgttagatgacttgagctattgaaattaattatttacactactgaaaattagaaacaatcttgattactaatgcgtatttctaaaatttaattaatttaaccttaactaacctcgttttaattcaaatcatgtcctaatacttgattcgcaaaattaatttaaactcatgttttaactaaatttagctacatgattttgattaacttaatgttggtgatactaaaacccttatgaatagtgaacttaattaattttgccaaacagatttaataaagtcatttttacgttattttcttctcattctaattattagacagtttaatcagtaatgaacatgcttaaatatatactatctaataatcagattaaagcaaagcattatttaatacatcgctacaatatgtctagttatgcaaaacgacggtgatttacagaatagtaatacatgaaataacctaaatacaaaaaaaaaagctaaattagaaatttaaaatctcattcttcatttcagcttacaaaatgccaagattacagttgtgtacctggtattgccaatataagaagaagaaagtcagcaacgtagtacgtaacacaacaatagcaataataaccagcaatccagtcaacagaaaatcccagtgacagatttgaaaatcaagataaaaatccagaaacaccgacaacaaacaacggacagaagccaagggaatcttttcagatttgaaagactaattaatatttaacccttaatttctgaacacgtatatcataatatttatcaggtgtatactactctctcttttaatttccagcccttttttattttgtatattttttttcttttttgaaagtcttaatatttttcggaatttttctttctctctcttcaatcttcagccctctttttttctctgtctccttctttataatctgatcaagtccccctatttatccccatctttcagcattttttaaatataaaactcactatcttcccattcatcccccttttaatcccactgcttaatgtattgtctcctactacattaaacaaataccccattatatcatgtcctccatgcttatattaaacaattgtattattcccaccattatatcttgtccccccattattgattattttaatattattttaatcctaattaacagagcactcaaaataaataattgttcagaattttaattccaaaaatacccctctgaccttactgaaattaacattttacccctgaacgtactgcaaattaccaaactacccgcatcagttataaccaattcacctaatcaatttcaaccaaaatacagcaaatatgactaatttctaaacaattttcaacaacaaattcaaactaaatgatgaacaaccaagaaacaactaaaattattttgattgaacaatattttttaacaacaaacaaacctactttcagattcaacaacaacaacaacaaacaagtatattcagatttctatattcaataattatttgaacttaaaattaaatctaacaacattacaaccaacaatttctatattaaactaaacaagatcatgaaacaaactgaagaaataatcataaatgataaacaacaaacaagaaaatcaaacttatgctaatttcggattcaagaacaatcaaacaaagtatggacataaatgaaaagattcaacaacaataacaaacaagttttattcaaattcgaattaaactcgaattaagcttaaacaaaacaaataaacatattcaaatcactaaacttcaaataatcaattgatctttttaaattaaatccaacaaaattataacaaagatacattgaatcaaaaaattaaaaaccaaaacataacttcacattaaatcactgaattaaaaacgaacttcaaacaaaataaacacgaattaaatctatattaaacaacaaacatgacagattcaaatgatttaaactaacacttttctatattaaaactaaatccttttaaattaataaaacaaactgaagaaataattaattgaacttcaacttaaatctaaaaacattataattaaactaacaatttctatctaaaaataaataagaaaaatgaaacaactgaataaaaatcaagaacaagaatcaaacatttaatgatttcagattcaaaaaatatcaaacaaattacggacaaaatgaaactcaaaccaactaaccggatcggaacgacgaagaacttgaatgaaaacaaatccgtccggaatcgattatcgcaccaaaacaattcgacgccgaagacgacccagaacggaccatcgaagaacttgaagaaggaagcagcggacagtagcagcagtgaaggatgaagaagacgcagcagcaactcgtcgaggcagcagtagcgacgaagaagaagacgcaacgcaggagctcgtcgaggcagctgggctgtcatggtggacgttcaaccatgaacgctcgagctgggttgttggtggatggagatggacatgggcgtgaaggaaaagaagtgaagaagaagaaggtgaagcagcaagtatggctatggagctcgagggtgcgatgaaaaaaaagaagaggcagcagccattaaagctctaactcgagctcgaagaaaatggcaacgacgaactcgacggggcagccatgggcgaaaagaagtgttgtcggatgatggtggagcttgacatggctgtgtagctatgcgaagaagaagaagcagccatggttgtgtgtgtgtgtgtgtggtcgtgagggggaagaagaaggtgaaggtaaggggaggtggcggatggtattttcaacagtgaaaattttttagggttttgtttttgaaatgaaagatagggaaatggggtgttgggtctttggggttatggactgggtcgacccggtttggaatggaccaggtcgtagaggaaggttgggtatatttgggtctgtggttcaaaattgaagaaaatgcctaattccgattttcttttatattttttgctctcttttcttttacttcctaattaataaaactaaaattctaaattaacttataaactaaattaacttataaaaaatactaattaatttcaaataactattatcgcacatttaaatagcaattaacgataaaattgcacaatttagacgttaaatgctaaaaatgcaacgtacattattttttatgattttctcatttttgtaaaacaaacttaaataaatactaaatgaaaatgcgacatattttatatttttattaatttaaagaaataaacatgcacagacaaaaatacaaataattatataaaaataccacaaaaatacaaacattgcacacaaaggaaaattgttttattttgaatttttgggagtgattctcatatagggcgaaaatcacgttctcacagcggcccctctttgtccgaaaacacgaagggttttcgtgcaaagataaagtgagcggatacgagtgatttttgcccgttcgagtactccgtgtgtagcattttttgaaagatttgaccgaacctttgcttcagaggtttcctacatatcctgggctaaacaggaatcgggtcaatgtagttcgggaagttttggtagctgggactaccatgggactgcaatgttactgctgctacatgatgttgctactgcttttcgatctccttattacaccgtgccaaaagaaaataagaagctagactaagctaggaattacaaaatcttatctgtcttccccttgctctggttgccttgctttcttgttggcttgtgtttcctctggtgcctttctttcgaaaactgctggggatgacactggccttttgccttttttaacataagttttattattccgttctgtctgctggggacactgcttcctacattaaagcttgttatgctggggatctttgttgtactccccctcattactgacttctgtttgatcttgaaatgtactcctctgttctgcaggcgggctcctgacttcaacaacttcctcaaaattttaacacctccattctccaggcgggttccttacttcttcaacttaaaatataacgacctctgttctacaggcgggctcctaacttcaataacttcttaaattttaacaccttcattctccaggcgggctcctgacttcttcaacttcttaatttttaacacctccattctccaggcgggctcctgtcttcaacaacaacttaaaataatttagcctccattctccaggcgggctcctaacttctccaaatttcaaaataattcagcctccattctccaggcgggctcctgacttcaacaactttctcaaaataattcagcctccattcttcaggcgggatcctgacttcaacaacttaaaaatataacgacctccgttctataggcgggctcctgacttcaataatttcttaaattttaacacctacattctccatgagggctcctgacttcttcaacttcttaaattttaacacctccattctccaggcgggctcctgtcttcaacaacaacttaaaataatttagcctccattctccaggagggctcctgacttctccaactttcaaaataattcagcctccattctccaggcgggctcctgacttcaccagctttctcaaaataattcagccttcattcttcaggcgggctcctgatttcaacaactttctcaaaataattcagcctccattctccaggcgggctcctgacttctccaactttcaaaataattcagcctccattctctaggcgggctcctgacttcaacaactttctcaaaataattcagcctccattctccaggcgggctcctgacttcaacaactgcttccttcaaaactggtgttttattcctctgaaaattgttggggataacaccgatattttatttcaccaatatgtcatgttccttcttcaaagactatttcctttaaagctggtgctttcgcttccctgaaacctgccgggaataacactgctggggaattatcttcctccttttaacaatggtgggaatgatattgattccaaggccattgcttttacaactttgggttatcatgcttcttccaagattgcttttcttttaaaacttgtacctcccttcttgtatactgctggggattttattttctttaaaatttgtgttatcttctctctttcccaaatggctatctgattttaagaaaattttcgtaattagagaaaattttctgccccagtttaataatcctctttgtgaccctgtcttcctgtggtcaataatatttcctttccctgctttaaatcaaagaaatatttgttagtttaaaacgtggtgagtgatcgtgccacttctgctggagatggtttttccctttttattttccctgcttttctacaaaacttgttggggatgatattcctactggggatggttttttcttttctcttccttccccgctctgtgttgtccgtctattgtggaacctggtcgagaatttgttgcagttgttcctgtatcttgtaaatctattggggatcctcttggaatttgatccataacttcccttggaaatttgggcctcttaggatctagacccattcatcatttggtcttgcgacaaacttcttttcgctttgtcgccttatctttggcttgtccttttcgcattttgccttgcaccattttggcaactggtagtaagctctgaaaatccttttcaaaaataaactgttggggaaataaaatcttttaaaccaagaaatgaaagagtgataattttaaagatagaaaaagaagtctttctgaacaaaccctggggaaaaagaaaagaaaagaacttatctgaatgatataaccaatcccaacgatcatgtcgtgcattccggattgatcaacccagtctatttgtatcaatccatctttcggatggcctcatctcgctggggataaataaatactcaacttttgccaaatgtggaccttttccgccaatctcgccttgtcgcctcatagtgcccttcgaggggttttcactaataagactctctcattttattttatttttcagctggggattggagcgttgtcgatatgacgctctttgttggggattatttcgactatcaattcatttccagtttatgatcctcttctctgctggggatcagagtgttgttccccacttccatgtgcatgaacttggcacttctcggttactgatcgggaggtcttttttggacatcaatatggtttttttgtgtatggctaaaaggaaaaggggtatcaaaagtttaaaataatttggaggggtaaaacagtacaactcttggaatcaaacttttttttcaccacttctgccccagttcttcttacttggggatttttattttttggttacactatgaccgagccgtgaggcgcctacgtatccttctttgaggaatcaggtcaaatgtagttcccacttcctttgtttttcttatgatttttcttttgtctttattattgtttttctcttttttttctttttttttttattaactccaaaagagggatatgaaagaataaataaggctcaaaagggtaagcaaaggttaaagtgtttggatagaagaaagaattgcctccgtcatttcattctccgataaatgccaaccacaaacaaatgacaattacaaccaaaagagatcatacataatatctcttaactgcgtcggaattgatagccatgtcgacacatttcccttcgatatctgttaaacataaagaaccatcggacaacactctggtaacaatgaatggtccttgccaatttggggcgaacttgccctttgcttctgcttagtgtggcaggattcgtttcaatacttgttgccccacttcaaattttctggggcgcaccctcttgttgtaggctctttccattctcctttgatataactgtccatgacacacagctgccaatctcttttcatcaatcaagctcaactgctccaaacgggttctgacccattcgccatcatcaatctcagcctcagcgacaatccgaagggatggaatttcaatttccgtcggtattactgcttcagttccatataccaacaaataaggggttgcacctactgaagtctggacggtagtgcgataacccaacaacgcaaatggtaatttgtcatgccattgcctggatccttctaccatcttcctcagtatcttcttgatgttcttgttggctgcttcaacaaatccattctccttgggacaatatggtgtggagttacggtgtacaatcttaaactgttcacatacttctctcatcaaattgtggttaagattagcaccattgtccgtgattatcactttcgggatcccaaatctacaaatgatatgggaatggacaaaatccaccactgccttctttgttactgacttgaaagttttggcttcaacccacttagtgaaataatcaatggttaccagaatgaacctgtgaccgttcgaagtcgtcggctcaataggcccaatgacatccatgccccatgccacagatggccatggtgctgatattgtgtgcaattccgttggtggagaatgactcagatctccatgtatctgacactgatggcattttcatacgaaactgatacaatcatgctccatagtgagccaataatatcctgctcgaagaatcttcttcgctaatacatatccgctcatatgtggcccacaaactccagcatgtacctctgtcataactgtcgtggcttgactggcatctatacatctcagcaatcccaaatctggggttcttttgtataacactcctccactgaggaagaaaccatttgacaatcgccgaatggctcttttctgatctccggtgacctgctccgggtgtatccccatcctgaggtactctttgacgtcataaaaccatggctcaccatccacctcttcctctatcatgttgcaataggcatgctgatcacgaacctggatgtgcaacgggtcaacatgaattttgtctaggtggtgaaacattgatgctaaagtggccaatgtatcggcaacctcattgtgaactcttgggatgtgtctgaactccactgatcgaaatcgcttgctcagatcgtgcaaacattgtcgatatggtatgagcttcaaatctcatatttcccattcactttgaatttgatgcaccaggaggtctgagtcccccaagaccaagacgtcctggacatccatgtctgcagctaatcgcaaacccaaaatgcatgcttcatactcagccatgttgttggtacaatagaaacgcagttgagctgtaacaggataatgacgtcctgtttcagaaataagcactgctcctattccaactcccttcgcattttcggctccatcaaagaaaagcttccaaccgggttcctcaggtaactccaactcatctatatgcattacttcctcgtcaggaaaatacgtcctcaacggctcatattcttcatcaacaggattctcagccaagtgatctgccaacacttgggccttcatggctgtcctcgtcacatagacgatgtcaaactccgtgagtaatatttgccattttgctaaccttcctgtgggcataggtttttggaaaatatactttaatggatccaaacgggaaatgagataggtagtatatgaggataaataatgtttcaatttttgggccacccaggttagggcgcaacatgtcttctcgagttgagtgtacttaacctcatatactgtaaacctcttgctgagataatagatggcttgctcttttcttcctgtaatgtcgtgttcccccaacatgcagccaaacgaattctccaagaccgttagataaagaattaacgatcttcccggctcatggggaaaccaatacaggtggatttgataaatattctttgatctgttcgaatgcctcctggcattccgccgtccatcctaccgcggcatccttcttcaacagtcgaaaaatgggttcacaggttgctgtgagttgagcaataaatctgctgatgtaattcaaccttcccaacagactcattacttctgtcttgttcttcggcggtggcaaatcttggatagatttgatctttgacggatctagttcaatacctcaccgactgacgatgaatcccaaaagcttcccagatgtaacaccaaatgcacatttggccgggttgagcttaatatcataccttcgaagtctttgaaagaacttccttaggtctgctacgtggtcttcctgatgcttggactttatgatcacatcttctacgtatacctcaatttctttgtggataatgtcatgaaacacagtggtcattgctctcatgtacgtcgccccagcattctttaaaccaaatggcattacctggtagcaataagttccccacggcgtaatgaaggctgtcttttctgcatcttcctcatccatcagaatctgatgatacccagcatagcaatccacaaaagatccgatctcacatccggcacaattgtcgatcaagatatggatgttgggtaaaggaaagttgtctttagggcttgtcgacacacacccttatctttccatctttctttggtaccagcaccatattagccaaccaatcaggatatcgagtgacatgaataacctttgcttgcagctgcttggttacttcttatttaatcttcacactcatatccgttttgaacttcctcaatttttgcttgacgggagggcatgccgggtcagtgggcaatttatgaaccactaaatctgtgcttaaccccggcatgtcatcatacgaccatgcaaaaatatctttgaactcaataagtgttttgatcaattcctccctgatatttggtgcaatgtggatgcttattttagtttctctgatatcgccgacatcccctaaattgatggtttctgtgtcatttaagttgggtttgtatttttcttcaaactagcttaactccctgtttatctctttgaatgcttcatcctcatcgtatttcgattcattatcataatcgacctcttgtatggttagctcggaatcagattgatcttttagactaggttgaagatccgttgtgcatgccatgtcattagaaccagtatgaaaagaacttttcagaaaaagaaacgaaagaaacaaaattaaaaataataacttataaaataaaaaataaaaaataaaaataaagaagaaacttttcattttattgaattatgggataacaaggtttcacactatattgaacacaataagaaggaatctggattacaaccctggaataatccagaaaacaaacaaggaaaatcagagccaactaccaggactccctccaagtaggaagaggagtagctatctaattgttgaccttgaccttaggacccacaaactgtatgtctgccttactggaaccctctccagcttctatcatgttgatatcggtgccacacctcctttttctgttacaatcggcaaacactctttcaaagctttcattcaaatctccatctggccccatcagaggtccaagaactttcgggaccgacaactttctgaaccctgctttgacaaatgatctggacaggcatgggactggcttagaaaggacccagactcttttcttcaatttgcgggcccatttcacatccgctgctataggcttgaatcctaacccaaacgtttccaggttcttgggcaaagaaactagctggatcattccctgcagatcaacccccagaccttttcctggtacaaacccattattcaacatttctgatgctatcatgaaggttgcagctgtgattctgggaagtggaaggcccccgtcctcaggaattttgtctactgagactgcgtcgaaaatctgataaacccatgggcccttatcatcgtcggtttctatgaagggcacaatagcatcgctgacggcatgtgtgccgtcatccccgtgtaccacaatctcttgtctatcccattcaaacttgaccatttaatgcagtgtagaaggcactgctttggctgcatggatccagggtcatcccaacaaaagaatgtataacaccgccacatctattacttgaaattccatggtgaactcgaccggaccaatggttaattccagtacgatatcacccactgtgtcagtgatgcccccatcaaaacctcggacgcagacactgttcttgtggatcctatcatccacaacctttagtttgttcagagtggccaaagggcagatattggcacttgacccattatcaattagtgctcgagtgaccaccgattcttcgcattttaccgtaagatagagtgctctgttgtgttcagtaccctctatagataactcatcgtcagagaatgtcactcggtttacttcaaagatcttgtgcgctactttctccaaatggttcactgagagcttgtccgggacataggcctcgttcagaatcttcattaaggcctgacaatgatcatttgaatggattaacaaggatagcaacgaaatctaggctagggtctttctcaattgctctataattgagtaatcctgtgccttcatcttcttcaaaaattcctctgcttcttcgtctgttactagtttctttattgtttcaggattgacccttctcaactctgcgggagcaaaacaccttccctatcgagttaacccctgtgcctcgcatacgtcttccacaacctccttccccttatgcgtcactgtcacttgactgtagctccacggcacagctttctcacttgttatcggcaactgtataaccggcttgataacaactggttccacatggaccccttttactaccaacattggtttgtttgctactccttgcaacactgctctgactgactctggcttcttcgcagcaacagacgatcctttccctgctaccacaaatggcttgtcatatacctttcccgactgtaccactgcctttccactggttgactcttcattaaaactggcgcgaatcatcattaccatttgtgagggtgtttttggtttccctccttcgtgcactagttcgatcatgtgggcttcatggtgcaccggtaacggatttttattgatgttgggtgcctcaggtgcctgaacctcgatcctatttgtgtcaataagatcttgtatggcagtcttcaacttccaacatttctcagtatcatgctcgggagcacccgaacaatattcgcagcttactgaatggtccagatttctgggaaggggatttggtaatttggtttcaacaggacttagtaggcctatttgcttcaacttgtgaaacagagtagtataggtttctcccaacggagtgaatgctcttggcttctgcatcctttcgttcctgaaagcctgatttccgcggaagcttggccctgaaggattcttgtaggccctcggtggtggatatgtgttttgtggaggtggatatatgttttgtggaggtggatatgtgttttgtggaggtagatatgtatgttggggagccggttcacgccattgcggacgagccggaggctgggtgtaagtttgggcgtgatggacggaaaaatgttgttcttgtggtggatagtagggttgtggagggtaatttggaatgtgtgagtagtttagatgatggggtttgggttggtaatgagggtaaggacctctagatctggaccaattgtctgcctctattgtcgtgacctcttctctccttttctttccgagcgcacctcccgtgccgctctgaatggcctaagttgttgccttaattgccgagtaacttatgatcttattggacttaagtccctcttctatcatacctcccattttcaccacttcattgaaggatttgccaactgacgtcaccaagtgaccgaagtaagtcggctctagagtttgtagaaagtaatctaccatttctccctatctcattggaggatcaactctagctgccttttctctccatcggaatccaaattcccggaagctctatccgggtttcttttcaagttttagcaatgtgagacggtctgggactatctcaaggttgtattggaagtgtcctgcgaaagcctatgccagatcatcccaggtgtaccacctgctcggatcttgtcttgtataccactctagtgccgacccgctcaaactctggccaaagtaagctatcagtagctcatctttgccccccgctcccctcattttgctacaaaatccccgtagatgtgccataggatcgccatgcccttcatataaatcgaatttgggcatcttgaaccctgctggtaattggacgtcaggtaaagggcatagatccttgtaagccacgctgacctggttgcctaacccgtgcatgttcctgaaggactgctccaggcttttaaatttccgcatcacctcgtcctgctctgggctcttagacggcttttcaatctccgtcgggacctcaaagtggggattataggtatgtggctcgggtgctttgaatgtgagttcaggggggtaatattgtgtatcgtgagcctaaaacaaaggctcgctagacaatctatgcaatggggctggggcaggcgccacaaagacgggaacatttggtggaggaggattctgattgggtggtagagcttggggatcataggcctctcttccctgatagtagtgatggcttgggaaactcgttgaaggaccgggagaggggtattctgacgtgtgtcctggttggagagtaggagtaacaggtagttcctgccccttttgggctctagctaaggctatctgcatttcattcatttccagcctcatcttttccattttttccatggcttccttcagcatctgatttgtcgtcttttccgaatcaacaccattgtctgaaccagtcatgctttctggtatgggcccttttgatcttgtttgataatggtacggtgccagtacgctttaacaaactaattggtattgattggaaaaacaacaaacttgccagtgttagagttagagtcttaacagatattgtatttgcacgttggggggatgcaatgttcttaggcagttaatcatttctaacatgcttttgctccgaccgcatgcatcatcccggcttattttatttgtgcctttttcgagtgtttcagggacctttctttttttcttctctctctctttttcctttttttaattaccgtcgaatcctatagagagtgcctacgtatcgtgactccgcatgaatcagaccaagcgtagttcgtgcatccgtaaaataaagacccaattttacattttattacccaaatttgctcttacaaactgttatttgaaagaaaacaaacaaaatacagattccacactattaataatgtttgaagagaacataggggtagacaacagactctaaaaaaacaaacaagtgcagacttgaactagggatacattaaagccttgaattttggttcccgcgaggcatcgttcggcctttccgcgggctttggtgtaagatccctttgtaagcttttcaactcatccatgatccggtggacgtagcccatgatggaggcaagaagggtatcccgaggtatttgctcacatgctaggcatctcatgtagatgtagtgcccaatctcatcaatcctacctcggatgttatccctttcccctaacagttgctctattcgtcggttctttagtcccagtacttgagcattgtcggcgagtcgatcctgaaacctctccatttgttcttccattctgtccatcacatcataacaatgccttctgtctgcttgggcatctcggatttgtttaaagatcctctactgaagagtggagtttgtttctcttaatagtccaatgcttatttcagaatcccttatgacttgttgtagatgttttctccgtgtcattgtaccttttgcccatctgaaccgcattctcgctatgcaagcctcggatctctccaaatcctctcggcttttgctgacctgtctcctcaactctactatcaacctctcattggaccgacttttctgttggtcaccggtattctttctgtcttggcggattcgggctctcagggccttattctcttgaatcaacttgcttttctctcctgtatcagcatcaatttgcaagctgctttggtattttagcccctcaattgttgttttaacttgccaatctcgacccgatattccttctcttttgctagccaaccccattgtgctcgcgatgattctacaaagtcttggacgtgagctcttttagttggtctctggtgctcaagctctcttctgtaccatgtgaggtattttggcgacacttcgcctttggcccggtcttgtacacgagtatctactttcagggtttgacattcattccagattctccgaatgactgcttcagggaactgcccaccaggcccgatttcgactacctggccactgagatcctcttcctttgggactatttggtatcgccccaactgtctcaacactctgtatagtgcgtagggctggatactttggagacccatcaacaacaaatgagattcggcggctgacatgtttatgatttcatctatgggtagccacctcaatgcccattctatctggtttgctgagatggaacgcaacagagtgacccattcggcgaccccttctggcaggctaaacccgttgacccttgtggaaaactcttctatacaagtcttttgtgactcctcatattttagaaactgagggcgatgacataggtgttctatcatccacatttacagtagtacattgcaaccctcaaagaaacctcctccggttttgcaaacagtgagagcgcgaaagatgtctgctattatcattggtgccagagtgctgttgttttgcttgagcaaagtgctgacgaccccagcgacttgtatgttaattttcgcgtcttttctcgggaataccagaaggcccagaaaggctaccatgaaagcaatacacctatgtctttcccatttcagctggttttccccgctgcagatctttccctcgggattgttgaaccctccaaaatgaccgtatctgtcgtacaggaatgccaaactacaaaaaccttcagataattctgggttgtgtataactctgcagatcttcacagtgtctaaaaatctgtgtatggtcacggtccttggtgcaataagatactgctctctcatagggactttgggactcccgatgtaccctgccagttcttccagtgtcggtgtgagctcaaagtctgagaaatgaaatacattgtgtgttgggtcccagaatgaaattagcgcccttataatgtcccctctcggaacaatgtccagtaacccaactaagtttcctaagtacatcttgactgtatctcgccctgattcttctaagtcgttccaccacatgcgtaagtccaaagggatcccatttacaatggcctcagatgaattcctaatcgtgctcattctgcacatttattaaggggatttagacaaaaagcaaaatctttatttgactcataaactaattttcctatttttttcctaatttttttaggaaaagaaaaactgattcttcaaatacggccttttgactcttcagggatgaagattttaaggctgtagggatttaaccagccgaaaggtaaaagaatgaccaaaggtgcttatgcaaagtcagccttccagcgcccctttagggaatgttcggctatttttgcaacatggcatcgcctgactcttttataaaagtggcaacattttgtcattttttcttttctggttgtttttgcaaaatggaaagttggacccgatgagggttgtctacgtatctcacaccctgtgagaatcaaaccggcgtagttcgggtgatcatgaataaagtaaatagactaactttttttttcattattattatttattattttatttttttgaaagaaaaacttataaagaagaaaaagagaatttttgcaaagaaggatttctaaagaaaaaaaaattgaattttgaaagaaaaacttctaaagaagaaagaaaatattttatttttttttggaattttacttttaatttatgaaagaaatgcttccaaaaattatttttttgaattttgaattttcttttcaattttttgaaagaagaataaaaatatatatcttttatttgattttttttggaagaaattaaaagaaaatatttttattttattttttatatttaaaaaaaacaattaaaaagactttctaaagaaatcaatagtggaaaatatttttgtatttttttttgaaaattgggggcttaaaaaaaacttttctagaaaggaaataaagaaaaatattttttggatttatatatatatatatatatatatatatatatatatatatatatatatatatatatatatttgcaacaaataataaaaccacattcaccgcccgactctttttatttttattttttggcatttttgtagacaaataaataaataaaaaaatattttaaaaacaagactttttttttatttttcatggcaatacaaactattgtttttttctctttctaaaataggcaattaattctctacactgttacttcgctttttttttctccaaaattttccaatattcctgattttccaaagccggtcagcatgcaagtctaaagcaaataaatgcataaagcaaataggatgcagcaggatggtcttttcatttcaggttgctagtcctagacggacccaacccctgtgttgagtcccttaagtcaaatgcaatatgatgcagataagcgttcctactagggattcggcatgaagctgagttattctaggtttataatctaggtatttgttctagactgtgtacccgagtggacaactagagtcgaggaggggctacgtaccggggacccgcgagatcgtccggctttgtaacttgtccggcctctttcttatttcaggtattgacactaacagaatagggagtctcgaccagcgagcttctccccgaagatgagaagagaagggtttcggcacagtttatatacagttcagataatatcaaagcgataaaagcaacattttgcggatttaagccaaaacatgtaataaaatcaaataataaataaagccaaataataactattattctaagctcgaattcttgaaccctgaaccagagattctgggtcaagtccccagcagagtcgccagagctgtcacacctcctttttccgcctcgcgaggggtgaaggagttttttccaattaaaggacaatcgaaacgggatttgtttatttatttcagagtcgccactggggagatctatggtgtcccaagtcaccggttgaatcccgaatcgaggaaagaatgactctgtttaacagtccgtgaatcagaaatccggataaaggagttctgttaacccgagagaaggtgttagacattcccggattccgtggttctagcacggtcactcaactattatatttggcttatttatctgattttttttaacaattaaggacttatatgcaaatttaactttgacccgcttttatcattattgttattattattattttatacaagaattgcaacgtcgtgaaaacgcatctcgaatcacgtcacaaccagtgtacacgtgatttgttgacacattttgactccgccaagattgggatttgagttacataaatgcacactcatatttaagaaaatacctttattaaatacacgcctaaagactacggttatactttgtattgtttatatttgtttacttttttttagcgaaatcctcccttattttatgaatatcttaaaatgactatattttttattattaagtttgtctataaatataaaatcaatctttacatacttaaaaataacatattaaataccagtttaaaacaaatattaacgaaaaggaatattactaaaattgtaattataaatacaatatggaattgtcaaatatttttttttaaaaaaaaaactaattatcccataaccggattaaaatcatattgttagatgacttgagctattgaaattaattatttacaactactgaaaattagaaacaatcttgattactattgcgtatttctaaaatttaattaatttaaccttaactaaccttgttttaattcaaatcatgtcctaatacttgattcgcaaaattaatttaaactcatgttttaactaaatttagctacatgatttcgattaacttaatgttggtgatactaaaacccatatgaatagtgaaattaattaattttgccaaacagatttaataaagtcatttttacgttattttcttctcattctaattattagacagtttaatcagtaatgaacatgcttaaatatatactacctaataatcaggttaaagaaaagcattatttaatacatcgctacaatatgtctagttatgcaaaacgacggtgatttacagaatagtaatacatgaaataacctaaatacaaaaaaaaaagctaaattagaaatttaaaatcccattcttcatttcaacttacaaaatgccaagattacagttgtgtacctggtattgccaatataagaagaagaaagtcagcaatgtagtatgtaacacaacaacaacaataataaccagcaatccagtcaacagaaaatctcagtgacagatttgaaaatcaagataaaaatccagaaacaccgacaacaaacaacggacagaagccaagggaatcttttcagatttgaaagactaattaatatttaacccttaatttctgaacccgtatatcagaatatttatcaggtgtatactactctctcttttaatttccagccctttttttattttgtatatttttttttcttttttgaaagtcttaatatttttcggaatttttctttctctctcttcaatcttcagccctctttttttctctgtctccttctttataatctgatcaagtccccctatttatccccatctttcaacattttttaaacataaaacccactatcttcccactcatcccccttttaatcccactacttaatgttttgtcccccactacattaaacaaataccccattatatcttgtccccgtgcttatattaaacaattgcattattccccaccattatatcttgtccccccattattgattattttaatattattttaatcctaattgatagagcactcaaaataaataattgttcataattttaattccaaaaatacccctctaaccttactgaaattaacattttacccctgaacgtactgcaaattaccaaactacccccatcagctataaccaattcacctaatcaatttcaaccaaaatacagcaaatatgaccaatttctatacaattttcaacaacaaattcaaactaaatgatgaacaaccaagaaacaactaaaattattttgattgaacaatattttttaacaacaaacaaacctactttcagattcaacaacaacaacaacaaacaagtatattcagatttctatattcaataatcatttgaacttaaaattaaatctaacaacattacaaccaacaatttctatattatactaatcaaaatcatgaaacaaactgaagaaataatcataaatgataaacaacaaacaagaaaatcaaacttatgctaatttcggattcaagaacaatcaaacaaagtatggacataaatgaaaagattcaacaacaataacaagcaagttttattcaaattcgaattaaactcgaattaagcttaaacaaaacaaataaacatattcaaatcactaaacttcaaataatcaattgatctttttaaattaaatccaacaaaattataacaaagatacattgaatcaaaaaattaaaaaccaaaacataacttcacattaaatcactgaattaaaaacgaacttcaaacaaatgaacacgaattaaatctatattaaacaacaaacatgacggattcaaattatttaaactaacacttttctatattaaaactaaatccttttaaattaataaaacaaactgaagaaataattaattgaacttcaacttaaatctaaaaacattataattaaactaacaatttctatctaaaaataaataagaaaaatgaaacaactgaataaaaatcaagaacaagaatcaaacatttaatgatttcagattcaaaaaatatcaaaaaaattacggacaaaatgaaactcaaaccaactaaccggatcggaacgacgaagaacttgaatgaaaacaaatccgtccggaagtgattatcgcaccaaaacaattcgacgccgaagacgaccccgaacggaccatcgaagaacttgaagaaggaagcagcggacaacagcagcagtgaaggatgaagaagacgcagctacagctcgtcgaggcagcagtagcgacgaagaagaagacgcaacgcaggagctcgtcgaggcagctgggctgtcatggtggacgttcagccatgaacgctcgagctgggttgttggtggatggatatggacatgggcatgaaggaaaagaagtgaagaagaagaagaaggtgaagcagcaaggatggctatggagctcgagggtgcgctgaaaaagaagaagaggcagcatccattaaagctctaactcgagctcgaagaaaatggcgacgacgaactcgacggggcagccatgggcgaaaagaagtgttgtcggatgatggtggagcttgacatggctatgtagctatgcgaagaagaagaagaagcacccatggttgtgtgtgtgtgtgtgtggtcgtgatggggaagaagaaggtgaaggtaaggggaggtggcggatggtattttcaacagtgaaaattttttagggttttgtttttgaaatgaaagatagggaaatggggtgttgggtctttggggttatggactgggtcgacccggtttggaatggaccgggtcgtagaggaaggttgggtatatttgggcctgtggttcaaaattgaagaagaggcctaattccgattttcttttatattttttgctctcttttcttttacttcctaattaataaaactaaaattctaaattaacttataaactaaattaacttataaaaaatactaattaattccaaataactattatcgcacatttaaatagcaattaaaaataaaattgcacaatttagacgttaaatgctaaaaatgcaacgtacattattttttatgattttctcatttttgtaaaacaaacttaaataaatactaaatgaaaatgcgacatattttatatttttattaatttaaacaaataaacatgcacagacaaaaatacaaataattatacaaaaatatcacaaaaatacaaacattgcacacaaaggaaaattgttttattttgaatttttgggagtgattatcatatagggcgaaaatcacgtgctcacagggatgatgatgtttcttgtgatgttgttccattgcggggacttgattgttgaactattattcccttgccgggattcttattgtaatttcatttactcccttgccctattatttgtgattgttgtttgggtgatgaagagtgttaaagtacgaagggtgatgacgtctattgtttggtgagagagtgttaaagcacgaagggtgatgtcgtgcatgatttgtaaggaaagagtgtaaaacacgaaaggtgatgtcgtgccgcacaatgtaccattccgtgcctattatattgattatatggtgaggacgagagtaaaagcatgaagggtgatgttgtgcacattttcattacttgattgctttggttaggacgagagtaaaaggacgaagggtgatgtcgtgcacttattgattcatgattctttgttgatatctgagatatgttgtttcttttaattgcccgttgtctttctattctaaattgatagttcctcgcaacatgttacccctctcatacttgactatatattactgttttttttccgttgtatatagttaaatggcacaggtttatttggtagtctggtcctagcctcgtcactacttcgccgagattacgctaggcacttaccagcacatggggtcggttgtgttgatactacactctgcactgtgtgcagatctcggagcagcagcttttggaccgtagattgggtggctgccttcagtccacacggagatccaaggtagtcctgcaggcgtccgcaggcccttgcgtctctctctatctctttactcttatttcatttacttagttcagaaacagtgtatcttttatttttcagactttgtatgtagttttcttagatcgtctgtgaaactgtgacaccagttctgggtggtcgaggctcaaacagttgtattagatacatatttcggatagtttactgcatttcttccgcttattgtaattttcgctgtctacacgttattgcttttataattgttaaagaatataaattggtaaaaaagtaatttgttcaaacagtcgacttgcctagctcacattagtaggcaccatcacgactctcgaggatggaaaatccgggtcgtgacagaattccaattttatcagcccttcatccttcctctctccatatcagtggcccatctctctctctcaaagttcttcaaataagaaaagataagggaaacagaaaagtaagatggacattaagggtgtgtttggtacgaaggaaattgttttccatgaaaaatattttctcatgaaaaataagtagttttttcacttatttttccttgtttggttagtgagtggaaaactttttccgaaaaatattttctagtatttggttagagaatagaaaatatttttttatgctactctccttcctcccccaagtcccaatgtttccttgctccacacccccccccccccccctcccctcaagagccaacattttcaggactctattttcttcgaaaatttcattattcttctaaatatttacacaaacccaaaagaactaatgtgttgctttacttttttttactcaaaaataacgttgaaatttgtgcttcataaccaaaaaaaaatactcatttttttggttgaaaaagaaagtactctttctacagcatgaaaagaaagtattcattttattgaaatgaaaaaaaaatactttttctacatcatataaagaaaatactcattttgttgaaataaaaaaaatactttttttatatcatgaaaaaaaatattttttttgttgaaatgaaagaaaatactttttttacatgaaaagaaagtaattgttttgttaaaatgaaaaaaatactttttatatcatgaaaaaaatactcatttgttgaaatattttttttttatctataacatgaaaagaaagtactattagtaatatttttatttagggtgagggtgagggtggagtgggatggggttgggttggggttgggttggtgggggttgatgaggatgggaaataaggtggagaaggttgagaaggagttttgaaaagtgttttctctttctcttgataaggaaaacattttcctccaaaccaaacacaccctaaacctatatttcaataatttcttgtgccaagagagaaaatctatatactttaagattatgttgattcctagtactcgctcgcaccagcatctttgtatattgtcattagggtaaaagtactccaaatttatccctaaattttatgaaattaatcattcatgctaatttgttaaatgttttcttttaaaactgaccttctcgttatcaaactattatatgactagcatattttattaaagatacagcctactgccttaactaattgatttaaaaaatttaaattgacacaaaaataacacccttactagttataaaaataatgatggagatattaccagcacatactgctactcctactattaataataatggtaataaaaagatggagatattaaaagcacatattactactattactaatattcctactactattaatatatatatatatatatatatatatatatatatatatatatataaattatgggatgtttcttgaaattaaccacctttcaacaaattcgaaatcccaaatctatcagtcattcatccttcctctccccctattcagtgacccatctctctctctcagagttcttcaaataagaaaagataagggaagcaggaaagtaagatggacattaaatcctatatttcgtgaatttctggtgccatgagagtacacggtcgaaattgggtacgcctattgtgtgaccaatcgagactgaaacatggcaggccaaagctcgagctcgggttatatcaaatcaaggcgcggaattagatcgtcgagctcgcgaccccgaaacggaacaagatcgagaccgaacaagatcgagaaaaacttgccgagccaaataacggaaggccgaaatatccgcgatcgattggagatcatggcggaaatctcagcacgtatcaagaaaaggccaattaattagcaaatcatgagatttttttaccctgtatagaactgtatcaagagtaggacacccctactatataaaagaggttttgatcatttgtaaaggacatgttaaaacacatcaaaaggcaatacacgattatttctagtcatcttgttgttctggtctaatatcagttgaggcattttttggctcgggggtgatcaaactcaaaggctaaggttgttcaatttgtgtgatttgcacttatatccttatcagtaatttcaatattaatatgttttcttaatttgtatcaagttacatcacgtatccttaaaaccgcgtataaatccaattgttatccgattttgagggtaaacagtttggcgctcaccttggggctaaggataatagtggttacttagtacacactttcataacacacactattttatacgtattctttggagtatctttgattccaggaccaaaatgttgaactctccgtcagtacccctacacattgacaatgatttcggccaccacggcgaaaataataacatagcaccaggaaacgacgtacccccgatcgatctcgacggagtccctgctgtggatccaatcgatgttaactcatatataacaatcaatgcaaattcggctgttgatcccaaggaagtgttcgtagggatgttcgatctgccgctcaaagaacacatggcgacgaagatgtcggaatcaacttgcgggtgatttttgaaatgttgcaggctcaacaagcaacgatagcctagctctagaaccagaatcgcccgccgagtaggattgagcctagccgtcctagaaagttgttcacagagttgaatcgatctcaagggaatcgaatgataaagaaccgaggaccaatcctataatcatgaagatgctcgaggaaactgacaaaacgaattgagtcggggggaaaagatgattgaggcaaacaataagaaggtggaaacttaaaactccagggtcgaccgaatctcgcgagcaacactgatattgaagggcctggattcaaaaacgttcgtgcaaaaaccttttcccccaagcgtagctctcaagccgatccccaagaaattctgcacgcccgagattcctaagtacaatggaacgatcgatccgaacgagcatgtcaccttttagacatgtgctatcaaagggaatgatctagaggatgacgagattgaatatgtcttgctaaagaaatttagggagaccttgtcaaaaggagctatgatatggtaccacaatttaccacctaactctattgactcatttgctaaatgcttgcagattctttcgtaaaggcacacgccgaggccatcaaggttgagaccaggaagtctaaccttttcaaggtaaggcagaaggataacgaaatgcttagagaattcgtatcttgattccaaatggaacggatagacctgccaccagtcgttgatgattgggttgttcaagctttcacccaaggactcaatgttcgaagctcggtggctttgcagcagttgaagcagaatctgatagaatactcggctgtcacttgggccgatgtgcataattggtaacaatcaaagatcagggtctaagacggtcaacttgggctcctttcgggtccgtttatcttgttagacccgtcgatagaatcaagaggaatatcgaccaagaaccgaggttgaatagagatcaataccatccatataatggagatcatagaagtaacgggtctgggagaaattctatgtgaaataaaaggagaagtgatcgaggccagagctctcgagggctcatgggcaagaacggcttcaataggcctatcggacctaaagaagcaccacaattattagaatacaactttaatgttgatgcaacttccattgtatcggctattggacgtatcaaagataccaaatggcctcgacctttacaaaccgatcaagcccaaagagatcccaatcaaatgtgaaaatgtcatggcactcatggctacagaatgaggattgtcaacaattgagagaagaagtagcctggttattcaacaacgggcacctttgaaaatttctgagtgaccgagccaagaatcatttcagaaacaaagactgtaataaacaagccaagcaagaataaccttagcacgtcatccatatgatcatcggatggatcgatgttcctcaaggtccaatgttaaaacgcaccaaagtatctatcacgagggagaaacaaacttgagaatacataccagaaggaactctgtctttcaatgacgaggatatagaaggaatcgtgcaaccctataatgatgcactagtaatatctgtactcatgaataaatctcgagctaaacatgtgttaattgatccaggtagctcatccaacatcattcgatcgagggtcgtagaacaacatgccctataggaccaaatcatacctgcagcccgaatgctaaacggattcaacatggcttgcgaaactactaagggagaaataacgctaccggtaaacgcatctggaaccatccaagagaccaagttttatgtgatcaaaggggacatgaggtacaatgcccttttcgagagaccatggatccacaacataagggtgtgccctggacccttcaccaggtgttacaattctcaacaccagaagggattaaaatgatctatggggagcaacccaccgcaaaggagatgtttgccatcgatgaagtaattccgatatcaacactctcattgataaaggagccaagttcaaaagcaaacagaaagccaaatagcaatcaccgatgttggcctcgacccaattgaacaagaagaagattgacgaagatgatgattacggggttcctcgatcctttatagtccccgatgattctgacgctaccaaatcaatgatcgaagagctggagcaggtcatgctgatcgaacaccagcccgattggaaggtaaacctgggcatggggttaactcccaagctgaggaaaaaactcattcaatttcttatagctaacatggattattttgcttggtccaatctcgacatgacagggatcccatcgtagatcactactcacaagctaatcctggaccgaaaattccattcaattaagtagaaaaggagaccccagtctgagaacaatcatgttttcatcaagaacaaggtaactaaactacttaaaatagggtccatccaggaggtaaaatactcggaatggttagaaaacgtaatagtagtcactaaaaaagggaacaaactaagaatatgtgtgtattataaagatttaaataaggcatgccccaaagattctttcccttttgccaaacatctatcgcattatcaattctacaaccggccccgagatcctcagttttctcgatgcttactctgggtacaaccaaatacgaatgaacccggatgatcaggacctccttcatccctaaatatggcatatactgctataatgtaatgccatttggattaaaaagtgtcgatgccactaccaacgctaagtaaactgaatgttcgaagaacaaatagggaaatccatagaagtttacattaacgatatgttagttaggtccttacaagcagaggaccatttaaagcaattgcaggaaaccttcagtatattgaagaagtacaacatgaagctaaatctaaaaaaatacacgtttggagtcggatcaggtaaatttctcgggtttatggtatccaaccgaggaatcgagatcaaccacgacaagatcaaacctattaaggatatcacggtagtggacaatgtgaatgtcgtagcaaggctaacctagaacattgccgccctagggcgattcatctcgaggtcctccgataagagccatcattttttctcgttactaaagaagaaaaactacttcacatagaccccataatgccaacgggccttggaagaacttaagcgatatttatcgagtccaccgctgcttcacatgccgagggagtatgaataactatacttgtatctagaagtatcggaaatagcggtaagttgagtcttagttcgggaagaacaacgtatgcaatttccaaattattatgttagccggacattaggtgaggctaaaactaggtatccttacctagaaaaattggcgctcgctttactaagtgcctctaggaaactgaaaccatattttcagtgccatcctatatgtgttgtgacaactgacccattaagaaatataatgcataaacacgaaatcttaggactattggccaaatgggccgtagaaatcagcgggtacgatataaaatatcgacctcagacagccattaagtctcaaattttggcagatttcgtggccgactttacgctgaccctaataccccaagtcgaaagagagttattggtaaactcgaggacatcttcgggaatatggaccctctttacggacgatgactcgaacgtaaaagggtccggactcggcatcatactgaacaacctacaggcaatatagttatacaatctaagagaactgtgaaattgactaacaacgaggccgaatatgaggccatgattgcaggtttcgaattggccaaaagcttgagggtagaggtgatagaagctaagtgttactaagtacttgtgttgaaccaagttaatggaccgctcgaagttagagaaaaacgaatgcaaaggtacccagataagttacatgtaacattatatcggttcaaagagtagactttgcagcatgtacctcgagatcaaaatagcgaggccgatgcgcttgcaaacataggcttgtcggttgaggtgacgagcttaattttggggtagtcgtacaactcatgagatcggtagtggaagaaggtcacaccaaaataaactctacaaggttaacttgggattggagaaaaaaatacgtagattatttgaaccggaaactacccttagatctaaaagaattgaggaccttgcgcacaaaggtagcccgatttatcctgtccgaggacggaacctgttcagaagaatgttcaatggcccgctagcaatatacttgtgactgggagataccgattacgttctgagggaagtccaggagggcgcctgcagaaaccattcaggcgccgaatcattggtttaaaatgtaattagagccagctattactggatcgacatggaaaaaaatgcaagggatttcgtacgaaaatgtaacaaatgccaaagacatgctccgatgattcaccaacccagggaactgctgcatttgatcttgttaccatggccattcatgaagtggggaatgagtatcgtcggccctcttccatgggcaccaagtaaggctcaatttatcttatttatgactgactatttttctaaatgggttaaagcccaagcgtacgagaagttcagggagaaggaagtcatcgacttcatttgggatcgcgtcatatgtcggttcgggatgccattcgaaattgtatatgacaacggaaaataatttatcagcagcaaagtgaccaagtttctcgaagatcataagatcaaaagaatcttatcgacaccttatcaccctagtgggaacggacaagacaaatcgaccaacaaaaccataatccaaaaccttaagaaaaggttaaactgatgccaacgcaaaatggaaggaaatcttgcccgaagtcctttgggcatatcgcacgacctcgaagtccagtaccggggctactccattctcagggagccaagtatcagattctgatatgcaacaaaggaataaaatgaagaggacatgaatacgagcttggagctattggatgaaagtcatgaagccgcccttgttcgattgggtgctcaaaagcaacgaatcgagaggtattataatcgaagggccaaccttcgatacttcaatattggggacttagtactaagtacggtcatacagaacacccggaacctgaacgaagagaagttgggtctgaactgggaaggatcgtaccaaattctcgatgtcatcgagagaggatcctataagctcggaacaatgaatgaggaacaattatcgagcaattggaatgtaactcacctaaaatgatattactgttaaggtacgaccccattcattttctcttatttgtattttgaactaacacttgcagttcaatatttgtattttgtctttccgagatctttcatctcgaattccttctttaaataatcaattgccttttggagttctataggagttccaataaggtttatgttattaacatatacgacaagtacaacaaattccgatgttgttttctttataaaaacacatgggcaaatggcatcatttatatagccttcctttaataagtactcactaagatgattataccacatttgtcctgattgctttagaccatataatgatctttgcaatttaattgaaaatatttcccgggactttgaattattaggcattttgaatccctcgggaattttcatgcatatctcattatcaagtgagccataaaggtaggcagtaaccacatccattaatcatgtcaagcttttcatggacaacaaaactaatgagataacggaacgttataacatccataacgggtgaatatatctcttaataatcgacaccaggcctttgtgaaaatccttgtgtaacaaggcgtgccttatatctttataccttatttttctcattcctcttgcgtacaaagacccatttataaccaacaggcttaacaccattaggtgtttggactacaggcccaaaaaattcacgttttgcaagtgaattcaactctgattgaattgcttcttgccgttttggccaatcgcgtctttgtcgacattctccaacagattgaggttcaagatcctcactatcttgcataatgctagatacaatattatatgcaaagacataatctaccactatatccacttgattcaaatttatctcaacatccattggatttattgatagttccttattttcttgagtcttaggctcagtggtttcttcatgaatctcagaatttaataaatcgtggatttcttcgtgagactctttcgtaatgtcatcttgatcatttgttttcctttttctaggatttcgatccttagattctaatgacctgctacgttttaggcgtgcttttgactttaactatgacactagaagatcgtccaacagggacatcaatacggattggaacattctctgcagggatatgtgattttgttatccttttcagatccgtaaatgcatctggcatttggtttgctattttttgcaaatgaataatcttttgcacctctttttcacaaatagaggcacgtggatcaagatgagataatgatggatttttctacaaaatttctggtttggtttcaccattttctctccctaattttgggaaaagtgtctcatcgaatcgaaagtctgcaaatcgtgacagatcccccgttaatgtttcaagatagcgaaatatgaaggcgattcaaactcaacatatattcctaaccttctttggggccccattttggtgcgatatggcagtgctacaggcacatatactgtgcatccaaaaattcttaaataggatatattaggttcatgacccaaaactaattgcaacgagaaatatttatgataatttgtcagtctgagacgaactagcattgctacatgcaaaatggtgtgaccccaaacagaaatgggtaacctcattttcataagtaatggtcttgctatcaattgcagacgtttaattaaagactctgcaagaccattttgactgtgaacatgagctacaggatgttccacttttatctcaattgataagcaataatcattaaatgcttgggatgaaaattcagcagcattatcaagtctaatagacttaattggattatcagggaattgtgcccgtaatcgaattatttgtgccattaattttgcaaacgcgaggttgtgtgatgacaataggaacacatgagaccatctagaagatgcatctattaagaccatgaaatatctaaacgacccactaggtgggtgaataggtccacaaatgtccctttgtgtatgttccaaaaatgcaggggactcaatcccaacctttgttggtgatggtctaataattaacttgccttgataacaagaagtgcaagaaaattcattatttaaaagaatctttaaattctttaatggatgcccatttgagttttctacaattcatctcatcataattgatccagggtgtcccaatcgatcatgccaaagtacaaaagtattggaatcagtaaccttttggtttacaatagaatgtgcctcaattgcactatttcttgtccaatacatgccacaagataaagataggaacttctcaataaccctcttttggccagagacattcttggtaatgatgatatattcaagattattctcatctattgtctcaatatgatatccatttcgtcggatatctttaaaactcaacaagttcctcttggacttgaaggagaatattgcattctctatgataagattgttcatttaggcagagttatagtagctcttccagagccttcagttagattactactattagaaattgtagtaacatctgccttacacatacttaaataagagaaatatttcttctctttgaatattatatgtgtcgtacatgagtcaattaaacaaatatttttacaattgaattgtgatctaattttgctttgagagatatccatatttgcttgtatttaaaatcaaattatagaatgtcaagaatttaaaagagaaaattaaagtaaaacacttaccttagatccaaaatttaatcatgaagaaagttcatggaacaattgacaatcattatgctcaatcccaaagcttctactcaattggttagagtctcgtgttgataacgtattataaaataataaaagaagaagaagagtattgcagagaaaagtagggagagagaattcttattgattttgagatgaataaaatgaaatagaaccctctatttatagggagagagtgacttagccaccaagtaataaatcctagaatctctctaaatatagacactcaccataaataaaattttatttataacacatccatatttatccactaaatgtttttttttagaaatgacctcgtcgttatcaaacgtattatatatgttttttattttttaatggagctacgactagcatattttatctatgaaattaatcatccatatgcccttatcttttttctttttaacattaaataacaattaaaccaatttaattggaacaagttacaaaaagagatttaacaaaatattttaataggactgattattggacgactgcgttgtgcgtcaattttgaaggaggaataagcaattacattcatacgcataattaggattttctttttgtcggatataaaccttcttagatactaacactgtttactgattgagtaacagtgcatactaacactatatatatatatatatatatatatatatatatatatatatatatatatatatatatatatatatatagtatatttttatttttacttgttcattctagcaaatcaggaaaaacaaaaaaattccccttttattctcaaaaaaagtaaaattttttttgatggggtttgcgcggtgcgggggagggggaggagtgggtggtgcgaaaaaataaaaataaaaatagaaaattaaatatacaaaaaaagtaaaaattaagggggtttgcttggcgggggggggggggggggggttagggagtagggtggatggtgcataaaaacaaaaaaccagaaaattaatacaaaaaaacggaaaacaaaaattttttgagggggtttccgggggaagggggggaggtagggtggtgggtgctgcagaaaaaaaaaaagaacagaaaatcgaaaatacaaaacaaaaaaaagaagtaaaattggggcaactaactaaatttctagataagttgggttaaaatccctttgttttgagtgagtttcatatataggttgtatttgagttgcttaatgagtcaaaatgagttataaaaaataatttattaatatgagctcaacccaaattgacccatgagctaatatacttgtagtccaacctattaatctctgggcgagttgtacgagttagatggatttgagctcaacttgacacccctatatataacataaaaaaaaaaaagggtgaaccataagtccctatcacttatagttatttattattttatgaaaaactattaagagattcattgcttttaatgtaatccaactaggatgcttaattttaatcaataattgtatacataagatgcttgaaatttgctaccacgtgtcagcaaaatgaaccccgtaagttacaataggctattcctattatatatttattatatacttctactcattgacgaatttaaaattttaaatttacctgtgaagtggcgaagtcacatgcttacaagggtggtcaactgatcaccttcgtcgaaaaattatattatgtatataaataaaatattacattttagaaatatataacacctattgaacacttttttcggattttttcccacttctttcaaatttgaatacccttgagtaaattcttaacttcgccaatgtgtgacagattggttggggtgggggaggtggggggtagggtgagtgggtgatgcagaaaataaaagaacagaacaataaaatataaaaaaagaaaaagtaaaattggggcaactaagtaaatttctagataaattgagttgagatccctttgttttgagtgttcatgggttgtatttgggctgcttaatgggtcagaatgagctataaaaaataatttattaacttgagttcagcttaaattaactcataagctaatatgtttgtagtccaacctattaatctctggatagattgggcaagttgaatggatttaagctcaaattaccaccccggtatatagcataaaaaaatgagtgaaccataagtccctgtcacttatagttacttattattttatgaataactattaagatattcattgcttttactgtaatccaactaggatgcttaattttaatcaataattgtatacataagaagcttgaaatttgctaccacgtgtcagcaaaacgaaccctgcaagttacattaggttattcctattatatatttattatatacttcttctcattggcgaatttaaaattttaaatctacatgtgaagtggcgaagccacatacttataagggtggttaactgatcacccttcatcaaaaaattgtattgtatatataaataaaatattacgttttaaagatatttaacatatattaaacactttttgtcggaatttttttcatttctttcaaattaaatacccttaaataaactcttagcttcgccattgtgacagattggtttaaattaccatggcaaggatacaaagttaattttgtaaatgtatgttttatgaaactattaaccaagagataaagatttaagaaaaatatgatggtattgtttttggatgaccaataaacttatttttttatcaccttgacttccctcatggttgaggtattatgcttttctcccttatttttattttttataataatttttttacctatttattatagaatttaaaaggcctgatatgacaaaattgccctttcatgttgcattaaactactgaaggtttgcttgattgaaacgattgacaattcgctagtaaaatggcattgaagatagcaaacaggtgtgataaaggctagatccacccgttacagtctctttggccaagttttccaaagttaaaagtacttttttttttattaagtattttttttaaagttaaagtgtttgatcaatattttagaagcaaaaacgtgtttttaagtagaagtagaaagaatttttaagaagtagaaaaaatagtttctcactaaaaatacttttttgaaaaacacttttgagaaaaaacacttagaagcaattttttaaaaacttggtcaaacactaattattgctcagaaatactactaattagccaaatgcaaactgtttttcaccaaaaaatactttttaaaaaaaacatttttagggctcttgtttacagagcgaatttaggattttaattttatgagttcaataatatttaataatttttacacataaatttacggcctacatcaaaattacgaagttcagttaagccttataactctattttcagatctattacaccaccaaaaaacctcaaaagactgaagaattttcaaacaatatattcttttattttattcagccagttaatttattgtagaatttttttctaaaaagatgattgcaattttagacagtgaaaatttattgtatcacaattttataaaattaaaaatatgtaggttaaaagaatttttactagaaattcaaaacaaagagaggtaagtgtaacatcttaaactaagaggaggtaagtgtaatggagtgaaagtatatgggccgatttagactttttaccttttctgtttattaacttgtctcacttatgatcagcatagaaaaaatatgaaggctggaggtctatttgaatgaagtgcatatatatactgatagaacaaaaagtgatttatcagtcaagcaatttcatttgaagaatggcaacaaaatagagtggagaaattaactaaaagtttagttgccctgcctttttttttttttgggttgttgagactattctaatgttgaacgcgaacccttcctttcacataattaagctaatctctgtaaattcaagctatgacaaaggaatttggctttggctatggaatttatcacatctatattccttttccttggtacattttctgatgatgaggtggatgaagaagacgatggctcgggtgagcgcgtacgactacgcctcgctgtaactctagccggcttaggcatgtttgagccgattaagtgaggaaaattgagccgagctctcgagccgcggattttgaaagcggcttgatcgtaagctaacgctgcatcctctgcggtctcgtaagttcctaaccacagccttgcaccttcacctttcctacttgggtctcttgtctccgccgaaaacgtcccccacggtcgccgtttcactcctatgtaccgcgtccaatctcgcggcgcgtttttctcacgcgccaccccagggccctgggttttctcctcggactcggagtacttttcatgggattcatgtgaaggattctgatcagttggtattaatgtttcctcagagttttcatcccaattaaggaagctgcagtcgaagtcgaagctgctaaaacttgagctaggactgttaggcaatatttcgttgctagaattcatcgacgaaaaaatttcagaaaaatctgaatcgtcaagaagatgttgctttatcgattcaaggagatgagagtcggagaaaaacaaggtttcgtcagctggattcatttccattgccataataaggttttggatgaaaatgaatgtagttttcttgctccttttaccttactaggggttaccaattgtggatgaacgaaaaggttgacacccacatctatttatatatgctttggtctattgcactagatcgtatcttcctgtttttcattaattatgttgcattctctctctgttaaagattttttaataccaaaatggtgtaaacatcaacactatacaaattaactccaattcattacattattttttacatcaaaaaaaatataccttgtatattctcctctttttttatattatattattaactttttatatattcatcacatataattcatattcctttcttatataaccatgtatttaatataaaattattttaaatcataaaattttaaataatataattataaccaaatattatacattatgcatgttatatttgtcgtgcatccgaatacaagtgatacaaattggtaataattgaacattagctacaaatgataattaggcaaactatagttatgtatgataattaaactttaagctgtagtgttttatgaaagttcaaaaaagaaaaaaaagggaatgtcagctaaaagaaccataaatatagttaaaagaccaattacgaccctgcaataattgaaaacgagattgtaaaactcggaatgcacgttcaacattttttcgacatgatattcttcttttgagaatgtggctcgcgaatagtttgcacaatattagactattttggatatatactgtcagtgttagctaatttattaaatgtttatttttatattatttaatgaatattgtgttatttattaaaaacatattatattttatatttgcaccttttatttttgtgatggttatattttttatacaattataacttgtaatagaattaacttatagtaatatataaagataatatatacgaaaattaatttataaaaatatacaccaaaattaagatgtaatttaatattataaagatattacataaaaataattatatatattagtgacctaatgaagaaagtaaaatttataatatgttaaattaaaagtgttatataataaaaaaaatatttatgaataataatggtgttgatgaatggtgtaatactattcatacaccaaaatggtataccaaataatacaccaaaataggtttggtgtaatatttaatataatgttggagatggtcttagggtaaaacttttgtgggacctttaatttgtttgactataaaaacttcttattacaggtgtaatgaaaagtaatttttttcaaacatacaaatatatcattctttttgaaactgattaataaggaaagtgtgtcacatcaataatagagtgggtaggagtttccgtgaaatttgctttttaagtagctgcatgttatgccttttaggtgcagtgtaaataacagcttgtttggatggttgttacgtatcgtttcataatgtatcgtatcgtaacgtattgtattgtactgtatcgtttaataaatataatgtttggatagattgtgtcgtttgccatcgtttcatgatatcacgcaccagtattatgaagaataaacttgcaatattgtaaagaaaaattatgatgcaaggtaaaattactatatataaaaagatagggtaaatgataaaataaaataatttaataataataaagattgagagaaaaagacaaggtaacgacgcgacaacaccaaatcgatcgttacataaagtgacacatttgatcgttatgtaacggtggatttacgatacgatacaataaaatttaagtaacaatcaaaacaaacattgtatttaaagtaacaatacgatgcgatacaatgcgtaacaacagtccaaacaagaaaattaagtactgatatatcccattaagaaatgaattatttcatcaaagggaattaaaaaatacagttctatgtgaatatggacatgaagtgcgacaaaagtactaacactattttttgaatgcagatccattaattttagacctagaggaagatctttacacgttcacataatctattgaatcccgagcagaaacgttttttatttgaaaaacaggcccagagattggtttatttgtatttttatttttgtctttttggtgaaaaatgagctgtcaaattaaatataaggaggagttatatacaggaaagtggaaaccgtgaagagctgatacagaaatacaattactaatttaaaagagatctggcaagcttttcctttcaacaaatttggcagctcattttatcaccaaaagaatatactgatatgtcaagctaagctacgccaaaatatttccattttgaaggtcgcaataaagatcttcgtgatctaaaatggatccgaatatttcagaaatgatcgtctctttgttattctgatgtatattatcactgttctttattactacctgttgcacaaaacaatattatacagagtataaaaatactccatgattatgccccattataataatactagacgttaatgtcttttcgcgttaaaccactcgccataagcatacatgacaattaaaacatactccctccggtctccttatgtcgcaaagtttgaatcgatatgatgtttaaaaaaagatagaaagacatctgaaacttgtgttctaaaataaattacagatatttatatgactttaaaaatttcttattaagggtaaaataaaatgtttgagttaaattattttcaaatttagaaagttgttattttttttaaaaacggactaaaaaagaaatgttaccgtataaattggaacagagagtatttttatatcatctagggaaataacatttttggtccctgaattattgggtaatactgattttggtccctattttattcgactaaatacatttaacctttacttaactcaaatatgtgcttttgatccttgaagctaacagaagctaaatcttaacaaaattattactttttaaaggtaaaaaagtttgttgtgacagtgcctctcttttgtttattttctttttttgataacttccatggaaatggagtttgcagctagagagaagacgaaggagaagaagatcagagtggagagaaagcagaaatgctctgtatttccaagaacggagggaaataaaaatatgtaactaactactgcacgtagagtgtagttatagttataactaactaactaactaactattacacatacatctctaatatcttaactaacttaagatgagctagatcctagctggaatgttgtaactacagcttgaacattgccttcacacgctcattgttcaacactgcccctcaagttgatggttgaaacaggttcttcactccaaggttccttagtagataatcatgttgtgctttgcttaggccttttgtaagtaaatctaccagttgctcctttgtagatacatgctcaattttgattggaccatgtatgatcctctcttttacaaagtggcaatctatatctatatgcttggttatttcatgaaagattggatttgcaataatttgtattgcagctttactatcacatttcaattgaacaggtaaatacacataaattcctagctctttgaacaaccccacaagccaagtaacctccgtagtgcatgaaaccatgcttctaaattcagcttcagctgagctcctagagatagtttcttgcttcttggattttcaggagataagagcaccaccaaacttcactagatagcctgtcactgtcctccttgtctccacacagcccccccaatctgagtcacaaatggctgttagcttgcttgttttttctgtaggcattaagagtcataggccaggttctgcctagatatatttcattgccctgagagcaacttctaggtgagatgtttctgggcagtgcatatattggctaagaacttggactgcaaatgccaggtctggtatagtcatggtgaggtatagtagtctacccaccagcctctaatagatacgagggtccttcaatttctcatctgcagctgcattgtcactttgcagccaagtatcatagtccacaaacaccatattttggttcaactctagtggagttcctgtaggtttagctccattcaatgatgattcagaaatgagctataaagcatattttctttgattcatcacaatgcccttctcagacatagtaaactcaattcttagaaagaattagagctcaccaagatctttcatctcaaacctattttgcaagtccctgctagtctgatccaatatgatttgatagttgcttgtgatcaacaaatcatctacatagactaagatggttgctatgtcatgacctgttctcttaatgaacagagaatagtcaaagtgactttgtctgaaccccatctgcagtaaagcctcaatcaacttcaagttccactgccttggggtctgtgtaagtctatagagggaaatttgcaatttgcacaccttctgggactccccctgtctagcagactcttcaggaatgtgcatatggactttctcttgaagctcttcattgagaaaaacattatgaacatccatccgatagagacactagtgccttgatgctgtatgtgctataatggacctcacgatcgccgtctcccccaaagacattcaatcacaatcacaatctcaatcactattttaatcacaatttcaagcgcaatcaccaccatgtgtgcggcatggcatacgatctcgacccgatcggctaggccgtctcaccataatgatgtgtggatcgacatcaccctttctatcaatcatctcatcccaattaaggggagtaacctcatcacatgaatcttatcctaaataaggggaataatcacaatccattcctataccggcacgtgtagtttcggggttagattatttcaacctacctttcctaggtgactaatgatactctcaaaaatatttattaaataaaggaatttcaactcatttcataatcttttacacatctcttcatttcattggcactagtggcaccaactgtaatatcattcttggcacgttggccgtatttcatatttcatgctcacctctttcactctcaaacatcatcatgggttatcaataacaaagcatttctaatcacagctttaagtacacatatgagcaattaagagacttaagcacattgagatttcttacacaatttggcataataactttcatttaaaacacgacttgaggtcataaaattttaatacacataccatactttgaacatattctcgaaggataacataacatgataagagaatccggaacatgttttgaacatatatctttcggcacaaagtttattcggcatagtccaatttataatgaataactcgggatatgagaaataaggaattgacacatcatacttgagacttacgagaacattatgggattctattctaagagaaaagtttagccaatataccccgctttgagcttttcttaaattactataatgttccgaaaatcctagcaaatcctaatctattctgagacataacaaaattgaatgcaaattaggaagatatttgtagtttcaactcatttgagcattttatcaaacactaggtgggcattatgatttcaaggtcctcctatggtggattccttcatcccacaacccaaagtctacccatttgagctcaacaaccttcccacaaaccttgatagtacatgcatgcataagtaacactctcacacccaataatcacactttccattaactatcttcttccccaaattcgaaattaaaaactagggtatgaaaccttacctcttagatgaagaccttgtgagttttccttgtgaattctccaattcttgagtaaggattgatgtaaacttttcttagaggtttctcctctcactctagagcacttcctttctctaaaaatatcagtttttctcttcacaaatggtcctttacgtctatttatcgaaataaggttgggttataaaatagaaaaatggacccttcaatcttaattctgcggtcgcaaagtggagtgcagaacaggtatgtgatccatataagggaccacaaaaatcactctccaaaacatgactgcttggattaggtttgctgttcgcagactagtgctgcggtcgcataatgcgccgcataatcttcctctggaaatcctcgtgctcattctgcgatggattgtgcagcccgcaaaatggttatgcagcctcataatggaccgcataatagtgctcaaaattggttcaatttctgcttcacttcgcggccgatctgtggtctacgaaagaaagccatgttctggaaaaatcattttaactccccgatacaatgtacaaccaaaacatttcgtaccgcggcgagcttgcgagccatgaagaatttctactatcctcaagtacattagccttctttggcaccataaaaccatgagttcaagtaaaattgtacggggacttacatcctcccccgcttaggatcattcgtcatcgaatgagggtaaaatctaccattatcatccactgtggcccaactattacttcatacaccagtggtaccaaattttaactaactccctaaattttcaaaatttttgccagagtttcccctgtaactgggcttatccgcctatctacctatccgagaatcccagaaaccaattttaacaaaatatacataatccaacgatgcaacataacatgacaacaacaccaaccgtggcctcataagcaatatattactaaaaggaacacccttagcataaattgtacaagtgatacataattcattgggaacaatttcatagaaacgattacatagctattcaaacaaatgagggcacttattcttcatttcttcctcggtcttccaagtagcctcttcaacttgatggtttgccatagcactttcacaggaggatatttctttatttctcagctttcgaacttgcctatcaattatggaaactataatctcttcataagtcaattcctcaataacctcaatagtttcaatcggaacaatggctgtcgggtctccaactaccttcttcaatgtagatacatgaaatatcgggtgcactaaagacatttctggaggtagcacaagcctataagccccctgaccaatcctctgaatgatcctgtactgtccgacatacctccgactcaatttccttttcttaccaaaccggggaaacctttaagaatactcaatcatcccctctgaactccaaatccctacaacgcacatcctaataggacttcagacgactctgggtagtttttgatcgctcattaatgatcttaaccttatccataacctgatgcacgaggtctagccctatcaaactctgcttccccaatctcgaactaacctatgagggatccacatctcctaccatataaagccttgaacagtgccatttgaatcctggcatggtaactgttgttgtaggcaaattctacaagtgggaaatgatcatctaagctacccttgaagccaagaatacaagcacgcaatatatccttaagcgtttgaatagtccactctgcctgcccgtcggtctgtggatggaagatttcactaagattcacctgagaacccaaaccttgctgaaatttcttccaaaaattagtcgtgaactgtgcccctcgatatgagataatagaaattggagtgccatgcaacttgactatttccttgatatacaactgagcatagtgttccattgtgtcggtagccttaacatgtaagaaatgtgctgattttgtgagtcgctccacaatcaccgtaattgagttgaacttgcgagaagtgcgaggtagtcctaccacaaagtccatattgatcatctctcacttacacattggaatttctattttttgtgccaacccactaggcctttggtgttcggccttcacttgctgaaaatttggacatcttgccataaagtacgctacattcctcttcatatcattccaccagtaaacttccttaagaccatgatacatctttgtagagcctgggtgcacggaatacctagacttgtgagcctcactcgtgatcctttcccggagaccatctacatttggaatacataatcgcccttggtaccttagtgtaccatcacctatgccaagagaaaaagccatcgtcttatgtttatgaatcccctctgtcaactgctcaatcaacagatcatcgtattgcttctccttgacttccacaacaagcgataattcaactttattttgcacaatcacccctccttcactagagtccgcaagacgaactcccaaactagccaaccgatgaatttccttgggaaacggcctttgatatgcccccaagtgagccaaactatccatggatttccggctaagagcatccgccacaatattagcctcccccggatgatatagaatatcgatgtcgtagtccttaagtaactcatgccatcttctcttcctcatattcaattccttctgattgaaatatatttgaggctcttatggtccgtgaatatatccatgtggaccacttaaaaataatgataccaaatcttcaatgcaaaatttacagccgtaagttctaagtcatgtgttggatagtttttctcatgattcttaagtttcctagaagcataagagatcgccttgcgtgttgcattaatacacacccaagtccgatccttgaagcatcacaatacaccacaaacccatctgtaccctctggtaaggtcaacactagtgctgtagttaatcttgatttcaactcttggaagatcttttcgcaagcatctgaccattggaacttaactgccttctgtgtcaatttagtcaacagagaggaaagagtagagaacccctccacaaattttctgtaatacccaactaatcccaagaaactgcaaatctctattggagttgtaggtctaggccaattcttcacggctacaatcttttgaggatcaaccttaattccttcactagagacgatatgacccaacaatatgacatattcaagccacaattcacacttcgaaaacttcgcatataacttgtgctgatatagggtctgcagaactaccataagatgattggttggtcctctcgattccgtgaatatacaagaatgtcatcaatgaacattatcacaaaggagccgaggaaaggctagaagactcgattcataagatccataaagtcattcgttagcccaatagacatgatcaaaaattcaaaatgcctatacctggtcctgaaagctattttcagaatatcctgctccctgagcttcaattgttgatactctaaccttaggtcaatcttagagaaatacttggcaccttgcaattgatcaaacaagtcatctatccttggtagtgagtacttattattgaatgtgaccttcttgagctgccgatagtcaatacgtatcctcaatgacccatctttcttcattacaaagagaacaagtgcttcccaaggcgacacactcggctggataaaacatttctctaataaatccttcaattgttcctttagttacttcaattccatcggcgccattctgtagggtggaatagatataggttgcgtgcctggcatcacatcaatcctaaaatcaatctccctatcgggtgggatcctagggagctaatccagaaagacctccaaaaattcattcacaactggcacagacttaagtttaggtgcctcaacatcagtgtccataactcggaccaaatggtaaataaaccccttgttgatcatcttcgtggccttaaggtaagaaataaacctaccctctggcaccacatcatcccccttcagctcaataaatagctcatttgtgaattcaaaccttacgatcctagctcgactatcaagcttagcaaaacacaaataaagccagtccatccccattattacatcaaaatcaatcatccctaattaaatgagatcaatcatggtatcccgaccatgcatcgtgaaaacacaatccctataaacctatgcagccacaatggactcaccaatcagagcagatgtcacgaccccagttctccctccgtgaattatcgtgacgacacctagtctgtacaactaggtaagcctagcaattgcgaaaaaagggaaaacaaccgataaaacaatttaaaaactgcggaataagcataatgaaggtttaaagatgccgctcggcatatacaatacgactcccaaactaaaaacacattcccaaaatgcggaatctcatgaaatcacaagctattgagtaactacaagtgtctaactctagaatgtctaaacaaaagtaaatacagaagggtttatattataagggagaattgaaaaagactcctcggtctgcggacgcggcagatatacctcaaagtctctggagaatcgcctcacctcaagggtagtagggctgagtcaaagtacctggatctgcatatgaagaatatgcgcagaaaagcatgagtacaccatagcagtactcagtaagtgccaagcttaacctcggtcgagtagtgacgaggaaggtcaggcactactaagtttaaatgaaaaacaaggtataataatatagaataagatagtataattaagtgcaacagtaagaagtaacacaagatagatagaacaacaacaactacaactgagataaaataatcacagaaaggaatacaactcaagacagagataacaaccgaggatctcctaggataactttctgtagtcccaaatataaatatctagtagatctctcgggtgatgtcccatagtccaactcatagtgcatggggatctcccggaataccaattcgtagtcccaaatgtaaatactcagtactgggggaatctaccgggtgcagtcccgtagttccaatataaaagtgcagggggatctcccggaataccgatccatagtcccaaagtaaacatgcaaggggatctcccgggataccgtcccgtagtcccaaagtaaacacatagaaacaacacgaagaatacacaattcaattcaaatttcataccaaggtaaaacgagtatatctaatctagcatgcaacacataattcaaataaggcagtttgagcaagtaaagcaattaagtcaattagacatacttccctaagctaacaacatgcttaaattgcaagtagtataaacaagaaaggaaacacaattaaagttacttaatgaaaacatgattttcaacaattagcacaagtatgcactcgtcacctcatgtacaaggcatttcaaatatcaacaataccaaatcctaataggagtttctccacacaaggttaggcaagccacttacctcgaaccaactcaaaatcaacccgaaaccacgctcttgtcacgagtactcgactccaaatgacccaaatctattcaaatcaattgcattatgtaaatataacttcaagtaactaattacactaatcaattctaagctaatacgcaaaattaggaaaaatgaccaaaacgcccccgggtccacgtctcggaatcgggtaaaatttacattttcagaatcctcatacactcatgagttcattcataccaaaagtaccaaaatcggacctcaaatggtccctcaactcaccactcaaagctctccaattaacaaagccctaacccacaatttaccactgattttccttcaaattttgtgcttacaatgataaatatcaccacaataatgagcttaagggccaaagaccttacctctatgaatccctatgaaaatctcccttgaaaatgctctccaaaacttctttccgttgaaaatttatgaaaaataagccaaattagcgaaggaaatctttttatactttctgacccaggttattcgcacctgcggtcaattctcgtttctgcgctaccgcttctgcggtcaagggaaacgcttctgcggttttcacttaagtccccttcttcgcacctgtgacgtagaatctgcatctacggtctcgtaggtgcggcacacctcccgcttctactgttttagctgtcttcacctttggccgcatctatggcagtgatatcacttctgcgggctcgcacctatgttccttaagccacaggtgcggttatgacagcaaactcaatagcttcagcagcaaattcccaactccaaacttcccgttaaccatccgaaatcatcccgaggcccccgggacctcaaccaaaagcacgaacaagttatataacactatccaaacttataccaatcctcaatacacctacaacaacatcaaaacatcgaattaaccatggattcaagcctaagaactccaaaaactctaaaattatgctttcgatcaaaaagtctatcaaaccttgtccgaatgacctgaaattttgcacgcacgtcacattccacacagtgcagctaatccaacttccgaaaatctattctgacccttagatcaaaatctcactatcgaatcagaaacttcaaaaattcaactttcggcatttcaagcctaaataagctacgaacctccaaaacacaatctgaacacgcccccaagcccaaaatcacccaacggagctaatggagccaatggaattccattccgaggccgtcttcacactgctccaactacggtccaaattctaaaacttaaactctcatttagggactaagtgtcccaaaactctctaaaactccaaataaatcctcctgtcaactcacaatagtagaaacaaacaagggaaaaacagttaataaaggattgaggcattaattcttaaaatgaccatctgggtcgttacagtagatatagagaacgactcatgaagctattctggttctatcccgaattccatagcaatataaggagtgacatatgacaaagtggaaccaggattaataagggcatatacatcatgagattagacagtcaatatacatgtgatgacatctggagaagcctctgaactctggcgacctctcataacatagaaacagctggatcctctcgaactctatgctctacccctagctgcaccacgccctgtgggtgctggagtgcctcgagctagaagaggtaatgtggatgtggtagctgtagaactagccagctgtgccgtgccttgcccacaccctggtgggacaaacgacgatccctttgaatgtgaccccttaatccgcacccgtaacatataggtaggtccatgtagcatattcctaagtgcatctttccacacctagggcatgggatcctccgctgctgctgaaatctccctccaagcggaccttgctggtaggatccccggttgccctgactgtgcctgaaatggctccactgttgctgattaggacctgatggaggtgacctaaccaaagactgagcaaaggactaggatggccctgatgaccctcctctaaatactaaccagccaccaccaccaccaccaccaccagaagaaccaccaaagttgcccgcatatagggccttattgctgccctctcgctctattactagtttgactttcccaataccaatatacaaaccacaccatgtctatggatccactaatagatacaaaagagcactatgaaagtgtcgtcaataaggccccggctatgcctcaaacaaaatacacgaggaacaaaagatacatgaccctaaaatgaagtggggctcaccaaatttgctaggaagagggtgtaccgctatcactgatcaatgccacctgctgtggaaccacctgcatccgttaaggatgcaactctcttggaaaaaaggacgttagtacatatggaataacactagtatgtatgactgaacaccctctcaatggaacaagtaataatacaagaatggacaattatagaatcaatggaagtctcaaacaataccaaaacatcaagttaggaacaagacaagtttccaagtaaatttccatattttaggttgggagatctttcgtaccgatataccaccgtgtatttagcacatagtccaatcgcggatcgatcgtctagggcgtctcacccaatgtcattcaatcacaatcacaatcttaatcataatttcaagcacaatcactaccatgtttgcggcatggcatttgatctcggcccgatcgactaggccgtctcatcacaatgccatgtgaatcgacatcacccttttctatcaatcatctcatcccaattaaggggaataatctcatcacaacaatctcatcccaaataaggagaataatcacaatccattcctacaccggcacatgtagtttcgaggttaggttatttcaacataccctttctcaatgacaaatgatactcccaaaaatgtttattaattaaaggactttcagctcatttcataatattttacacatctcttcatttaattggcactagtggccccaaatgtaatatcattcttggcatgttggccgtatttcatgctcagctctttcactttcaaacatcatcatgggttataaacaacaaatcatttccaatcacgactttaagtacatatatgagaaattaagagtcttaagcaacttgagatttcttccacagtttggcataataactttcatttgaaatatgactctaggtcataatattttaatacacaacccatactttgaacacattttctaaggataacataacatgataagagaatctagaacacattttgaacatatatctttcggcacaaaatttattcgagatagaccaatttatattgaataactcgggatatgagaaataaagaattggtacatcatacttgagacttacgagaacatcatgggattcaattctaagagagaagtttagccaacatacctcactttaatcttttcttaaattactataatgttccaaaaatccaagcaatcccaatctattttgagacataacaaaattgaatgcaaattaggaagatattcgtggtttcagctcatttgagcattttatcaaacaataggtgggcattataatttcaaggtcctcctatagtggattccttcataccatgacccaaagtctagccacttgagctcaacaaccttcctacaaaccttgatagtacatgcatgcataaataacatctcacacccaagaatcacactccccattaaccatcttcatccccaaactcgaaattaaaaactagggtatggaaccttatctcttagatgaagaccttgtaagttttccttgtgaattccctaattcttgagcaaggattgatgtaaaattagcttaggggtttctcctctcactctatagcacttactctctctaaaaatatcaaattttttcttgacaaatggtcctttatgtctatttatcaaaataggatcgggttataatatcgaaaaatggacctcccgatcttaactctgcagtcgcatagtggactgcaaaacaggtatgcggtctgcacaagggactacaaaaatcactctccaaaactgggctgctcgggtcaggtctgtagcgggtctgcggccctcagaccagttctgcggtcgcataatgtgccgcagaatctccctctagaaatcttcttgctggttttgcgatggattgtacggcccgcgaaattgttatgtgaccgcataatggtcctcaaaatttgttcaattttttatttcactccacggccgttctgcgatccacaaaatggttttgcgttcacatagtggatcgcataaatgccatgttctacgaaaatcatttcttcaactccctgacgcactgtgctcgtcgcgaataatttctactatcctcaaacacattagcctccctcggtaccatgaaacctcgggtactagtaaaattgtatggggccttacatcctcccctacttaggattattatcctcgaatgagggtcaaatctaccattagcatccaccgtggccgaattattatttcacacgtctagtggtatcaaattttgactaactccataaatatgcaaaaatgttgccagcgtttcccctgtagctgggcctatccacctgtcagagattcctagaaacaaatcctaacaatatatacataattcaacgacgtaacataacatgaaaacaacaccaatggtggcctcataagcaatatattaccagaaaggaacaaccttagaataaactgtacaagtgacacataattcatagggaacaattttatagaaacaattacatagctattcaaacaaatgagggtacttcttcttcatttcttccctggcctcccaagtagcctcttcaacctaatggtttcaccatagcactttcgtggaggaaatttctttaattctcatctttcggacttgcctatcattaatggaaactggaatatcttcataagtcaattcctcattaacctcaatagtctcaactgaaataatgagtgccggatctccaactaccttcttcaacgtagatacataaaataccgggtggactaaagacatttctgagggtagctcaagcctataagccacctgaccaatcctctgaatgatcctgtacggtctgacatacctcggactcaatttccctttcttaccaaatagcattatacctttcatcggggagaccttcaagaatacccaataatcctctatcaactccaaatatctatgacgcacatccgaataggacttctaaccactctgggtagttttcaacctctccttaagtagttttcagctgctccttaatgatcttaaccttctccatagcctgatgaacgaggtctgaccctatcaactctgcttccccaaacatattagcctctctcggcaccatgaaaccacgacttctagaaaagttttacggggccttaaactaacatgccgaggagaatgacccgatcccataagagtagtgttaccacactgccgaggtgaatagacagatcccataagagtagagaagtttacctcgttcgcagaaacacatacgagacgagaagacacagatctatagtttatcaaatattgtccaatttttccaaagtaagaggataagtcgatatatttattaaaatcctttatctcagttataataaagaaaattaacacacatgataggcataaaaagcacaattaaaggcatgctatgaatctaagtctacccgaacatatcatgaatatagctacatacagactctcgtaacctcgtatgtacgtatttccccacaacaagtatcacataaccattaatacacctaaggggataagttccctcttacaaggttaggcaagagacttaccttgatttcaaatcctcgatctggctcttcaacctcattagaactcctcaaatgacaccgaggactccggaactaatcaaaagtcatatacaataataaatatatgctcaaaagttcataattttgctattaaattaatttcccaaccaaattcgggaagtccataaaaagcaccccggacccacatgcccggatatcaaaatgttttgaataaaattgttacccataacttcacgaactcagatatataatttattcccaattacattatcaattttcgtggtcaaattttatatttaccaaaccataggttccaacaaaatcccacaatatttcccttaatttcatgttaaatctactcataatccgtgtatttaactgaagaattgatagggatcacttacatcttgatgtttatgaaaatcccccacaaaatgctcttaaaatcactcaagaccaagtgaaaaattaaagaaaatggactaagtcccgtattaaaaatcaagtctgcccattgatcccttcttcgtgatcgcgaaaaatgcctcacgattgcgaaggccaaaaagccactgcccaaaaaccttctttgtgttcacgtcccgacggatgcattcgcgatacatcactgcccggccttccatgttcgtgatccccaagtcacattagtgtaggctaaaagcctcctgcccaatttcctccattttctcttcgcgatcgcggttggacctccacgttcgcgaagcactgccaagccaacctttgcgatcgcggacccttcttcacattcgcatagaaaaataagctgcacctccaattttccttcttcacgatcgcaggaccatcttcgcaatcgcgaagcacaccaacgcaccaatagtgttcatccaagttcaaacatgctctgggtggtccgatacacaccttagccacccgagaccctatacaaatgcaccgttaagtccataaacacatcgtggacgtacttgaagcctttgaaaatataaaacaacactagaatcaagaatcacacctcaaacctcattaatcaacttctaagcttcaaactcatttcaaccaactccgaacgcgttgaaacatacttagacaactcggaatgatgccaaattttaggcacaagtcataaattatcatacggacctattccttggctcagaatcccaaaaggacctcgataacaccaaggtccactccaaaccaaatttaaagaactagaaaacctttaatgaactaactttcaacattaagtgccgaaacatccccgggtcacccgaacctcgattcaaagacacatcaagtacaaaattatcatacaaacctattgaaaccatcaaatcctggttccaatattgtttactaaaaatgttgacccaagtcaaacttgaccaccttagaccactattaaggaactaagtgttctgatttcaacccgaacccttccaaacccaaaccaattatccccacaagtcataaaatagtaaaagaacatgtaggaagtcttaattaggggaatgaggatctaaaaagcaaaactattagtcgggtcgttacattttacacttttaaacaaacgttcgacctcgaacagatctagaatcatacctggagtgctgaatagctgtggatatctgctctgcatgtcctccttggtttcccaagttgcctcctcgatcggttgaaccctctactggaccttgactacaacaatcttattatacctcaactggcgaacttgcctgtcaataatgacgattggctcctcctcataacccaaactctcatctagctgaaccgtgctgtaatctaatacgtgcaacctatcagtgtgttactttcagagtatagacacatgaaagaccggatgaacacccaataggctgggaggcaaagcaagctcataagaaacctcctgaacttgcctcacacctcaaatgggtcaataaacctcggactcatcttgcctttctttctgaacctcatgatacccttcatcggcaaaactttcaagagaaccttctcgcccaccataaatgataaatcacacgccttctgatccgcttaactcttctatctagactgcattgtgtgaagtcgctcctgaatcaacttaaccttctccaaggcatcctttactaaatcaatgccatataacttacccttgccagactcaaaccatccgatgggtgaatgacatctctgaccatataaaggcttaaatggagccatctcgatgctggactaataactgttgttataaataaacttgtcgaagggcaagaatcaatcccggttccatcagaagtcaattacacgcactctgagcatgtcctctagaatctgaatggtccactctgactgccggtcagtctgcgagtgaaaggccatgctgagctctactcaggtacttaattagctctgttctactctctagaaatgcaaagtgaactgaaggcctatatctgatatgatagaaaatgatataccatgcaatcagacaatctcctaaatgtaaatctacatcaacctatttgaagagtcagtagtcaccaccagaataaagtgtgccaacttggttagcctatcgacagtgaaccaaatgacatcaaacttcctcaacgtccgcgacaacccaactatgaagtctatagtgatgcgctcccacttctattctggtataaccatctgctggagtaggccaccttgtcctctagttctttgataagtggggattttgactgcttattagtgccttttagcttttgttttagtctaaaagcattgaattgtattcctgaaattgatcaaattgtgcaaaattacaagaatgatggaaactgagctcccgagatgaaatccgactaaaaaaggagtttccaaattacaaggcaatgaaaggcacaaaaacataaaagtgcggtccgcagaagaaatttgtggaccgtagagtaccttctgcggccgcaagacaagaagaacaacttttgtagagaattgtgcaaattgcggaccgcacatgaattgtgcggccgcaaaaatgtgttagaagttgaagatcagagagtgtgcaaaaagaccaagtccagagcttatgagaattacggactacacaaaaattatgcagccctagaagaatgccttgtggccgcatttctaaatctgcgaaccgtagaagaagtgtctcgcagccgcagttcagaattgtgttgtcgcagagcttcagttcctgttaaatgaagacatctgtagactgcacatggaattgtgcggccgcagaatgtcccaaggggaatttttgtccgagattttaatctttgtataaatagatgtgtttcacgaaattaggtcaagttttgaatctctaaagtactgtagccatttctctttgctattttaggaaactttagcttattttggtaatttaacattatatttctctattttaatcttctaatatgagttttattatcttttcttctttgttttcttctacacccgttatgagcagctcaatttttactagggttatgacccaaccctagtgttgaaaccatatgggtgattaattttatattcctttatgattgagtgtttattatttagcttagttcatgcttaaattgtagaattaagggttgcaaaaattgattcaagcctatttgacttagtatcttcttgagaaagagagacctagtctaggataacttagctaacaaaaaattgggtcaattgagagattgattaacctaattaaagggttcaatctagagatagtaacaaaccgtcttgagcttttaccaaccgttttggtagatacccatttgctcttgagaaaaccaaactaggtaaaatcactctctgatcgagatgtatcaagtgggaaacgtagtgttgtgagctataatacaccaattaacaaaacaagcataaatatctttatcccattaggcaaacacctaggtcatggtcacagctctagaccttttatacttttgaaaaaacccgcaagaacaattatctctagttttatatcttaaaatttgcaatcattagcttaattttagaagtagaaacaaaaaacctatttgtgtaagtgcaatctagatacttcacttacttattccaaatatatactaataattcccatcttaggtccttgaggattcgatcccgactctttattgcgttttattattgcaaacgaccatatcgtacctctttagagtcgtgcatttgtacgtgatcatgctcatacttaacctactggcaatttagaaatctcgctacatactcaactatgtccttcttcatccaccccatgaataatattgcctcgggtagcggtacatcttcgtagcacttggatgaatagtatattgagaactgtgcgcctcatctagaatattctccctctagccatcaacattaggaatacataggcgaccatggagtcacagaacaccatcctcaccgatagtaacctccttggagccaccctgtactaccgtctctctaagaaccaacaagtgcggatcattgtactgacaagccttgatccactcaagtaataaagactgagccacaacatatgcaagaactcgattgggctctaaaatattcgacctcacaagcctgttagctaaggactgaattgttacatcccatatttttgtatgttagattacttcgtaagccaattgatataagctcggaaatgagatcatctttgtaagtacataaagtaagttaaccatgttaaattggaggttataaatatttaagatcatgatttgcaagtaccaagagggttggaaggcttagaagctgaacgaatttaagaaaatatgttttgtcgaaagtcgacaagttgggaatgttataacatgtaattttggagtgagactagtgtgctcaaaatgataagaaggttatgttatgagttattttagtcttatgatagtcgtgtgttatgttttgaattcaagcgagttgtggaacaaaagttggcaaaatcatcacaagttacattcataaatatgctaaaacttaggtcaaatttaggtgatcatttctcccaatatacttgaaattatgggatgatctacctatcaaattgaatatctatgaatctagtttccaacagattaaatcgttcattgatataacattggattagagagatatttgcgtttttgcgagactgcacagacttaggtgacaagtaagtgaatcacctacttaccaaaaggataggcctcaattaaaagctcctaaagtcggccaaaatgggacttttaagggcttattaactcattaattttattcatctttcagaccaagaaaactagtttgaaaccctacaactcctccccaaaaattcacacaaatcctaggttatttagggtgttacaatgtgattctagtgccgaaaacaacttgctagtttctctttctccttattgtggccgcattgggggactgatttttgatgaagaagggataggtttcatgggttctatgaattgcaagataaatttatgcgtctcctcctattatatatgtttgtacgagttgtaactcaatcgtaaaggctaaacctagcaagtttcgaaagagtggtatgctgtttgttattgcatcacaattggctggttgtaaacatatttttatgttgaattcatggttgtttcataggataagaggcttaattatgtattttttattgtgttcctcaacttgaaagaaaagacaattcgaaacgtgttttagtaaactgaaaaatcagttttgcgttgctgaacttgtgggactattttgtaggttgttttgtgttgctgttgggttgtctcttttgctactatttttatggagtttgggaggagaaagggtgtggagaaataccacataatggcagggtggttgtctgatcgttcgttgttacattttcaggttgtttgacactactagggttgtcgttttgtgtatgaactgattaggctgtgtgggatattttgtggtattttgtgatggatataaggttgtaaagtgatgtatacatgtttttattattgtgttcttgttgtttttggtgttatgtcaaattgggaggaagcaaaaattatagaggagttacttcccgttttattataaaattatttgtcgttcgttgtgcgatagttataccttctataacttgattatagtattgttattgttgttgtagattaaggtggaacgagacaactttaacgtggtttttggataggtttgataagatatgttaaggctaaacctttcctttattttggcatgatcccataactatatgtgtttgataactagacataaagagaagttcgtattcctaaagttatgtacattatcctagtctcataagttacagtattctcctatatcgggactttatatttagtttagtattgtcgtctttcagccaagagagcagagagtccatatatattcagtattacaatattttcactaccaccgagctatattcggtgggcaggtccttattgggcaacctctaataagatggtaagttatatactgagcctaatatggccgagcgcctatgaagtagcctatagtgacctatatacaaatcctagtatgtccgagcgcctatgagtaagcctactacggtagagcagttatatgtaccgagccttatagggctggacatctatttaattgctatattgagagagttaagtcagtgtcatcatgtaagcatatcttcagatcatctttgactcccagttactttcagttattatattatcagttcagtttcaagaacaacaggtaagggcactagtacagagagaattattgataatgtagcctagattgaggccctatcagatcttgcatacaaatgtatgtatttcctacttaataccctaagacgggaatatctaacataccctaaaaatagtaggccatgggagtattataaggtaaaagtataagtttcaacaggtaacagaagcaaggtgaagaggggtactaggtacccagttaatgaagattatctgaatatccaatttaggtggagaaatataaggattctaagttaccttcaatagaagtagaggtatgtacaatttgccacacccatctcagttatgtctatgggacctaacatatataatttaagagaaggatgtgatatcaggatccagcttgggttagagtaacccaaaatggtggattgagccagatgagctaagagtgaaacaatgttttgttgaagttttcagaataatgtgatagatcaaaatattagcaggagaataaggagagaataaatgaagcattatgagtaaggtatgataaatgagtgataacggtaaatcaaaatatagtaggatgacatagtctatggtgaagtgaagaaaactacaataggtgacaagccttgagacaataaaagagtataatccatgaagttatatccttattttaagaaaatgagttggcgactccaacgtaattaccagaaggctaagttagaccccctcagagtaataacaataagcataggctagtaaacaagataaaccgaacatgaattatggaccagaggatttgataatagttggcatcatgagaatttctgagaccgtgttctggtaaaaataggatggacaacagaagaataaccttttaaggtcattcaagagtatgcttccctaaagcaagcactatgaatatagttaagcttaagggactaactgtgccaattacactaggtgtcaccattgtgcgtaaggaatttagatatccttggcatagaagggttacaacaaggcaagtaagagtcagtaaagacgtgaaaagatgccgaagatgaacatgtaaaatattttattggtaaatcttcaaagcattaaacgttattactcccttaaagagtggaagatggtgtgatatggtattattactcccttaaagagtggaagatggtgtgatatggtgttattactcccttaaagagtggaagatggtgtgatatggtatttagtcagagttaagtcgttcaagtaactatggaatagtaaaagaagtatgcggtaaaaagggcaaaagaaatgatattgcatttattcagatccaacagatatattacgactccagaagattatgcaaacacaataccggggagaggcggtaagggttccccactaggatgttattgataaataactgtgaattgacacttgatacataaggagccagtgaaagaggtaagttaagacaaaggacataacgcaagagagattacgcagaatataaatatgagcatggaccaacaaatagttaatagttgattcagaaatggcctagttatgtctatataagaggatacagataaatcagcggatcatgcaagctacgacatcataatctttgagaattaagataaacctagtgaaccccaacatagggaattaagtctcgcagatacgacatcgtaatccttgagaattagtcagataagagttgagatagttatagttgtcatatatgtgttagggatgttgatacccaatttttccggtattttttatatataaaatacctttcaaaatagcatgtattacatacataagtatgtcccaaggtcctgttatttttctcaaatttttaatgattttaaaatcagttttactgccctattttatcaagaaaaacccaataagtgttcccaaaattggcattttggtaattcatttattggattctcatatttatactaaaatatagctagtatgattttttcacatttttaaaaatgtatttagtattttaaaaaaagaagctaaattgcatataattgcaatattagtctactttaagatttaattgcgtttataattacaaaattagctccagtatttttagtctagtatttatatattattaattaatttagtacctttaatttgtttccagaaattattttactattttttataaaataaataagggaaaatggctatttaaatgttagcctgtttttacttcgattttggccagatttggcacccctattccaacacaatttcaattgcccagcccaattcaaaaattacccgacccacaaccttgaaaaaataacctacttggccctcctttaaatcccagcctttgatctaacagatcaatgactcacgttctccctttcctttttaatttaccaacaccccaagcctaatcattttgtcaccagtagccgcctttgaaacctccactctctcaaactctctcaagtcttcttagaaccataaccgcctcttaccgctttcaccctgaaagccaccagaatccatggcttccagggctgtgagagtcttatacctacctcttgttgctcttacacacctgatctctgaagattcaaggcttgaccttgaaggtttgtacctagacctctatcgattcgaggttctacgaccatctctggccttgctccagcgtaccatggttgtttgagcctgatcctgacctctcagactcagatcagtgacttttcaaagcctttctcatttctagggttcttctgaaaccctaacccttcgagattttccgattcccttagatctgttccggatccatgctttccttaaggtcttaaacgttttcctgacttttctttcaaaaaactactttcaaaatctttcttttccgatctagggttttctgaaagtatttaagtgttttctaactttctttttccttttatgtgtatttgcttctactgggttcttgtattttcttctaccatgttcttaccttcttctgctgtattttcctatactatgttctcgtatgctcctctactgcatgatttctctattgtgttctgatatgtttatcctactgtattttcttactatgttcttaagtttgcttattaagttccttttactgagttctgtttaaagattcttctaaaatttcttagcatgcttcttctactattcttatcattcttctctattatgtttcgtattagcttcttctactcttattttctttgaattctgctactatgttctgtgtgttacttgatatcattgtgttatcatgagtttctactgttaaaagaaatatgcaagaggtttcatagaactgaaacctctgagcctgtttcgattacttgccttttcatctctatacttgattcaaggtggaaaccctagaattcgggggttctgccaagtttgattatgtgatttaattgaactagggtttttattttagaacccctaactctttcggaccaacttcgagtctctgaacctagtttggacatctgtgtttgcatatgattctgacctttggctaaactcttctaaaactctttcttcgctttatttttttttattgatttttgcaatggcacaacattttctttcaactcaatgtgtttgtgtgctctttatatgtgatgaatcttcctctaaaaaggctttcaactcgtgattgattcaaattccttctaaataggtctgattgattccctttccattgtttgctgatttcccttaagataaaaaacctttcccatctttttgactcggttcattcatacaagatccctgacctttgatttactgcttgttaactgattttcttgccttgtttgagcaaccacatatttcaaaaattctgtccttaaataacctttatgtatttacctttaattgcatgttgtgcacaaagtgcttattcatttttctttccttaaattgtttttacctatttgaatatgaatccattaattaagggaaatcttgtgtaattgtttgacaatcagttccttgactattttcttaccttatttcttcatgattttcacactataaaaggcacgaccctttttcaaaaagaggacatcagaatcctcctgaactcatactctctcacaataactttctcttcttgtctgtattgtggcctgtttacaagacctaatacttttctttgtttgtttcctttaaaactgatatgtcctgatttaagcttcagcaccacaacaatgtgtttatttacagtctttgtatccatgtctactttactactttctgtagagttcaacatttaaattagtatgcttatgtcctactgcttgtttctgctatgaatcatcgcccctatttccctttatgtggtttgagttacagtttaaaacatggcaatatgcaagttattgtctatggattgaacttgatcccttagaggatcctaacctctaaacaatatgttctaacaggcttatgggtgtgccagcatttcccattgcagggtatgcccactagcctgtcttttcctatttatcacctccccgttccctatacccctatgtgtattaatgtaaattgtttcccttcccccttttcagaattctgcacttgcaccctctcttagtctctaagttctgccccctcttgtgagccttgccttgggaccttgagttccctctgaacttggacacttgagggctagcccttccacaatgcactatgtcttcatctataatgtatttgggtgtgagcattgcccggagtccatatgaggctcttagggaactctagcacatccaaatcggagaaaggctttgaaataagatctcttggagttggtttacttcatacttcagacaggaagtctgaatcaggctctcattggctgtactttttctgattgtattttttctttactttactctttctgggatgtaataactttgtaataaaactctcggggatggctagtgaaaagggaggggtaactatgtatgcaaaaaggggtagataacctgcctataggagtatgtgtaagtcatgctatttgcttgctttctttgtttaaaggaggtctgtttgagccttttcatttgtttatatgcttccccatacttgccatatatgttttgtttgtcacctcagtatttttaccttttgaattcacaagtaagcccaatatcgctcccctttaggattagtagtcccaaatgcctccgggactgataggattggggtgggtaatagtatgcaataagtaaactagaccattccgcagtttaataccttaaacagggcgggaagggtagatatggatatgatgaccacacggtaacatcacgtgtagcccctcactgaggagtgattaccagatgttgtgtggggtgatccatattattaataaacctaggaccccctcctttcttttgtttcttccttttaaaccttttaaactgtttcttcaaagtcaactcttttagttttcttacttgtaaccctcatgtgcaaaatcccctcttatttgaagtcttattcgcctacgtgttgtttgcgcttaaagtcacaataattgtctcgccgggaaccacactagtgcatccagaggggtgcctaataccttcctcttgggataatttcaagaccttacccaatatctggttgttcaaatcaaacctttcttagtgtcttaatgcacttaaatcattaggtggcgactattcaattcaaacccaattcccgaaagggaacgagttgtcctcccaaatgtcataaacccgatttcgcgagaaaaagagggcgcgacagcgtggagactctgcttgggacttttaggtttttaccatttcagactattattgtgaatttatgtttctttatgcgtacttatttgtttatttcttttaagcattcaatttccttttcgattgcaaaactgacttgtctttttgtttcttccctttattactttcctttactgctttcctttactaccactttaagttatgaaaagctgttgtatttactgctttcctaacgtgctcccttaagttgtccgcttaagggtaccagtctaaaaccccatggaaaccttactctgtttaactgtgcatgtatcatggtcaaacctagccgggtcagttatgttgtccacataatgaccctttaagatagcattgtccaaagtccactaggtttccctaaaacccaaacggacatcatcatgttctatgcatttatttggagaactagatgcgtttatgctgattgttgatattaaattgacgagtctggtaggggtaagggcctaacccttttgttttgcagaaaatgaggcacgaggtgcccagttttggtatggctagcataccctaactcttgctagactggtggagaagtcttccatcaaatgaccaaatcaacaagtggaaagagagggccgccaaagctagcgaaaagttgaaatatctagagtacagtctactggaattggaaggaaaagtgaggaagagaatcaccgactgctagagcaccgagggaaatgaaggagaactcctagcaaaggcatgtttactggtgcacctatgcgaattggaggatctgatcaacgagagcattcaacctgaggaaggtccttccgggacaaagtagataggagcttgttcttttgctttaagaaatgtaataaggcccatggccattagtgattttcatttcttgtttatttagtgtcgatttgggattcgtctactttttatcaataaaatgaggcatttagcattctaagttctccaaatcaacttatcactaggcctatatcgagcacaaagaggttcccaaataggacacgatttacattcttccactatgcgtttaaatatcgcaacattttcttataatcctcactgacttgttacttttttgtttttactttttgtttatttattcccatcccaaaggttagtttgtgcaatctggcatcgtcatcatattccacaagatcaaagggccatccacccacccttcctcctagtcctatcagaagcaggaacaaagaaaagatggaagatttgaacaacaccagaaaggaaaacacaactgaacgggtagaggtcactcatggtgctcaggtctccaaacaaagtgcgtcccaactcgagcagaaactgttgaaatttcaggaggaacttgatcaagttcggaatctggcaaatttgtcatttttgctcaccactccagctatcaattttccaaacgctcagaaccccacatatccaaaaaacatcccaaaaccacaaaaccatcccgctcctcaccaccactgccatacttgccacacatccaacaatactccactgctcatccccgaacctttgaattccacaaatgaccatttccacgctcatcataacacccccatctacgtggaaaccatgccacactccacccaacccatctcaaacatacccaagtctgatgataaagactcactcatcaggaacctggttgtagaactcaagaaattgactagtcgaattcagggtgtcgaaggaagtaaggggattaaaagggttgaactacgaagatctttgtatacaaccggatgtcaaactacccgaggggtacaaaccacctaagttagaaatgtttgatggtacaggggatccgagagtccacttgagaacatactgcgacaagttggtcagagtagggaaagacgaaaggattcgcatgaagcttttcatgaggagtctgagaggatatgctctgtcttggtacattagccaagaaccaaagaaatggtcgaactgggtgagtatgacatccaactttatggacaggttcaggttcaacacagaaaatgcgccagatgtgttctacatccagaatttaaagaagaagaccacagaagcattctgcgagtacgctactcgttggagatcagaagctgctaaagtcagaccggctttagaagaagaacaaataaacaagtttttcgtccggactcaagactcatagtactatgaaaggctgatgttgattgagagccagaaattttccaacatcatcaaactaggggaaaggattgaggaaggcatcaaaagttgtatggttactacctttgaagctttgcaagctaccaataaggctttacagtatggcgatacgtccaagaaaaagggacgtaggtgccataatggttgcacaaagagccaaatcccctatcaaataccaagcctatcctatacctccactcacatatcagcctaccccgaattaccaagaaccttaaccctctcaccaaactctaccgcccacttatcaatcatccccacctcctacatatcaacctacttcacccagatattcccaaaccacacatgtctaccaagcctacaattctcagccatcccactatcaatcacctcccacacgttaaaacatttcaagacctcgaccaaatttcaaccgcagaccccccaaatagtataccgccattgctgagccaattgaccagctatacgaaaggctcaaagctcctggttatatcacccctatccattctataacccatgaaaacccttctcaatgggttaatccaaataaatcttgtgcataccattccagcatgaaaggcataccattgatgaatgtcgctctttgaaagacaagatccagactttgattgataataagatcattatggcaaaggagcctactccgaatgttggcaacaaccctctgccggaccataagggtggagatgttcacatgattgaaatagaggatgattgggatcccaaaggatcgatcggtttaatcacagaaggttacaaaccaaaaaagccaatagtcacccttaatcagattgtagtccatactcagccttctagggatgccgaggtaaacatgtctgtaccacttgagtttgaagcaccaccccctacaaagacgccaacaccaatttaggtcaagtttgggtttccatcaaacacaccagcactgtttgaagttgcggttttaccctccaaaattcatgctccattcggagtaaacgtgcccattccagtagcaatgtcggtcataacaccgtttcatacaaatgccataccttgggattacacagccgaggcgagaaggaaagggaaagccaattttggggaaacagttgcggcacagggtatgacaagaaccgacagggtttatactccggagcatttagctgagtcaagtaagtaggcctctggtcagccgaccatcactaaaaccaggctcgatgatctctggagaaagatacaagccaaggaatactcagtcattgttcagctgaaccaaacactggcataaatttctatcctagctttgctgcaaagttccgatgcacataagaataccttgttgaaggtgctgagtgaggcacatgtaccaagaaaaatcaccggaggagaaatggaaaacatggtagggcaggtattagaaagtcacaagatcacttttcatgaagatgagctgccaccagaagggttgagtcacaacaaagcattgcatatcaccgtgcaatgcgaagattattttatcactaggatcctgattgatggagggtccagccttaatatttttccattggtaacactcagaacattgggaaaggggctacatgagatcaaggatggggccatcaacatcaaagctttcgacggttcccaaaggtccactattggggaaattagcttgtgcttgcaaatggggcctacttggttcgatatcgatttccaagtaatagatgtgccaacatcttacaacttgctattgggatggccgtggattcatgccgctggggctgtagcatcaacactacatcaggcagtgaagtttgagtggaatcaccaagaggtgatcattcacgacaacggtagcaatcccatatacagtcgccaaaccatcccagcaatcgaagaaagaagaaaggtaggcggggaaacctagcaccacatcgagcgagtcaacgccgttgacaaagacaaatggtgggacaacaaaattgaaagcatattgaactggagcggatatgaacctggcaagggacttggcaataacctccaaggaatagccaagcctatcaaactaaagaaacatggcaccattttcggtctgggatatgagtatacttgggaggaattcaacaactggtcgctactatggcgcgtgccatactacccgctggagtagccaataccacatttggagcagactttccagccagccgatattatctatgggtcggatgaagaagaagcaccggaagcagagaggaatttgttcctagaagacgatgatatggactgttgtgttgttctcgaggaggagggggtggaaggcccttccatacaggccataagtcgaggagcatgcttaacaattggaccatcagaaccaccagagcctggaaagcctcgggatagcaaggctgaacaaagcatcatgcactatcttttatttttactatttgattttccttttgcattttgaattttcgcaataagatcttccaatgttcaaaacagttatcaaatttatcaaagcatttcggtttccttacaaatcttactcttattatttcttctcattactttatttatatagcattactattacctatcttgatgaaccaatgactgtgacatgaaacgagacaacgcaacaaacagacatagattcagaggaagatgatataccagaagagattgttaaagaagtcgagaactttgagaataggccaaagtccaacctggacgagactgagattgttaacctgggagatgcagaaaatgtcaaagaaacacgaatcaacattcacttattaccgtcagaaaagaaagagtacgcagaatttctaagagaacacgaggacatattcgcttggtcatattatgacatgactggtttgagtacatctattatggcccacaaactgccaactgatccgacatgtccatcggtaaagcagaagatcagaaagttcaagactgatatgagtctgaagatcaaagaagaagtcactaagcaggtcaaagctaaggttttcagggtagcagaatatccgacatggttagccaatattgtgccggtgcctaagaaggatgggaaggtcaagagcctgtgtcaactaccgggatcccaatcaggctagtccaaaggacgacttccctttgctgaacatacaccttcatttacatcttgcatggctgaaatatcgccacttcatttacatcctgcatcggctgaaagatcgccacttcatttacttcttgcatggctgaaatatcgccactttatttacatcttgcatttctgaaatatcgccactttatttacatcttgcatgactgaaatatcgccaccttatttacgccttgcatcggctgaaatattgccacttcatttacacttgcatggctgaaagatcgccacttattgtatttcatgggctgaaagatcgccacttactgcattccatggctgaaagatcgccatcttcacacttgcatggctaaaatattgttgctttattttatgtttgtatggctgaaagatcgtcacttattgcatttcatgggctgaaagatcaccacttactgcattccatgggctgaaagatcgccaaaattgtccaaaggcatcattgtttggaggcaccattttcatagcccgagaacgccatgcctggcttgaggaccccttttatcttttgcatatcattattcaaaggcgtcatagtttggaggcatcattctcatagcccgagagcatcatttcatggcatgcgaatcccttatcatacgcttcatggcccaggacgtcatggtttgaggacgtcatcctaaacgtccaaagacaacattcatggtccaacgggaacttgcatcacatttaaatttccgcacaatatacacttgtattgcttatttgcaggtaaaccggcaagcaacgaccgtctcaataggagcaatcctgctccagttcccgctgccctattagactttaaccatccatcccaacgcaaatatcgtgtccgtcttgaaaaatctccatgggcatattccgccgacggatcctgaactacatatggcctgattcttgtaacaccagagatatgtaggtagcttaggagccagagctcggtaaaattcttcaaaccattccgttcggtcaaattggccatcatatcttcacccgacaactctttcatccttctcgggtaaagaggggcagctattgatacctaattttttcctatattttttatttgtaaaatacctttcaaaatagcatgtatatacatatataagtatgtcccaaggtcctattattgttttcaattttttaaagattttaaaatcaattttattgccctattttatcaagaaaaacccaataagtattcccaaaattggcattttcataattcatttattggattctcatatttatactaaaatatagctagtaagatttttgcacatttttacaaatttatctagtattttaaaaaaaagctaaattgcatataattgcaatattagcctactttaagattaaattgcgtttatatctacaaaattagctccaatatttttagtctaatatttatatattattaattaatttagtacctttaattttttttgcagaaattattttactattttttataaaataaataaggaaaaatggctatttaaatgttaacctgcttttacttcgattttggccagatttgacacccctaatccaactcaatttcaatttcaattgcccagcccaattccaaaattacccgacccaaaacctttaaaaaataacccacacaaccctcctttaaatcctagccgttgatctaacagatcaacgactcatgttctcccttttctttttaatttgccaaaacccccccaaccctaatcattttgtcaccagtatccgccttgaaaccctccactctctcaaattctctcaagtcttattagaaccctagccgcctcttaccgcttccaccctgaaagccaccagaatccatggcttccaaggctatgagagtcttatacctacctcctgttgctcttacacacctgatctctgaagattcaaggcctgaccttgaaggtttgtacccagacctctgtggatttgaggttccacggccatctccggccttgctctggcgtaccatggttgtttgagcccgatcctgacctctccgactcagatcagtgactttttaaagcctttctcatttctagggttcttctgaaacactaacccttcgaggttttccgattcccttatatttgttccggatccatgctttccttaaggtcttaaatgttttcctgacttttatttcaaaaaactactttcaaaattcttcttttccgatctagggttttctgaaagtatttaagtgttttctaactttctttttccttttatgtgtatttgcttctactgggttcttgtattttcttctaccatgttcttacgtgcttcttctgctgtattttcctatactatgttctcgtatgctcttctactgtatgctttctctactgtgttcttatatgtttttgctactgtattttcttactaagttcttaagtttccttttactgagctctgtttaaagtttcttctaaaatttcttagcatgcttcttctactgttcttatcagtcttctctattatgtttcgtattatcttcttctactctatttttctttgaattctgctatgagtttctactgctgaaagaaacatgcaagaggtttcatagaactgaaacctctgagcctttttcgattacatgccttctcatctatgtacttgattcaaggtgaaaaccctagaattcgggggttctgccaagtttgattatgtgatttaattgaactagggtttttattttagaacccctaactcttttggaccaacttcgagtctctaaacctcgtttggacatccgtgtttgcatatgattctgacctttggctaaactcttctaaaactctttcttcactggattttttattgatttttgcaatgtcacaacattttcttccaactcaatgtgtttgtgtgctctttatatttgatgaatctttctctaaaaaggctttcaactcgtgaatgattcaaattccttctaaataggtatgattgattccctttccattgtttgctgatttcccttaagataaaaaacctttcccatctttttgactcggttcattcatacaagatcattgacctttgatttactggctgttaattgattttcttgccttgtttgcgcaaccgcgtatttcagaaattctgtccttaaataacctttatgtatttacctttaattgcatgctgtgcacaaagtgcttattcatttttctttctttaaattgtttttacctatttgaatctgaatccattaattaaaggatatcttgtgtaattgattgacaatcagttccttgactattttcttaccttatttcttcatgattttcacactatcaaaggcacgacccttttcaaaaagaggacatcaaaatccttctgaactcatactctcttacaataactttctcttcttgtctgcattgtggcctgtttacaagacctactacttttctttgtttgttttctttgaaactgatatgtcctcatttaagcttcagcactacaacaatgtgtttatttacagtctttgtatccatgtctactttactactttctgtagagttcaacatttaaattagtatgcttatgtcctactgcctgtttctgctatgaatcatcgcccttatttccctttatgtgctttgagttacagtttaaaacatggcaatatgcaagttattgtctatggattgaacttgatcccttagaggatcctaacctctaaacaatgtgttctaacaggcttatgggtgtgccagcatttcccattgcagggtatgcccactagcatgtcttttcctatttaccacctccccattccttatacccctatgtgtattaatgtaaactgtttcccttcccccctttcagaattctgcacttgcaccttctcttagtctctaagttctgccctcgcttgtcagccttgccttaggaacttgatttccctctgaacttggacatttgggggctggcccttccacactatactatgtcttcatctataatgtatttggttgtgagaattgcccggagtccatatgaggctcttagggaactctgacacatccaaatcagagaaaggttttgaaataagatctcttggagttggtttacttcatacttcaaacaagaagtctgaatcatgctctccttggttgtactttttctaattgtatttttttttactttactctttctgggatgtaataactttgtaataaaactctcggggaaagctagtgaaaagggaggggtaactatgtatgcaaaaaagggtagagaacctgcctataagagtttatgaattcctgcattctcatataaacaccatgtctataggaatcttgcattctcatatagataccatgtctctaagaatttctgcattctcataccatgtctataggaatcttgcattaccatatagataccatgcctataggttatttctgaatttctgcatatcatatagatatcctacctataagaatttctgaatttctgcatatcatatagatatcctgcctataggttctttctgaatcttgcatatgcattcctcattaggaaaacatgtttgtaggtcttaataatcaaccgcaattagatatcatgttcatagatcttaaatgaaattcaacacctagatgccatgcctataggatttctgcactttgctatgtctatgaaagtgtttaaatcaacaacgcctagaaagcatgcctataagagctattaatctagtctgaactgtttcactcacctataagtctaaaaccgacaataatgatgcattaccagttgcagaacttatgatcgtttgctaaaactcacccttctttaataactaacacattctcttaaatcagtatgtaatcatctcatatcccttgttcttgaagtctatagatatcacgcctatagggttttcatataacacttaggcaagccatagggtaaaagattataaattgaatcttttgttattaacaacaaccagctggtagtcctgattcgggtttcttatctaaattatgtgataaatcaaactgcctcaacccttaagtttaatcaggccctaaatagtatgtgtaagtcatgttatttgcttgctttctttgtttaaaggaggtctgtttgagatttttcatttgtttatattcttccccatacttgatatatatgttttgtttgccgccttagtatttttaccttttgaaaccacaagtaagcccaatatccctcccctttaggataagtagtctcaaatgcctccggtactgataggattggggtgggtaatagcatgcaataagtaaacgagactattccgcgctttaataccttaaacagggcgggaagggtagatatggatatgatgaccacgcggtaacatcacgtgtagctcttcactgaggagtgattaccagatgttgtgtggggtgatccatattattaataaacctaggaccccctcctttcatttgtttcttccttttaaaccttttaaactatttcttcaaaattaactttttagttttcttacttgtaaccctcatgtgtaaaatcccctcttatttaaagttttattcgcctacgtgttatttgcgataaagtcacaataattttctggccgggaaccatactagtgcatcctgaggggtgcctaacaccttccccttgggataatttcaagcccttacccaatctctggttgttcagatcagacctttcttagtgtcctaatgcacttaaatcattagatggcgactattcaattcaaacccaattcccgaaagggaacgagttgtcctcccaaatgtcataaacccagtttcgcgagaaaaagggggcgcgacagcgtggcgactctgcttgggacttttaggtttttaccatttcagactattattgtgaatttatgcttctttatgcgcacttatttgtttatttcttttaagattcaatttccttttcgaatgcaaaactgacttgtctttttgtttcttccctttattactttcctttactgctttcctttactaccgctttaagttatgaaaaactgttgtatttactgctttcctaacgtgcaaatatgtgacaatctgctttagttattgcataatcatgctcaacgtcatattccactcgtgccaaacaaaataccatagcaacgcttataatgagtggttacgctcttccaatattatcaccccctaaatccggaaaaggcatatttgcggtaaaaccagtctattaacggtgtagtcgacggttccgtgtctttcccccttaactgtgcatgtatcatggtcaaacctagccgggtcagttacgttgtccacataatgatcctttaagatagtattgtccaaagtccactgggtttccctaaaacccaaacggacatcatcacgttctatgcatttatttggagaactagatgcgtttatgctaattgttgatattaaatagtcgagtctagtaggggtaaaggcctaacccttttgttttgcagaaaatgaggcacgaggtgcccagttttggtatggctagaatcccctaactcttgctagactggtggaggagtcttccatcaaaaaaccaaatcaacgagtggaaagagagccgccaaatctagcgaaaagttgaaatatctagagtacggtctactagaattggaaggaaaagtgaggaggagagtcaccgactactagatcgccgagggaaatgaaggagaatacctatcaaaggcatgtttactggtgaacctatgcgaactggaggatctgatcaacgagagcattcaacctgaggaaggtccttctgggacaaagtagataggagcttgttcttttgctttaagaaatgtaataaggcccatggccattagtgattttcatttcttatttatttagtgtcgatttggaattcgtctactttttatcaataaaataaggcatttagcattctaagttctccaaatcaacttatcactaggcctacatcgagcacaaagaagttcataaataggacacgatttacattcttgcactatgtgtttaaatatcgcaacattttcttataatcctcactgacttgttacttttttttttttactttttgtttatttattcccgtccccaaaggttagttcgtgcactctggcatcgtcatcatattccacaagatcaaagggccctccaaccactcctcctcctagtcctatcagaagtaggaacaaagaaaagatggaagatttgaacaacaccagaaaggaaaactcaactgaatgggtagaggtcactcatggtgctcaggtctccaaagaaagtgcgtcccaactcgagtagaaactgttgaaatttcaggaggaacttgatcaggttcggaatctggaaaacttgtcattttccctcaccactccagctatcaattttcaaaacgcttagaaccccacagctccccaaaacatcccaaaaccacaaaaccatctcgctcctcaccaccactgcaatacttgccacacatccaacaatactacactgctcatccctgaacctttgaattccacaaatgaccatttccacgctcatcataatacccccatctacgtggaaaccatgccacactctacccaacccatctcaagcacacccaagtctgatgataaagactcactcatcaggaacctggctgcaaaactcaagaaattgactagtcgaatttagggtgtcaaaggaagtaaggggattaaaagggttgaactacgaagatctttgcatacaaccggatgtcaaactacccgaggggtacaaacttcctaagttcgagatgtttgatgctacaagggatccgagagtccacttgagaacatactgcgacaagttggtcggagtagggaaagacgaaaggattcgcatgaagcttttcatgaggagtctgagaggagatgctctgtcttggtatattagccaagacccaaagaaatggtcgaactgggtgagtatgacatccgactttatggacaggttcaggttcaacacagaaaatgcactagatgtgttttacatctagaatttaaagaagaagaccacgaaagcattctacgagtacgctattcattggagatcagaagctgctaaggttagatcggctttagaagaagaacaaataaacaagtttttcgtccgggctcaagacccgcagtactatgaaaggatgatgttgattgagagctagaaattttccgacatcatcaatcaaggggaaaggatcgaggaaggcatcaaaagtggtatggttacaacctttgatgcttttcaagctactaataaggctttatagtctatcggtacgtccaagaaaagggacataggtgccataatggttgcacaaagagccaaatccgctatcaaataccaagcctatccgatacctccactcacatatcagcctaccctgaattaccaagcaccctcaccctcttaccaaactctaccgcccacttatcaatcatccccacctcctacatatcaacctacttcacccagatattcccaacccgcacatgtctaccaagcctacaatgctcagccatcccactatcaatcacctcccacacgttaaaacctttcaagacctcgaccaaattttgaccacagaccccccaaatagtataccgccattgctgagccaattgaccatctatacgaaaggctcaaagctcctggttatatcacccctatacattctataacccctgaaaacccttctcaatgggtcaatccaaataaatcctatgcataccattccagcataaaaggcataccattgatgaatgccgctctttgaaagtcaagatccagactttgattgataacaagagaagtgtggaaaaggagcctactctgaatgttgtcaacaaccctctatcgaaccataagggtggaggtgttcccatgattgaaatagaggataaaggatcgatcggtttaatcacagaaggtgacgaaccaaaaaagccaatagtcacccttaatcagattgtagtccatactcaaccttctagggatgccaaggtaaacatgtctgtaccacttgagtttgaagcaccaccccctgcaaagacaccaacaccaattgaggtcgagtttgggtctccatcaaacgcacccgcactgtttgaagttgcggttttaccctccaacatacatgatccattcggattataggtgcccattccagtagaaatgtcggccgtaacaccgttccatacaaatgccataccttgggattacacaaccgaggcaagaaggaaagggaaagctaatttcggggaaacagttgcggcacatggtttgacaagaaccagcagggtttatactccggagcatttagctgagtcgagtatgtaggcctttggtcggccgaccatcactaaaaccgggctcgatgatctctggagaaagatacaagacaagtaatactcagtcattgatcagctgaacaaaacactggcacatatttctatcctagctttgctgccaagttccgatgcatataagaagatgctgagtgaggcatatgtaccaagcaaaatcaccggaggagaaatgaaaaacatggtatggaaggtattggaaagtcacaagatcacttttcatgaagatgagctgccaccagaagggttgagtcacaataaagcattgcacatcatcgtgcaatgcgaagattattttatcactaggatcctgattgatggaggttccaaccttaatatttttctgttggtaacactcagaacattgggaaaggggctacatgagatcaaggacgaggccatcaacgtcaaagcttttgacggttcccaaaggtccactattggggaaattagcttgtacttgcaaatggggcctacttggtttaatgtcgatttccaagtaatatatgtgccgacatcttacaacttgttgttgggacggccgtggattcatggtgctggggctgtagcatcaacactacatcaggtagtgaagtttgagtggaatcaccaagaggtgatcattcacgacaacggtagcaatcccatatacagtcgccaaaccatcccagcaatcgaagaaaaaagaaacgtaggcggggaaacctatcaccacatcgagcgagtcaacgccgctgataaagacaaatggcgagacaacaaaattgaaagcatattgaactggagtggatatgaacctagcatgggacttggcaagaacctccaaggaatcgccaagcctatcaaactaaagaaatatggcatcactttctgtctgggatacgagtatacttgggaggaattcaacaactggtctccaccatggcgtgggccatactacccgctgtagtagccaataccacatttggagcagactttccagccggccgatgttatctatggattggatgaagaagaagcactaaaaacagtgaggaatttgttcctaaaagacgatgatatggattgttgtgttgttctcgaggaggagggggaggaaggtccttccatacaggccgtaagtcgaggagcatgccttaacaattggaccatcagaaccaccagagcccggaaagcctcggggtaacaaggctgaaaaaagcatcatgctctatcttttatttttactatttgattttcctttcgcattttgaattttcgcaataagatcttccaatgttcaaaacagttatgaaatttatcaaagcatttcggtttcattaaaaatcttactattattatttcttctcattactttatttatacagcattactattacctatcttgatgaaccaatgactgtgacattaaaggagataacgaaacaaacggacatagattcagaggaagatgatataccagaagagattgttaaagaagttgagaactttgagaacaagccgaagtacaacctggatgagactgagattttattaacctgggagatgcagaaaatatcaaagaaacacgaatcaacatttacttatcaccgtcagaagaggaagagtacacagaatttctaagagaacacgaggacatattcgcttggtcaaatgatgacatgactggtctgagtacatctattatggcccacaaacttccaactaatccgacatatccaccggtaaaacagaagctcagaaagttcaagcctgatatgagtccgaagatcaaagaagaagtcactaagcaggtcaaagctaatgttctcagggtagtagaatatccgacatagttagccaatattgtgccggttcctaagaaggatgggaaggtcagagtgtgtgtcgactatagggatctcaatcgggctagtccaaaggacgacttcccctagttgaacatacacatcctgatcgacaattgcgccaagcatgagttgcaatcatttgtagattgtttcgctgaatatcaacagatcttgatggacgaagaagatgcagagaaaacaactttcattatgccatgggggatgtactgctacaagatgatgccattcgggttgaagaatgtaggggtagcctacatgagggccataactactattttctatgatatgatacataaagagattgaggcgtatgtagatgatgtcatcataaagtccaagaaatccactgatcacatggaagatttgaggaagttcttcaacagactgagaaggtacaacctgaaactgaatcccgcgaaatgtgcatttggggttcctgccagaaaactacttgggttcattgtgagttgccgagggatagaactggatccatcaaaggtcaaagatattcaagaactgccactgccaaagaacaagaaggacgtaataagtttcttagggagactcaactacatcagccggttcatagcacaatctactatcatctgtgagccaatcgttaagatgttgaaaaaggacaccgctaccgaatggattgatgactgccaaaaggccttcgatagaatcaagaagtacttgttaacaccacctgttttggttcctcccgagctgggtaaacctctaatactctacctcgcattattggatggagcgttcggttgtgttctaggtcagcatgatgaaatagggaggaaggaacaagccatctattaccgcagtaagaagttcatcctgtacgaggcttgatattctctgttagagtgcaacctgttgtgctttgacttgggtagctcagaagttgaggcactacctctgtgccaatacttcatatctcatatcaaggatggatcccttgaagtacatctttcagaagcccatgcccactggcaagctagccaagtggcaaatcctgttgagttaatttgacattgtctatgtgacttagaaagcagtcaaaggataggcactagcagatcaccttgctgaaaatcccgtggacggagaatacgaacccttgaaaacatattttcctgatgaagagttatcattcataggataagatattgcagaatcctatgacggttggagaatgtttttcgatggagcaacaaattttaaaggagttggcataggagcggtcctagtatcagaaactggtcagcattatccagtgtctgccaaactcaggttcccctgcaccaacaatatggccaagtatgaagtctgcatcttagggctcaagatgtccattgaatgaacattcaagagttgctagtaattggatattcagacttgcttatacatcaggtccgagaagaatgagcaactaagaattccaaaatactcccttatctgcatcacgtacaggagttgagaatgaggttcacaaagaaaaagttccagcatgttcctagagtccagaatgagtttaccgatgcattggctaccctatcatgcatgatacatcatccaaataagagctttattaatcccattccggtaaagatccatgatcagccagcttattgtgctcatgttgaggaagaagcagacggaaagcattggtttcatgatatcaaggaatatttgacgaaaggagtatacctataacttgcaaatcctactaaaaaatgcacacttcggaggttgtccaacaatttctttcacagtagaggaatcctgtatagaaggactcctgatttaggattgctaagatgtgtcgacgcaaaagaaacatctaaactgctagaagaaatccatgctaggacctacggtccacatatgagtggctttgttttagcaaagaagatactccggactggttacttctggatgactatggatacagactgcatccaatacgtctgaaagtgtcaccgctgttagatacatcaagacaggataaaagtacctccaaataagcttaatgcaacaagcttgtcatggccgttcgccgcatggggaatggatgttattggaccaatcgaacccattgcatcaaatgggcacaagtttatcctagtagcaattgattatttcaccaaatgggctgaagcagcatcttacaggacagtgactaagaaagtcgtggcggatttcgtccgcgaccgtatcgtgtgtcggttcaaaattccagagtcagtcgttactgataatggctccaacctcaatagtgatttgatgaaatccattgtgaaaccttcaagatcaaacacaagaattctacagcctacagacctcagatgaacggagccgtagaggcctacaacaagaatatcaagaagatactaaggaaaataatagagaagcataagtagtggcacgagaagatatcatttgctttattggggtaccacaccactgtccgtacattaactggggcaacccctctatatgttggtttatggtatggaagcagtcattcccgctgaagtagaaatttcctccctaaggatcatatagaaagctgagctcgacgatgcagaatgagtgaagagtcgttgcgaacaactagctcttatagacggaaagagaatgaatgcagttttccatggtcagctttatcataacagaatgtccaaagccttcaacaaagagtcaagctaagacaattcacaccagggcagctggtattaaagaagtttttcccgtatcaagatgaagccaaagggaaattctctcccaactggcagggtccgtacatggttcaccggttctaataggaggaaccctcatatttgcagaaatggaaggggaagtttggacaaagccgatcaattcagacgcagtcaagcgatactatgtgtaacttttatgctttctttcatgatgtaatttgaactacgcctgacctgattcccgtttaagaggggatacataggcagccctatgggttcggtcacaattcaataaaattttcattttccctgctattggaaactagggcagaattttgaggaggaccctcaaaatttcaaagttgattccagccatttatcattaacagccatcagaagcagcaacccagtaaactggggcagaattttgagaaggacccacaaaattccggagcaagagaagttgcaatgtcttaaaccacgtcgcaatcgtcggttcatctaaacaaaactattcttaattatgtacttatgttatgcttttactagatcatgcatgtttattactaaaattgctttgtttagcaacgctaccccagtgatatatatagtatcgccgaatcaaagcctagcaggccaagaaaagctagcggggatacgaactaacctttccccctttaaaactcaagactttttctttggatgcaggcacttgagttgaaaaatcatcaaatatactatacactcactcacaaagttcagtaatagaactctccgaaccattgcgcttgctcgcaactactatccgcacacaacagtgtccccagcgggcacaatatccccagtaatcacgataccacaatccgcaatcagctaagaaaactctattgccatttgttattttacttcctgcataaggctaccattctaccttccgagactaagctctgtctccatttgcattttctgtattgcataaggctaccattctgccttccaagactaagctttgtctccatctgcattctttgcattgtataaggctaccattctgccttccgagactaagctctgcctccatctgcattccctgcattacataaggctaccattctaccttccgaggttaagctctacctgcatttgcatggctgaaagatcgccactttatttacagcttgcatggccgaaatattgccactttatttacatcttgcatcggctgaaagatcaccacttcatttacatcttgcatcggctgaaatattgtcactttatctacatcttgcatggctgagatatcgccacttcatttacatcctacatcggctgaaagatcgccacttcatttacttcttgtattgctaaaatattgccactttatttacatcttgcatgtcttaaatatcgccacttgatttacatcttgcatggctgaaatatccccaccttatttacgccttgcatcggctgaaatatcgccacttattgcatttcatgggctgaaagatcgccacctactgcattccatggctgaatgattgccatcttcacacttgcatggctaaaatattgccgctttattttacgtttgtatcgctgaaagatcgtcacttattgcatttcatgggctgaaagatcgacacctactacattccatgggctgaaagattgccaaaattgtccaaatgcatcattgtttggaggcaacattttcatagcccgagaacgccatgcctggcctgagggccccttttatcttttgcatatcattatttaaaggcgtcatagtttggaggaatcattctcatagcccgagagcatcatttaatggcctgcgaattccttatcatacacttcatggcccaggacgtcatggtttgaggatgtcatcctaaatgtccaaagacaacatttatggtccgacgggaacttgcatcacgtttaaatttccgcacaatatacacttgtattgcttatttgcaggtaaaccggcgagcaacgaccgtctcaacaggagcaatcccgctccagttcccgccgccctgttagattttaaccatccatcccaacccaaatatcgcgtccgttttgaaaaatctccatcgacatattccgccgacggatcctgaactacatatggattgatttctgtaacaccagagatatgtaggtagcataggagatagagttcggtcaaattcttcaaaccattccgttcgatcaaattagccatcatatcttcacccgacaactctttcaactttctcgggtaaagaggggcagctgttgatacccaatttttttcaatattttttatttgaaaaatacctttcaaaatagcatgtatatacatatataagtatgtcccaaggtcctattatttttttttaattttttaaagattttaaaatcaattttattgctctattttatcaagaaaaacccaataagtattcccaaaattggaattttcgtaattcatttattggattctcatatttatactaaaatatagctagtatgatttttgcacatttttacaaatttatctagtatttaaaaaaaatgctaaattacatgtaattgcaatattagcctactttaagattaaattgcatttataattacaaaattagctccagtatttttagtctaatatttatatattattaattaatttagtacctttaatttatttgcataaattattttactatttttataaaataaataaggaaaatggctatttaaatgttagcctgtttttacttcgattttggccagatttggcacctctaatccaactcaatttcaatttcaattgcccagcccaattccaaaattacccgacccacaacctttaaaaaataacttacacgaccctcctttaaatcccagccgttgatctaacagatcaacgactcatgttctcccttttctttttaatttgccaacagccccccaaccctaatcattttgtcaccagtagccgctttaaaaccctccactctctcaaactctctcgagtcttcttagaaccctagccgcctcttatcgcttccaccatgaaagccaccagaatccatggcttccaaggctatgggagtcttatacctacctcttgttgctcttacacacctgatctctgaagattcacggcttgaccttgaaggtttgtacccagacctctatggatccgaggtttcacggccatctccagccttgctccggcgtaccatggttgtttgagcccgatcctgacctctccgactcagatcagtgacttttcaaagcctttctcatttctaggtttcttctgaaaccctaacccttcgatgttttccgattcccttagatctgttcaggatccatgctttccttaaggtcttaaacattttcctgacttttctttcaaaaaactactttcaaaatctttcttttccgatctagggttttctgaaagtatttaagtgttttctaactttctttttccttttatgtgtatttgcttctactgggttcttgttttttcttctaccatgttcttacgtgcttcttctgctgtattttcctatactatgttctcatatgctcttctactatatgttttctctactgtgttctgatatgtttctcctactgtattttcttactaagttcttaagtttccttattaagttccttttactgagctctgtttaaagtttcttctaaaatttcttagcatgcttcttctactattcttatcagtcttctctattatgtttcgtattagcttcttctactctatttttctttgaattttgctactatgttttgcgtgttacatgatatcattgttttctcatgagtttctgctgctgaaagaaacatgcaggaggtttcatagaactgaaacctctgagcctttttcgattacatgccttctcatctatgtacttgattcaaggtgaaaaccctagaatttgggggttctgccaagtttgattatgtgatttaattgaactaggatttttattttagaacccctaactctttcagaacaacttcgagtctcggaacctagtttggacatccgtgtttgcatatgattctgacctttggctaaactcttctaaaactctttcttcactggatttttttattgatttttgcaatggcacaacattttcttccaactcaatgtgtttgtgtgctctttatatgtgatgaatctttctctaaaaaggctttcaactcgtgattgattcaaattccttctaaataggtatgattgattccctttccattgtttgctgattttccttaagataaaaaacctttcccatctttttgactcgattcattcatacaagatcattgacctttgatttactggctgctaattattttcttgccttgtttgtgcaaccgcgtattttagaaattttgtccttaaataacctttatgtatttacctttaattgcatgctgtgcacaaagtgcttattcatttttctttccttaaattgtttttacctatttgaatctgaatccattaattaagggaaatcttgtgtaattaattgacaatcagttccttgactattttcttaccttatttcttcatgattttcacactataaaagcataaccctttttcaaaaagaggacatcagaatccctctgaactcaaactctcttacaataactttctcttcttgtctgcattgtggcctgtttacaagacctactacttttctttgtttgttttctttgaaactaatatgtcctgatttaagcttcaacgctacaacaatgtgtttatttacagtctttgtatccatgtctactttactactttctatagagttcaacatttaaattagtatgcttatgtcctactacctgtttctgctatgaatcatcgcccctatttccctttatgtgctttgagttacagtttaaagcatggcaatatgcaagttattgtctatggattgaacttgatcccttagaggatcctaacctctaaacaatgtgttctaacaggcttatgggtgtgccagcatttcccattgcagggtatgcccactagcctgtcttttcctatttaccacctccccattccctatacccctatgtgtattaatgtaaactgtttctcttcccctttttcagaattctgcacttgcaccctctcttagtctataagttctgccccccttttgtgagccttgccttgggaccttgactatgaacttggataccatgtctctaagaatttctgcattctcataccttgtgtataggaatcttgcattaccatatagataccatgcctatagattatttctgaatttctgcatatcatatagatatcccgcctatagaaatttctgaatttctgcgtatcatatagatatcctgcctataggttctttctgaatcttgcatatgcattcctcattaggcaaacatgtttgtaggtcttaataatcaaccgcaattagatatcatgttcataggtcttaaacgaaattcagcaactagatgctatgcctataggatttatgcactttgctatgtctatgaaagtgtttaaatcaacaacacctagaaagcatgcctataggagctattaatcaagtctgaactatttcactcacttataagtctaaaaccggcaataatgatgcattaccagttgcagaacttatgttcttttgctaaaactcacccttctttaataactaacaccttctcttaagtaagtatgtaatcatctcatatcccttgttcttgcagtatatagatatcacgcctatagggttttcatctaacacttaggcaagccatagggtaaatgattataaattgaatctgtttttattaacaacaacaatcaggcagtcctgattcgggtttcttatctgaattatgtgataaatcaatctgcctcaacccttaagtttaatcaggccctaaacagtatgtgtaagtcatgctatttgcttgctttctttgtttaaaggaggtctgtttgagccttttcatttgtttatatgcttccccatacttgccatatatgttttgtttgtcgccttagtatttttaccttttgaaaccacaagtaagaccaatatccctcccctttaggattagtagtcccaaatgcctccgggactgataggattggggcgggtaatagcatgcaataagtaaatgagaccattccgcgctttaataccttaaacagggcgggaagggtagatatggatatgataaccacgcggtaacatcacgtgtagcccttcactgaggagtgataccagatgttgtgtggggtgatccatattattaataaacctaggacccactcctttcttttgtttcttccttttaaaccttttaaactgtttcttcaaaatcaactcttttaattttcttacttgtaactctcatgtgcaaaatcccctcttatttgaagtcttattcgcctacgtgttgtttgcaattaaagtcacaataattgtccggccgggaaccacactagtgcatcctgaggggtgcctaatacattccacttgggataatttcaagcccttacccaatctctggttgttcaaatcaaacctttcttagtgtcctaatgcactcaaatcattaggtggcgactcttcaattcaaacccaattcccgaaagggaacgagttgtccacccaaatgtcataaacccgatttcgcgagaaaaagggggcgaaacagcgtggcgactctgctggggacttttaggtttttaccatttcagactattattgtgaatttatgcttctttatgtgcaattatatgtttatttcttttaagcattcaatttccttttcaattgcaaaagtgacttgtctttttgtttcttccctttattactttcctttactgctttcctttactaccgctttaagttatgtaaaactgttgtatttactactttcctaacgtgcaaatatgtgacaatctattttaattattgcataattatgctcaacatcatattccactcgtgccaaacaaaataccatagcaacgcttataatgagtggttgtgctcttcggtattatcacccttaaatacgaaaaaggcgtatttgcggtaaaaccagtcgatcaatgctgtagtcgacggttctgtacctttctcccttaagttgtccgcccaaaggtactagtctaaaaccccatagaaaccttactctatttaactgtgcatgtatcatggtcaaacctagccgggtcagttatgttgtccgcataatgatcctttaagatagacttgtccaaagtccactaggtttccctaaaacccaaacggacatcatcacgttctatgcatttatttggagaactagatgcgtttatgctaattgttgatattaaatagtcgagtctggtaggggtaatggcctaacccttttgttttgctgaaaatgaggcacgaggtgcccagttttggtatggttagcataccctcactcttgctagactggtggaggagtcttccatcaaataaccaaatcaacgagtggaaagagagggccaccaaagctagtgaaaagctgaaatatctagagtacagtctactgaaattggaaggaaaagtgaggaagagagtcaccgactaccagagcgccgaggtaaatgaaggagaacacctagcaaaggtatgattactggtgaacctatgcgaaccggaggatctgatcaacgagagcattcaacatgaggaaggtccttccgggacaaagtagataggagcttgttcttttgctttaagaaatgtaataaggcccatggccattagtgattttcatttcttgtttatttagtgtagatttgggattcgtctactttttatcaataaaatgaggcatttagcattctaagttctccaaatcaacttgtcactaggactacctcgagcacaaagaggttcccaaataggacacgatttacattcttgcactatgtatttaaatatcgcaacattttcttataatcctcactgacttgttacttttttgtttttactttttatttatttatttccgtccccaaaggttagttcgtgcattctggcattgtcatcatattccacatgatcaaagggccctccacccactcctcctcctagtcctctcagaagtaggaacaaagaaaagatggaagatttgaacaacaccagaaaggaaaactcaactgaacgggtagaggtcactcatggtgctcaggtctccaaagaaaatgcgtcccaactcgagcagaaactgttgaaatttcaggaagaacttgatcaggttcggaatctggcaaacttgtcattttccctcagcactccagctatcaattttccaaatgctcagaactccacagctccacaaaacatccaaaaccacaaaaccatcctgctcctcaccaccactgcaatacttgccacacatccagcaatactccactgctcatccctgaacctttgaattccagaaatgacaatttccacgctcatcataacaccaccatctacgtggaaaccatgccacactttacctaaccaatctcaagcacacccgagtttgatgataaagactcactcatcaggaacctggctacagaactcaagaaattgaatagtcgaattcagggtgtcgaaggaagtaaggggattaaaagggttgaactacgaagatctttgcatacaaccggatgtcgaactgccttaggggtacaaacctcctaagtttgagatgtttgatagtacaggggatctgagagtccacttgacaacatactatgccaagctggtcggagtagggaaagacgaaaggattcgcatgaagcttttcatgaggagtctgagaggagatgctctgtcttggtacattatccaagacccaaagaaatggtcgaactgggtgagtatgacatccgactttatggacaggttcaggttcaacatagaaaatgcgccagatgtgttctacatctagaatttaaagaagaatcccatggaagcattctatgagtacgctactcgttggagatcagaagctgctaaggtcagaccggctttagaagaagaataaataaaaaagtttttcgtccgggctcatgacccgtaatactatgaaaggctgatgttgattgagagacagaaattttccaacatcatcaagctaggggaaaggatcgaggaagtcatcaaaaatggtatggttacaacctttgaagctttgcaagctaccaataaggctttactgtctggcggtacgtacaagaaaagagacgtaggtgccataatagttgcacaaagagccaaatcccctatcaaataccaagcctatccgatacctccactcacatatcagcctaccccgaattaccaagcaccctcaccctctcaccaaactctactgcccacttatcaatcatccccacctcctacatatcaacctacttcacccagatattcccaacccgcacttgtttaccaagcctacaatttttagccatcccactatcaatcacctcccacacgtcaaaacttttcaagaccttgaccaaattttgaccgcagacccccaaatagtataccgccattgctgagccaactgaccagctataggaaaggctcaaagctcttggttatgtcacccctatcccttctataacccctgaaaacccttcttaatgggtcaatccaaataaatcttgtgcataccattctagcatgaaaggcataccattgatgaatgccgctctttgaaagacaagatccagactttgattgataaaaatatcattgtggcaaaggagcctactccgaatgtcggcaacaaccctatgtcggaccataagggtggaggtgttcacatgattgaaatagaggatgattgggatcccaaaggatcgatcggtttaatcacagaaggtgacgaaccaaaaacaccaatagtcacccttaattagattgtagtccatactcagccttctagggatgccgaggtaaacatgtatgtaccacttgagtttgaagcaccaccccctgcaaagatgccaacaccaattgaggtcgagtttgggtctccagcaaacgcacctgcaccatttgaagttgcggttttaccctccaaaatacatgctccatttagagtaaaggtgcccattccagtatcaatgtcagccgtaacaccgttccatacaaatgccataccttgggattacacaaccgaggagagaaggaaagggaaaaccaattttcgggaaacagttgcggcacaaggtatgacaagaacctgcagggtttatactccggagcatttagctgagtcgagtaagcaggcctctagttggccgaccatcactaaaaccaggcccgatgatctctggagaaagatacaagtcaaggaatactcagtcattgatcagctgaacaaaacactggcatagatttctatcctagctttgctgcaaagttccgatgcacataagaatgccttgttgaaggtgctgagtgaggcatatgtaccaagcaaaatcaccggaggagaaatggaaaacatggtagggcaggtattggaaagtcacaagatcacttttcatgaagatgagctacaaccagaagggttgagacacaacaaagcgttgcacatcaccatgcaatgcgaagattattttatcactaggatcctgattgatgaagggtccagccttaatatttttctgttggtaacacttagaacattgcgaaaggggctacatgagatcaagaacaggtccatcaacgttaaagctttcgatggttcccaaaggtccactattggggaaattagcttgtacttgcaaatggggcctacttgtttcgatgtcgacttccaactgatagatgtgacggcatcttacaacttgctattgggacgaccgtggattcatgccgctggggctgtagcatcaacactacatcaggcagtgaagtttgagtggaatccccaagagatgatcattcacgtcgacagttgcaatcccatatacagtcaccaaaccatcctagcgatcggaggaagaagaaaggtaggcgaggaaacctatcaccacatcgacgagtcaacaccgttgacaaagacaaatggtgggacaacaaaattgaaagcatgttgaactggagcggatatgaacttggcaagagacttggcaagaacctccaaggaatcgccaagcctatcaaacttaagaaacatggcaccactttcggtctggtgtacgagtatacttgggaggaattcaacaactggtctccaccatggcgcgtgccatactacccgctggagtagccaataccacatttggagcagactttccagccggccgatgttatctatgggtcggatgaagtagaagcactagcagcagtgaggaatttgttcctagaagatgatgatatggactgttgtgttgttctcgaggaggagggggaggaaggcccttccacacaggccataagtcgaggagcatgccttaacaattgcaccatcggaaccaacacagcccggaaagcctcggggtagcaaggctgaacaaagcattatgcactatcttttatttttactatttgatattcctttcgcattttgaaatttcgcaataagatcttccaatgttcaaaacaattatgaaatttttcaaagcatttcggtttccttacaaatcttactcttattatttcctctcattactttatttatacaacattactattacctatcttgatgaaccaatggctgtgacatgcaatgagactacgcaacaaacagacataaattcaaaaaaagatgatataccagaagagattgttaaagaagtcgagaactttgagaacaggccgaagtccaacctggacgagattgagattgttaacttgggagatgcagaaaatgtaaaagaaacatgaatcatcattcacttatcaccgtcagaaaaggaagagtatacaaaatttctaagagaacatgaggacatattcgcttggttatatgatgacataactggtctgagtacatctattatggcccacaaaatgccaactgatccgacatgtccaccggtaaagcagaagctcaaaaagttcaaacctgatatgagttcgaagatcaaagaagaagtcactaagcaggtcaaagctaaggtctcagggtagtagaatatccgacatgtttagccaatattgtgccagtgcctaagaaagatgggaaggtcagagtctatgtcgactaccgggatctcaatcgggctagtccaaaggacgacttccccttgctaaacatacacatcctaatcgacaattgcgccaagcatgagttgcaatcatttgtagattgtttcgctggatatcatcatatttggatggacgaagaatatgcagagaaaatggctttcattacgccgtggggatgtactgctacaagatgattccattcgggttgaagaatgcaggggtcgcctatataagggccatgactactattttccatgatatgatacacaaggagattgaggcgtatgtagatgatttcatcataaagtccaagaaagccactgaacacatggaatatttgaggaagttcttcaacagactgagaaggtacaacctgaaactgaatcccgcaaaatgtgcatttggggttcatgccggaaaactacttgggttcattgtgagttgccgagggatagaactggatccatcaaaggtgaaagctattcaagaactgccaccgccaaagaacaagaaggatgtaatgagcttcttggggagactcaactacatcagtcggttcatagcacaatctactgtcatctgtgagccaatcattaagatgttgaaaaaggacgctgctatcgaatggactgatgactgccaaaaggccttcaacagaatcaagaagtattttgtcaacaccaccaattttggttctgctcgagctgggtaaacctctaatactctacctcgcagtattggatggagtgttcagttgcgttctaggtcagcatgatgaaacaaagagaaaggagcaggccatctattacctcattaagaaattcaccctgtacgaggatcgatattctctgttagagtgcacctgttgtgctttgacttgggtagctcagaagttgaggtactacctctgtgtcaatattacatatctcatatcaaggatgaatcccttgaagtacatctttcagaagcccatggccactggaaagctagccaagtggcaaatcctgttgagttaatttgacattgtctacgtgactcagaaagcagtcaaaggacagacactagcagatcaccttgctgaaaatcccgtggacgaagaatacgaacccctgaaaacatattttcctgatgaagaggtaatcattcataggagaagatattgtagaatcctatgacggttggagaatgtttttcgatggagcaacaaatttcaaaggagttggcataggagcggtcctagtatcagaaaccggtcagcattatctagtgtctgccaaactcaggttcccctacaccaacaatatggccgagtatgaagtctgcatcttagggctcaagatggacattgaatgaacattcaagagttgctagtaattggagattcagacttgcttatacattaggtccgagaagaatgagcaactaagaattccaaaatactcccttatctgcatcacgtacaggagttgagaaagaggttcacaaagacaaagttccagcatgttcctcgagtctagaatgagtttgccgatgcattggctaccctatcatccatgatacatcatccaaataaagctttatttatcccattccagtaaagatccatgatcaaccagcttattgtgctcatgttgaggaagaagcagacggaaagccttggtttcatgatatcaaggaatatttgacgaaaggagtatacctagaacttgcaaatcctactcagaaacgcacactttggaggttgtccaacaatttcttttacagtagaggaatcctgtatagaaggactcctgatttaggattgctaagatgtgtcgacgcaaaagaaacatctaaactgctagaagaaatccatgctgggacctacggtccacatatgaatggctttgttttagcaaataagatactccagactggttacttctggatgactatgaagacggactgcatccaatacgtccgaaagtgtcaccgctgtcagatacatgcagacagggtaaaagtgccactaaatgagcttaatgcgacaagctcgccgtggccgttcgccgcatggggaatggatgttattggactaatcaaacctaccgcatcaaacaagcaaaagtttatcctagtagcaattgattatttcaccaaatgggttgaagtagcatcttacggggcagtgactaagaaagtcgtggcggattacgtccgcaaccgtatcgtgtgtcggttcggaattatagagtcaatcattactgataatggctccgacctcaacagatatttgatgaaatacatgggtgaaaccttcaagatcaaacacaaaaattctacagcctacagaccttagatgaacggagccgtagaggccgccaacaagaatatcaagaagatactaaggaaaatgatagagaagcataatcaatggtacgagaagatatcatttgctttattggggtaccgcaccactatccgcacatcaactggggcaaccccctacatgttggtttatggtacagaagcagtcattcccgccgaagtagaaattccctccctaaggatcatataggaagctgagctcgacgatatagaatgggcgaagagtcattgcgaacagctagatcttatagacggaaatagaatggatgtagtttgccattgtcagctttatcataacagaatgtccagagccttcaacaaaagagtcaagccaagacatttcacaccagtgcagctggtattaaagaagattttcccgcatcaagatgaatccaaaaggaaattctctcctaactggaagggtctgtacatagttcaccggttctaataggaggagccctcatacttgcagaaatggacggggaagtttggccaaagccgatcaattcagatgtagtcaagcgatactatgtgtaacctttatgctttctttcattatgtaatttgaactacgcctgacttgattcccgtttaagaggggatacgtaggaaaacctatgggttcggtcacaattcaataaaattttcatttcccccgctattggaaactggggcagaattttgaggaggaccctcaaaattccaaagtcgattccagccatttatcattaataaccgtcagaagtagcaacccagtaaacttgggcagaattttgagaaggaccctcaaaattccggagcaagagaagttgcaatgtcttaaaccacgtcgcagtcatcggttcatctaaacaaaactattcttagttatgtacttatgttttgcttttactagatcatgcatgtttattactaaaattaccttgtttagcaatgctaccccagtgatatatacaatatctccaaatcaaagccgagcaggccaagcaaagtcagcggggatacgaactaacctttccccctttaaaactcaagactttttctttggatgaaggcacttgagttgcaaaatcatcaaatatactatacactcactcacaaagttcattaatagcactctctgaaccattgcgcttgctcgcaactactatcggcacaaaatagtgtccccagcgagcacaatatccctagcaatcatgataccacaatccgttatcagctaagaaaactctattgccatttgttattttacttcctgcataaggctaccattctaccttccgagactaagctctatctccatttgcattttctgcattgcataaggctaccattctgccttccgagactaagctctgtctccagctgcattctctgcattgcataaggctaccattctgctttccgagactaagctctacgtccatctgcattccctgcattacataagactaccattctaccttcctaagttaagctctacctgcatctgcatggctgaaagatcgccactttatttacatcttgcatggccaaaatattgccactttatttacatcttgcatcggctgaaagatcgccacttcatttacatcttgcatcggctgaaagattgccacttcatctacatcttgcatggctgaaatatcgccacttcatttacatcttgcatcggctaaaagatcgccacttcatttacttcttgcatggatgaaatatcgccactttatttacatcttgcatggctgaaatatcttcactttatttacatcttgcatggctcaaatatcgccaccttattttcgtcttgcatcggctgaaatatcgccacttcatttacacttgcatggctgaaagattgccactttttgcatttcatgggctgaaagatcgccacctactacatttcatggctgaaagatcgtcatcttcacacttgcatggctaaaatattgccgctttattttacgtttgtatggttgaaagatcgtcacttattgcatttcatgggctgaaagatcgccacctaaaacattccatgggcttaaagatcgccaaaattttccaaaggcatcattgtttggaggcaccattttcatagcccgagaataccatgccgtggcctgaggaccccttttatcttttgcatatcattattcaaaggaatcatagttcgaaggcatcattctcatagctcgagagcatcatttcatggcctgtgaatcccttatcatacgcttcatagcccaggacgtcatggtttgaggacgtcatcctaaacgtccaaagacaacattcatggtccgacgggaacttgcatcaagtttaaatttccgtacaatatacacttgtattgcttatttgcaggtaaaccggcgagcaacaaccgtatcaacaggagcaatcccgctccagttcctacctccatgttagactttaaccatccatcccaacccaaatatcgcgtccgtcttgaaaaatctccatcagaatattccgccgacggatcttgaactacatatggcctgattcctgtaataccagagatatgtaggtagagtaggagctagagctcggtcaaattcttccaaccattccgttcggtcaaattggtcatcatatcttcactcaacaactctttcatccttctcgggtaaagaggagcagctgttgatacacaattttttcctatatattttatttgcaaaatacctttcaaaatagcatgtatatacatatataagtatgtcccaaggtcctattatttttctcaattttttaaagattttaaaatcaattttattgccctattttatcaagaaaaacccaataagtgttcccaaaattggcattttcataattcatttattggattctcatatttatactaaatagtatgatttttgcacatttttacaaatttatttagtattttaaaaaatagctaaattgcatataattgcaatattagcctactttaagattaaattgcgtttataattacaaaattagctccaatatttttagtctaatatttatatattattaattaatttagtacctttaatttatttacagaaattattttactattttttataaaataaataagggaaaatggttatttaaatgttagcctgtttttacttcgattttggcctgatttggcacccctaatccgacccaatttcaatttcaattgcccagcccaattccaaaattatccgacccacaacctttaaaaaataacccacacgaccctcttttaaatcctagtcgttgatctaatagatcaacgactcatgttctccctttcctttttaatttgccaacaacccccaaccctaatcattttgtcaccagtagccgccttggaaccctccactctctcaaactctctcgagtcttcttagaaccctagccgcctcttaccgcttccaccctgaaagccaccagaatctatggcttccagggctattagagtcttataccttcctcctgttgctcttacacacctgatctctgaagattcaaggcctaaccttgaaggtttgtacccagacctctgtcgattcgaggttccacggccatctccagccttgctccggcgtaccatggttgtttgagcctgatcctaacctctctgactcagatcaatgacttttcaaagcctttctcatttctagggttcttctgaaaccctaacccttcgaggttttccgattcccttagatccgttccggatccatgctttccttaaggccttaaacgttttcctgacttttctttcaaaaaactactttcaaaatctttcttttccgatctagggttttctgaaagtgtttaagtgttttctaactttcttttttcttttatgtgtattttcttctaccgggttcttgtattttcttctaccatgttcttacgtgcttcttctgctatgtttccatatactatgttctcatatgctcttctactgtatgatttctctactatgttcttatatgtttctcctactgtattttcttactaagttcttaagtttccttattaagttccttttactgagctctgtataaagtttcttctaaaatttcttagcattcttcttctactgttcttatcagtcttgtctattatgtttcgtattagcttcttctactctatttttctttgaattctgctactatgttttgcgtgttacttgatatcattgttttctcatgagtttctgctgctgaaagaaacatgcaagaggtttcagttgaaacctctgagccttttttgattacgtgccttctaatctctgtacttgattcaaggtggaaaccctagaattcgggggttctgccaagtttaattatgtgatttaattgaactagggtttttattttagaatccctaaatctttcggaccaactttgagtctctgaaccgagtttagacatccgtgattgcatataattctgatctttggctaaactcttctaaaaactctttcttcactggatttttctattaatttattcattggcacaatattttcttccaactcaacgtgtttgtgtgctctttatatgtgatgaatcttcctctaaaaagtctttaaactcttgattgattcaaattccttctaaataggtctgtttgattccctttccattgtttgttgatttgccttaagttaataaacctttcccatctttttgactcggttcattcatacaagattcctgacctttgatttactggctgttaattgattttcttgccttgtttgtgcaaccgcatatttcaaaaattctgtccttaaataactttttgtatttgcccttaattgcatgttgtgcacaaagtgcttagtcatttttctttccttaaattgtttttacctgtttgaatctgaatcccttaattaagggaagtcttgtgtaattgattgacaatcagttccttgactattttcttaccttatttcttcatgattttcacactataaaaggcataaccctttttcaaaaagaggacatcagaatccctctgaactcaaactctcttacaataactttctcttcttgtctgcattgtggcctgtttacaagacctactacttttctttttttgttttctttgaaactaatatgtcctgatataagcttcagcgctacaacaatgtgtttattaacagtctttgtatccatgtctactttactactttctgtagagttcaacatttaaattagtattcttatgtcctactgcctgtttctgctattaatcatcgctccctacttccctttatgtgctttgagttatagtttaaaacatggcaatatgcatgttattttctatgtattgaacttgatcccttagaggatcctaatctctaaacaatgtgttctaacaggcttatgggtgttccaacatttcccattgctggatatgcccactagcttgtctttgcctatttaccacctcccctttccaatgtgtattaatgtaaactgtttcccttcccctttccccttttcagaattctgcacttgcaccctctcttagtctctaagttctgcccccctcttgtgagccttgtcttgggaccttgagttccctctgaacttggacacttgagggctgacccttctacactgtaccatgtcttcatctataatgtatttgggtgtgagcattgcctgtagtccatatgagactcttagggaactctgacacatccaaatgggagaaaggctttgaaataagatctcttggagttggtttacttcatacttcagacaggaagtctaaatcaggctctccttggttgtactttttctgattgtattttttctttactttactttttctgggctataataactttgtaataaaactctaggaatggatagtgaaaaaggaggggtaactatgtatgtaaaaaggggtagataacctgcctataagagtttatgaattccagcattctgagataaacaccatgtctataaaaatcttgcattctcatatagataccatgtctctaagaatttttgcattctcataccatgtctataagaatcttgcattaccatatagataccatgcctataggttatttctgaatttctgcatatcatatagatatcctgcctataggaatttctgaatttctgcatatcatatagatatcctacctataggttctaaattcaacacctagatgccatgcatataggatttctacactttgctatgtctatgaaagtgtttaaatcaacaacgcgtataaagcatgcctatatgggctattaatcaagtctgaactatttcactcgcttataagtccaaaaccggcaataatgatgcattacctgttgcagaacttatggtattttgttaaaactcacccttctttaataactaacaccttctgttaaatcagtatgtaatcatctcatatcccttgttcctgaagtctatagatatcacgcctatagggttttcgtctaacacttaggcaagacatagggtaaaagtttataaattgaatttgttgtttttaactacaactagcaggcaggcctgattcagatttcttatctgaattatgtgataaatcagtctacctcaacctttaagtttaattaggctctaaacagtatgtgtaagtcatgctatttgcttgctttctttgtttaaaggaggtctgtttgagccttttcatttgtttatatgcttccctatactttccatatatattttgtttgtcgccttagtatttttactttttgaaaccacaagtgagcccaatatccctcccctttaggattagtagtcccaaatacctccaggactgataggattggggtgggtaatagcatgcaataagtaaacgagaccatttcgcgctttaataccttaaacagggcggggagggtagatataggtatgatgaccatgcggtaacatcacttgtagaccctcactgaggagtgattactggatgttatgtggggtgatccatattattaataaacataggactccccccctttcctttgtttcttccttttaaacctttttaaatgtttcttcaaaataaactcttttagttttcttacttgtaaccctcatgtgcaaaatcccctattatttgaagtcttattcgcctacgtgttgtttgcgcttaaagtcacaataattgtctggccgggaaccacactagtgcatcctgaggggtgcctaacaccttccccttgagataatttcaagcccttacgcaatctctggttgttaaaataaaacctttcttagtgtcctaatgcacttaaatcattaggtggaaactcttcaattcaaacctaattcccgaaaggtaacgaattatcctcccaaatgtcataaacccgatttcgtgagaaaaagggggtgcgacaagttaaataagagagagtgccaagggggagacaaaagaaaagaatttgaatttaggaataaccttatgagaacaagggcactgaggtatgtaactaaggatgtttataggcgagcaagaacattaaaaattcctttaggtatacgatgtaataagcttgcatcttttcagtagtcagagggtctcccctaagtactacaactaaagattacatgaggaaataagagagaaggtttcaacctaagcatagtgatctgaagaacaaatgatcttggagcaacagtcttactagaacattgtatgcactccataagaaagtggcacctatcgtagcttatgaatgggaagtagaattcaaaagtgatatttgagatcatatgagttacatgaagttctagtattcttgggtaatgagatatgccaagtattcacacaatgagtggcagaaagaccaggaaaagtaatttcttacatttaaagaaaactaagaaggcacaaaatgaattattctatcaacgacctccagttaattatgttatgaacgcacttaagttttaggagtgttatccatgcaacatatatgctgacattcatacaattataggagactttggtatacgttaagaaaaagaattgagtccacatcacagataaaggactgagttgctagaagattataccatggatgttacataacatccacaaaaatctaatgtaatagctaataccttgagcgattggaagatagcttaagcctacacaaaggctgagagagaagaggaagctcgaaagttacaatagctaagtaaatcaggggtccgattattagacccagatggttatagaaattgtgactcaaaacattgcagaatctctattaatagcagagttacaagaaagatagtacaatgaccatattctgtaacatctctacgataaatccagttagaagactactaacctcatatgaagtcaatataaagtgcccatctgattgtttatgcatcataggtgcatgtattatagtagcgatttaaggtgtggacgtgaatttcacccatgtggaagggaggtaatgaaagtgacagaagatacaatgcaaaatttaaagctaagaaaggtaaaggtaaaaaaaatacgagatacaagccagacttcagatagaggcctagaagcgctgtgatttagtatctataaatgatagtagtgtcttcagtagcatatcattagcctatggtttctaggtaccgaggtctagttaagagggtaaagaggacgtgatgtcttccttgaggttccataataacataaggaaatcaatggtgcttgcaagttaaaagaaggttgcgagtagtataaatagatatgtgtaggtcgcaagctaaagtgtggtagagagacaaggtcttagttatataggagtaaggataaaaaaaggtgagtgaaaaggggacaagaatagtaaggcctcaggatttagcccatcaaaacaagacgtctgatgattttcgtaagttatagaaagctaagtagagcctgaatgaactcggatgagtctaagactaggatcatttagaaaagatgaaatgccacctttgtgtcgacgccccctgtttccctcctaaaagaaggcgaaatggggtttacgacattatgggcaaaacaactcttattcccttttgaggaatcgggttatggaatttgaagagtcaccacctaatgactatagtgcattaggaccttttagagaaaagaagaatattttttggaagaaaaccagagttcgggtaagggcttgagattatctcgaggggaaggtgttaggcacccctcaagatccactagtgtggttcccggccgtacttagttgtgactttaagaagagtaggagtagacaagcaaagtttgcacataagaaatataaacaagttgacaattttgaaagaagaaagacacaagtgatttttttttttggaaaaaaaaaggaaagtttagtttgaggaaaacgttaatttaaatgaaggaaaagcaaagaaaagggttctaggtttaaatacaatatggatcaccttggtgcaatacccaacagtcattctcacacgagatattagtgcaccggtcatcatatccatattctacccttcccaccccgttaaggtattaaacgcaattagtctcatttacttattgcatgctaatacccgtcccaacctatcagtcccagggtattaggacttctaatcctaagagggaagaaagggatggggcctttatggagtgtaaaggataaaattctagtttcgacattccaaaacaaatatcaaataaaaggatgagtaaacaagcaaacaaggctcaaataaaccccttaaatcagacaacacttaatttagtatgtcttagcatatactgatttggtcttaatttaaaaactaagcggcgagcggactggttcaacacatatatttagacagaaagtctgcattaggcaactcggatccaattgtcagaaattgaagtattttaagcgagtaaaaaaaagcactattttcagaaaggacctaacgcagaatagtttaagacagaaggttgaaaatttgcagaggttcagagatgacatgaaaatcagtagtattgtttaaggataaaacgagttcgagctgcagaacttattaaaaatgataaaatacagaaaagtgatatgtaactgagttggaaatcattcattgaactaccagaaaaggcagtaagtttcggaaagcatgcaagtttaccagaagattaggttttagaaagagttgcactaatctgggaagaggctcaatggttcggagaaccactagttttttatccgttagtcaatgaaattgttactgcttttagacgagtgaggcaagtttgaaaaaaacttcatatagacatgatctctacgagtcatttgttttaaaccatgttaacaaacttgtaaatagatgctgatttgattatccctaaaaatttgcctaatatcatgaacatgcacattcctataggcatgatatttatatgcaagattgcagaaagttaaatattgtctcctataggcatgatttctatgtgattggatcaaaaacattaaaaagaattaaaaccctaaagcatggtttctaccctttgatgcaggaaagtaaaatccctcccacacctttttgctagattcccagattttgtacaagttattatagacccaaagaaaagataaaaatacatcaaagaccaacagccgcatccgaggaacctaattcaatcttaatgtctaataatatgtgattaaccaattccgaatccaaatttccaaggccttctcttacccaaattgtttcaaatttccaacgagcctcgaggagccacaggaaacgcttacactctggataacaattattgtaacagaatggtgcagtgtggaatagtgaaccctcaggcatccaagttcaaagggagctcgagggtcccaaagcatggcttaccaaagggggcagaacttagaaactaggaataagtgcaaagtgagagagggattaaggaaccatagcagagggtggtcatacccagccatgggataggctggcacacccctaaccctttgcttaggtcaacaaataggagcagactctggggagtcaaacttagggtctgagtggtgattaggacactaccagacccaagttaaagctcaacacataaaggggagaggaaatgggaaagcatttgagtagagactcaggagagtctgattctggatcatggtcagcaatatcagatgttgccatgattcagaatagtactagcacacaaaagggaatatagggaagggatttccatgcagaagcatgcactgccattaaaaaaatataagaaaacatagcagactgcagatgcaaggacatagaagaacatgctagagaacataactatagtgaagcatgtgtagaagaagagaactgaatagacatagtaggagagtgttatttaacttagaagtacataccagttttcagttctagtacagcagagaaacaacagcaagtagacagccagacagttagtaggaacaattcaaaacttcagcaagtacttggaagttcagaggaactctagaaatgttcagacagtaggagaaaagggaacaaagtgctcagtagagagacagtagtagagaaagtggtaatagagagagtagtagtaaagagagtcgtagccagtaaagatagagatgattgtgtgttgcaatggtgcagaaaagagttctgagaactgtgttgtgttcgaatgtttgtgtaagaaaaactgtgtcctagaacttgtgagagctgtgagcttttatagtgcaaaaacgagtagacaagaaggcaaagaaataaaatctcggtcaatcaaataaaatctcccttagtcaaagggatttgatttcaaacgagagtggtaattaagggaagaaaaacctttcaaagtagcataataaagggtaggttcatacagagtctatttaaggtaagaaactttagtacacgattttgagagaataaggaaacaaagtaatcaaacagccggaaagttttaaaagccttgaatgaacttagtcaggaaaatagggaaaaggctaagttgtaaaaatatcaatagcaaatcaatcgagactcagtaaaaggatattgaaatcaatcacgagctaatagtatcaattcaaaaagaacaaaaccctcgtatataagcatgctagtatcaagctagaaagaaagattggcataaacagttttagaatcataagcaaaaaggaaagcaagtttcagttcagtctatgaactcagcacaaatttgagagcctagggtttctagagtagaaccctagaaccaaaagctcgcaaaatccccaaatagggtttcagtccgagtaggacacacaaaaagagaaggcaaactcaacaagcctggggaactctttcagaattccctgaggaaatacacagacatacgtagcaatcgaaagcagtagagtgcaaactaaaactcaaccagttcagaagagagaaaagatgccatagaactttaggaagtagtaaaagaagaaagttcaataacccaaataaatccagtaagagtaacacttttagtaacagaaatagtaaagggacaggcaagataggcgtataaacatgcttatagaaaaatcagtagaagcaataataaaacaaaggcagagagacatgcatattaatagcaaaacataagaaataaacgaaaaccccctaaagcatggcatgaacacacagattcagataaagaaagaagaagaagaagaagaatcgttttaggattttttttgaaaaccttaatttaaatagactaattttaaaaagggaaaattaggggaaatcgttaaaacatcgaatagagcatagatctgctacagatctaagaaaataaggaaagaaaaacctcgaatcaagctttttagagacgagaaggcctggaatggtttggtctcttaacgaatctgggccatggctaagccttcagagcttgaacacgccggaacggagccggaggagccacaagaactcaggtcggcagaggacctgaacaggtctgtggaagattgatccttaaaagcctcgaataatcatggcttggggtgaaaggggagagaatataggttgtccatggcctgggaagccatggacgccggtgggtttggtcggagactatgatagacgggtagggtttcgagtggcctagagagcatttgagagaagaagggatttgggggaggtggtcttagagaaaaaaatttagggttagggggtcggatgaaattaaaaaggaaaggaagaaggggtggccgttgattaatacaatcaacggccaagagtaaaagcaagagacaggcgggttaggttaattgggtttggatcgggtaaaaatcaaaattgggtcgtcgatttgggcctgatttgaggtcaattggggggtcaagataggctataattgaaagaaattgaggccatgattgcaatagccagttttcccttttgatttttttaaaaaatagcaaaagatgtttgaaaaccaaattgaaggcactgagtcaactaataatatataaatattaattcaaaaatattgggatcaattttgtaattataaaatgctattaaatcttaaagaggctagtattgcaattatatgcaatttagttttaaaaataccaaacaaatttgtaaaaatatgcaaaagtcatgccgattatattttgatataaatatgaaaatgaaataaattattctccaaaatggcaagctttgggaataattatgggattttatggtgtaaaaataggccataaattggtttaaaatagttaaaaaatgccaaaaccctttggggtgcttatatatgcacatatatgtcattttgaaaatatgtagggaaaattgggtatcaacacttggtagtagaataagggtaattatgatagataagaggatgacgcttgggcctttgattgggtaatgattcaaagtaaaaagatttcataaattgcacgggattataatacccccataagatgaaccattttaggatgctatgaaatacatgtatttaagtataatatcgtcactatgtggatcatgcaaatcaattcaaatgttccccaatgagatgtgagcgttagtgacaatgtattatgtgagaggtttaaagttatccttggtagattatgagttattttagttttatgatagtcgtgtattttgttttaaagtcaagcgagttgtggaacaaaagttggaaaaaatcatcacaagttacattcatgaatatgctgaaacttaggtcaaatgtagctgagaatttgtcccaatgtatagggaattacggtatgatctacctaccaaattaaagatctacgagtctagtttctaactgatcaaatcatttattgatacaacattttagtagagacatattcaccttttttgtgagactgcacagactggtaggtgataagtagttgcatcacctacttgccaaaaggagcagcctcaattaaaagctcctaaactcggccaataggggacttttaagggatttttaactcatttctttcactcatcattcagacaaagaaaaccagtttgaacccctgcaactcctccccgaaaatcccgcacaaaccgtatgttatttcgagtgttacgatgtaattctaatgccgaaaaccccggacaacgttctagtttctctttttccttcttgtagctatgttgggggattgattttggatgaagaagggctagttttcgtgggttctacttagtccaaggaaattttatgcttctccttccattatctatgcttgtatgagttgtaactcaatcataaagactaaacctagcaagtttcaaaagagtagtatgctgtttgttgttgcatcaccgttggctggttgtaaacatatttatatgttggattcaaggctagtttacatgataagaggcttaattatgtattgtttgttgtgtttctcaaattgaaagaaaagacaagttgaaacatattttagtaaactgaaaaatcagttttgagttgctgagcttgtgggactgttttgtgggcagttttgtgttgatgttgggttttttcttttcctactatttttatggagtttggtaggagaaaagggtttggataaacaccatataatggtagggtggttggctggtcgttcgttgttacatttttgggttgtttgacactactagggttgtcgttttgtgtatgaactgattattgtatgtaggttgttttgtggtatttatgatggatataatgttggaaaatgatgtatacatgttattgttgtattctttttgttgttagtgttatgtcaaattgggaggaagtaaagattataggggagttgctgcccgttttattataaaataagtttgtcgttcgttgtgcgatagttataccttctgtaaattaatgatagtgttgttatcgttgttgtagattaaaacggaacgagacgactttaacgtggtttttggacagatttgataagatatgttaaagaaaaacctttccttcattttggcatgatcccataactatatgtgtttgataactagccataaagagaactttgtattcctaaagatatatacattatcctagtttcataagttatagtattctcccatatcgggactttatatttagtttaatattgtcttctttcagccaaaagagcatagagtctgtatatatatagtattacagtattttcaccaccaccgagctataatcggtgggcaggtccttattgggcaacctctaatcagatggtaatttatatactgaggctactatggctgagcgcctatgagcgagcccaaaatggccgagatacagagcctagtatggtcgagtgcctatgagcaagcgtactacgaaagagtaattatatgtatcgagccttatagagtgggaaaactattttacttaatatatttagagatttgagtcagtatcagatggtaagcatatcttcagatcatctttgactcctagttactttcagttataatattatcagttcaatttcagctttcacttattctattgccttacataattggtacaatatttcgtactaatgtcccttttactggggacgctatatttcatgcctgcaggtcctgatagagagctggataaaccttcttagtagacagagccaaacatcaacttggttggtaagctccacttcctcggagttaccaggtctagaccttgaagtccactttatatatacaggtttgatggtaggtcgaggccctgtcccgaccatgatatagttttgttatctctagaggcttgtagacaagtcctgtatagtttttatatcagtagatgttcatgacagcctcgtcagcctacatagttatatatatatgtatatacatatatatatatatataccatactgggtgacgaccacgcctccccaagtttggggtgtgagatgaatgtccaaatccaatggcatttcctctgccgaaatgaatgccaaactacccatactctcgacctttctgctcaaggcatccgcaaccacattgtccctgtccggatggtaaagaatggtaatatcatagtcctccagtaactcaagccatctacgctgcctcaacctaaggtccctctatttaaacaaatgcttcaagctgcgatgattggtgaaaaccttacaggacaccccatagagataatgccttcagattttgagagcatgaactatcgcgaccaaatccaaatcatgtatggggtaattcttctcgtggcacttcagctgatgtaaaacatatgcaataactcgcccttcctgcatcaatacacaaccaagccaacgcacgaagcattacaatacacgacatacatcccagaactatatggcaacactaacactagtgttgtagttaaagcagtcttaagcttctgaaaactcctcatcttggtcgcatggtaaaacgaggctaactctagactgcctcgatcttccttggatctaccttaatcctatcacctaatacaacatgccccaagatagccacaaaattcaaccagaactcgcacttgaagatcttagcataaaggttctgttccctcaaggtctgaagcactaacttcaaatgccgctcgtgctccttcatactatgcgaatagatcaatatgtcatcaatgatgacaatgacaaatgactaaatatacggcctaaacggtcggttcatcaaattccataaatgcaaccggagcattggtcaagccgaaagatatcaaaaaaactcatagtggctatatctagcctggaaggccgtttttggtacattccaagcatggatcttcagctgatgatacccataacttaagttgatcttgggtaacaccctagcactctgcaacatgtcaaacaaataaccgatgcccgacaatgagtgcttattcttgatggtggctttgttcaactagcggtaattaatgcacatccccacactcccatccttcttcttcacaaacaataccagtgcgccccaaagtgacacactgggtccaatgaaccccttctgaagcaactcttcaagttgctcctttaactctataagctccttaggatccatacgataaggcaaagcggaaataggcttcgtgcctggcaccaaatcaatatcgaaattgagatcctgatccggcggcgtacctaatagatcaacatgaaatacatcagaaaactctcgtactaccggcactgaatctaatgtgaaagtatttgcagtagtatcccgaacaaaggccaaataggccaaacaacctttctcagccatatgttgagccttcaagaaagaaataacccgattggaattaccaacagacgaacccctacactctaatctgacaagtcaagcatcgccaaggtaacaatcttggtataacgatcaagaatgacatggtacagggacaactagtccatgcccaagataaccttgaaatcaaccatatggagtaataaaagatccgttctagtctcaaatccatataaagtcaccacacaagaccagtagacctgatccacaatgacataaacacccattagtatggacacatatacaggaacgcctaaggactctcgaggtacatccaaataaggacaaaatagagaagaaacatagtagtaagtagaccttggataaaataataccgaggcatcccaacgacagacataaatagtacacgtgatcactgcatcggaggcgactcctcgagcctggcaaggaaaggaagaatctagccggagtgccatctaactagcctccacctttatggcgacccctacccacctaccctgcacctctaactggcctggtgggcggtgtggtagatggtaaggtaatcataggccaatggtcctgctacttgtccttgccccaaagtctgggacaaaaccatttcacgtggccaagatcctcacactcaaaacaacccctcggagtagtggattgctgacatgaagtctaaccttgatggcacgaatcccactagaggaacccagaatagttggcggatggtaagtactttctggaatggcactgacgtagggtcgtactggagcactctgagcaagcggtggtgctgacaacatgggtctgctagactgacccctcacaaactaacctctacccctaggtgggctgccactgaatcctccaaactaccatggcttgttgtccctcggtggaaactctctgttgtggttgcgaatatactcaatcttcctagctatatacacaactttatgaaagggagtccctatcactgcctaacgggccatgaaaacctgaagctcagggtgcagtcctgcaatgaacctctgcaccttctcttcatctgtggggagtacaatagctacatggcgatacaagtaagtgaatctcgcctcatagtcggtcatagacatatgaccttgacagagtccctcaaactgacctcgaagctcctctctctcaaaaggtggtatgtacttctccaagaacagatgttgtaaactgatcccaagtcaagggaggtgaacctgcctcctaaggaggtaagcttgccaccatctgcgggccttgcctcaagtagaaaggtggtgaagtccactccgttggactccaatatccccttgttccgtagtatatccttgcatcggtcaatgaaatcttgggggtccttcgaccgctcacccccaaagttagaggggagaagtctagtccatctatccagctgcttctgttgatcaacagtcgcgactggtacagactctagaaccgtaggtgcaactggctggggcccgcccgtaggtagtgcacctggggtccgataaacggcagcgacttgccttagagcatgagtggcaggggcttgtgctccccctcccgcctgagatatggctacgtctgctagaaataaaccatcctgcatcatatagtctatgaaccacaacatacaacccatgaccttttggaatcccgatgcagtcatgaaatctgttggggctggctaagctgtaggcgtcttatccttctcctaaataataggatccttcactggatccactggtagtacaacaggagcaactctaggacaccctcgtgctctgacaagagtcggagcccttcttgagcctcattctgtagcaacagggggagcaactcctctattgcctggtgcatccgccacgaatattctcaccatctgtgagagatcaatagaaagatacttagcaccaaatctactacacgataggaaatgaagaaagataagtttcctatcaccctatagtctctgaaagataactacaaacatctcggcaccgatccgcacgactctactaggcctactcatgactcgtgagacctatgtgaacctaaagctctgataccaagatgtcacgaaccaaaacccatgataggtcgcgatggcacctaacactactgtttggcaagcccacaagtgggcctataatttaattactcctttttaatagctaaaacacaagttttccttcttaaaagaaggaaataagtaagatttcatgcaaccgtacactcttttctcaacaaaataccagcgtgataaaatacatccattgtagtgacagtaatgataagcaccacaatacataaatactaaaaagtccccaaaactcggtgccataagtgtatgagcaatctagagagtatataaaactaatacaactactgtttgaaaggtaatagataaaaataataaacaaggtagagggagactccggtgctgcagatcgtatcaaggaaagcaaatcaccactaagtctccgtagaagtgcggctaagagctcatgtgaccgctggtagtacctatatcagtacctgcacatttagtgcataagtgtagcgtgagtacgaaaaataatgcgtacccagtaagtatcttgtctaacctcggcgaagtagtgacgaggggtcaacttgacttttactagaggtcaaaatagtaatagaaatacataaagtagacatggtgagtgtacaacaagtagcaatgaagcaaataaaagtaactatagtaattccacacataagtctatatcaaatcactaaacatgtaataaccggccttgaaggtgcaaactaaactgttaccaaaccaaatccagtctcaattattaagcacgaagctaccaaggcgaatgacccgatcccataagaatagtgttatcaacctgcaggcgaacaacgcgatcccataagagtagtgttaccatactgccaaggcgagcgtcccgatccgacaagagtaaaaaagtttacctcactcacgaaaacacatgcgaggagagatgacacggatctatagtttatcaaatatttactatttttttcaaagtaagaggctaagtcagtatctttattaaaatccttaatctcagtcataatcaagaaaattaatagacatgataggcataaataacataataaaaggcatgttgtgaatctaagtttacctggacatatcatgaatataactacatacggactctcgtcaccttgtgtgtacgtagctccccacaacaagtagcacacaactattaatacaccaagtcctcaatccgctctttaaccttactagaactcctcaaacgatgtcgaggagtccgaaactaaccaagagtcgtataaactaataaatatatgttcaaaagttcataatttaactattaaactcatttcccaaccaaatctgggaagtccataaaaatcacctcatacctacgtgcccggattctgaaatatttttgaataaaaatgttacccatgacctcagaaactcaaatatataatttattcccaattacataatcaatttcgtggtcaacctttgcgatcgtagacccctcttcgcgtttccgtaggcaatcagctgtccctctaattttcctttttcatgatcgcaggaccatcttcgtgatcgtgaagcacaccagcacaccaacacactagcagtctttagccaagttcaaacatgctccgggtggtccaaaacacacccgagtcacccgggaccccatccaatgcaccattaagtccataaacacattgtggtcctactcgaaacctcgaaacacataaaacaataccggaatcaagaatcacacctcaaaacctcattaatcaacttctaagcttcaaacttattttaaccaactctgaacgcgtcgaaacatacatagacaactcaaaatgacactaaattttacgtacaagtcataaattaccatatggacctattcctaggctctgactcccaaacaaagctcgataacaccaaagtcactgcaaaacaaatttaaagaactagaaaacctttaatgaaccaacttcaacattaggcgcagaaacgtgcctaggttacccaaaactcgaaccaaagacacgcccaagtttgaaatcatcatacgaacctattagaacaatcaaatatcggttccaaggtcgtttactaaaaatgttgacccaagtcaaacttaatcaccttaggctactgttaaggaactacgtgttccaattttaacccgaaccattccaaaccagccatccccccaagtcataaaatagtaaaagcacctgcaaaaagtgttaattaggggaaaaaggatctaaaaagcaaaacgattggttgggtcattacactaactcaggtgtcctttcagtttactctctttgtccaattttaactatcattttatcttgttactagttactagctcgaatgataccaaaggtggccacagatctgaatcgagggcggacgaatgatatattgggaatcaagcatggcctaacccgagaagaatcaagctcaagagaaatgaagaattgagggtaaaggaaagatggttaaaatagacaaacatggagccgaaatatctgcaatcagctggatattgcaacaccaatcacgttcgatattaactgcggattatgttttcttgggagaaaaggaaggggaggatttttaccttatttagacttgtattagggttaaaactcctctactatataaagaggggaacctttctattttttaggtcactattggcacacatatcaaaataataaagtttattctggcttttagcaaattgtctaagtgttcttcaatcgctcattgacttagccgtttgaactccatctcgagggctcagttatggtgaatagttagtgtttaagactaacatggggcctaattacttcaacatattggtttgatagtttattctcacttcaatttaattatttattgttctttaatcatttgtgttaaattaaaccacatatcctttaaatcgcatacaaattttattgttatccattttaagggtaaacaatttggcgcacatcgtggggctaacgataatagtggtgatttaaggtgaatcttgataacatacactattttacacttgttgatttcaggactgttctatatgttagatttcaatctggtcacataagtgttgacgccgaatcaggccaccatggtgaaaataacaacggcttgccgagttacaatgtagaccctgtcgaccctcatggcattccattcgcttaccaaattgatgctaattcacaggatagtgtcaatgctaacctaccaactaaccccaataacaacatgcatggggtaccttgaccgtcggtttgcgaggcacccgaagggggaggtgatgaagttatcttgcgtttgatttttgagattttgtaagcctaataagttgccatagtacaaccgttgattccagatcacaatgcggctgaacctgattggtttagagaagatgctcagaaggaagaatggattgtcatagaaccctacgggcccagatccgtggaaacatccgaggtgataaaattcttgaagcactgacaaaacgagtagaatctgacgaaaagaagatataggtaaatgaaaataaagtggaaacttacaagatcagatgccgggagcaccttcgatatttaaggggccagattctaaaaagttcattaagaagccttttcccctgagcgcgacaccaaaaccaattctgaaaagggtttggatgcctgatattttcaaatacaacgggaccatagatccaaacgagcagatgaccttttacacatgtgcaataaaaggaaacgacctcgaagatgattaggtcgagtcggtactcctaaaaaaatatggggaaaccttttccgagggagtaatgatatggtatcacaacttacctccaaactctattggttcgttttctatgcttgcatatgcctttgttaaagctcatgttagggctgttaaagttgagatgaggaaatcatatttgttcaaagtcaagcaaagggctaactagatgcttagagaattcatgtcgagattctaaatgtaacgaaaggatctgcccccagttgcagacgactgggccgttcaagcatttactcaatggctcaacccccaaagcttgattgcatctcaacaattgaagcaaaatttggtagggtacccagaggttacctgggttgatgtctataacaagtatcgatccaagataagagtcgacgatgaccaactaggggctccctcggggttggtttatcccaatagatcaaatgaccagtctaaaagaatagtggatcagaagttgaggtcaccccgagatcgataccaaccttaaaactcaaatagaggggaaaacagacctagtctctacccgactaggaacaatagaagaaatgatcatagtccaagcaatcgagggttagtgaatagaaacggtttcggcagatcacacggagtcaaagattccccaaagctatcagaatataactttaacgtggatgcaacgagtaacgtgttagccatcggtcacatcaaggataccaaagggtcgaggccgcttcagcatgatgcggaacagtgagatcacaatttgatatgcaaatatcacggtactcatgggcatagaaccaaggattgtcggaagttaagggaagaagtggctcgtttgttcaaaaattggcaccttcgggaattcccaagggagtgggccaaaaaccatttcaagaatagggacgccaacaagcagatcgagtaggaagaacctcaacatgtgattaacatgattattagaggagtatacattccatagggatagatgataaaacgcacccaagtttctatcacaaaagaaaagtgaactagagattatgttccagaaggatctatctcgattagtgatgaagacgctaagggaatcattcaaccctacaatgatgcactggtaatatatgtattcattaataaatctcgagttatgtgtgtgttaactgatccagatagctaggccaacaccatttgatggagagtcatagaacaactagggttgttggaccagatcattccaggagtttaagtactgaacgggtgcaatatggcgtgcgagacaacaaatggtgaaatcaccctactggtcaacacagtcaagaccatttagcaagagaagttctatatgattgaaggtgatatgaggtacaacaccttattcggaagaccgcaggtttatagtatgagggtggtaccatcgaccttgcaccaagcgttgaaatttctatctccatatgggataaaaatcatctacggggaacaaccgaccacaaagaagatgtttgctatcaaagaagtgatccaaacacccgtggtcacaacatcaaaagataaggaattatcgaatagaaaggaaccaaatgacaatcacaggtctcggcctcaactgaaccagaaaaacaggaggagtatctaaccgatgaagaagatgatttcggggtcccaagattcattatattaccaataaacatcgattccaccaagtcaacaatcaaggaactggaataagtcatattgttcgagcatctgcctgatagaaaggtatacctgggcacggggataacccccatgctcaggaaaaaactcattgattttcatataattaatgtcgattgctttatctagtcttacttagatatgacataaatcccactggagatagaaactcacaaattgagtttggatccgaacttccactcgattaaaaagaagaggaggccacaatctgaagtcaagcttgcattcatcaaagatgaggtatctaaacttttaaaaataggttccattcgggaagttaggtacctagattggctagctaacgtagtcgtcgtacctaaaaagggaaacaaacttagaatgtgtgtggattataaggatttgattaaggcatgtccaaaggactcatttcctttgcctaacatcaaccgaataatcgatgcaatgacagggcatgagatgccgagctttcttgacgcctattcgggtgaccccaaattcggatggacctggggaaccaagagtaaacttattttataactaaattcggaacttattattataatgtgattccatttaggttaaaaaatgccggttccatgtatcaatgcctagttaatcgaatgttcgaggaataaataaggaaatcaatagaagtttatattgacgatatattagttaagtccctgcaagtagaggacaatttgaaacatttgcagaaaacctttgacatatagagggaatatgatatgaaattgaattaggagaagtgtgccttcggagtcggctcgggcaagttcctgggcttcatggtatctaaccaagaaatatagatcaacctggatatgataaaggccatagaagatataaaagccactgatttttctcgttactaaagaaaatgagtgacttttcttagagcccatagttccataaggctttggaagaactcaaacaatacttatcgagccctctttttctgcacaccctgaaggcaaatgagcatctatacctttacttggcggtgtttgaggtagcggtaagtggtgtcccagttcgaaaagaagaaggtacacaatttcctatatattatgatagtagaactttatctaatgccgatgcatggtatccacacctagaaaaattggtgcttgccttgctaagcatatctaggaaacttaaaccatattttcaatgtcatcctatacgtttcgtgacctcgtacccattaaggaatgttatgcataaacccaactcgtaggtcagctgacaaaatgggccgtagagattagtaggtacgatattgaatacaagccctaaagaactataaagtctcaaatattggcagacttcatggccgatttcacatcgtccatgattctccaagtcgacaaagaattattactttccttgggaactagctcgggggtctagaccctattcacggatagtgcctccaacatgaaagggtcctgatggtaggctagaaacccgtatttgaaccagagtttacactttaactaatgcattttacgtttgtttgagcataactgataatgaattgtacttattatgtgtttttatgtcttgtaagagttaattccaagtttaaaaggtgaattggagctaaatcaaataagttggagctttgaagtattagtaaaaccccaagaaatccagcgaggatcacgctcaggggtcgaggaccaagtccgaatgtcaaacaatgaaagaaacaatttactctagaaaaactacactaccacgtcatatggggtgccacgaggcgtgacgcaatagtgaaattcctgcctgacaaacaaaagtcaagccccctgataaccgccacaggcaagccacgtggggcacaccctacgccgcgtctatgcattctgggttagagtaatttctgtttcagcttgaaaagggtagtttcatccgggcccagctttacactgtttaaatacatcaaaaatatgtttttgaagggacttttgacctacaaaagatttgagaagtaaccaaggcaagaaaatacaagaattcatcaagatttcaaccaacaatcggtgcaatacgggagtttgtatcgaatcattagcattgatgttttctttgcttttaaaccttattgagatgactttttccattgctatggagtaatttccatttgggtattgacagatatggtgttttgattagggatttgattcttgataattgttggaattaattgatggagtcttaattcgtattgtggagttacttcttattttgcttaatcgaacgaggagcttgatatttaatttcattacatcttatgatctagttttaattcgtgattcaagaaggtaatcgaaatagcctcttgaattattaatcaaactagaaaataggaaaatatttgtgagaacttacctttagatcataaccatcattttatatttgcaattgtttactgttgatacccaattttttcccatatattatttaatatgtatatatactttcaaatagcacttatgcagttatgagcatgcataaacattttttataatttttaaaatctccaaatcaatttatttcctctcttttatttttaaaatatccaataattattctccaaattacttttgtgatgatttagttatctaaattctttattgataccaacatagtgattaaatatttttagtacattttttgtaattatattatcattttaggctaaattgcacatctttgcaataatagcccatactaatgcataattacattattgatgcataaaatggtcttttatatttttaaaatattaaataactattttaaatcattttagtacacgaaaatatttttttagtacaccaaacccgaatcgtcccgaaaaccccacaaatagccctgacctaaaataaactaaatgacccccccccaaaccctctcatttccttaccgtctgccgctttgaaatccctctcctctctcaaaatgctctcaaacctaaccctagtcgtcactcatatatggctatcttggtggcttcccaccactccccatgcctctaatggccccccttacgttggtattgccatctccagggtcctcaagggaccaaggttagttggattgcatctatggcccctttctcacttgtttcagactatgatctatgggtttctaagcttgtttcttcacctctgtcttgttctactcgaaaccctaatttctttcttctgaacctcttagatctatacagatctgagatgatttagacttgtttcatatgatttttacaataaccttgtaattttttacaagaattgtatgattttcgagtgatttttcatctttctataagactagggtttccggaaatttcttttttcaaacatttggtaatttttgagtgtttgatcttcttcttcttttgtgttttaactgatttcgtaagtttgctataaccttaacttgtttatactaaaacccctaagttttgacatttctttgtttggtttctgattactagtctactgattgtgttctagccttagttcttgtgatttctctttagtcatttaaatgtctcgtggttttgttgtcctaatatgcctctactgaatttcttagttcaacctttcactgatttatatgttcgtgttcctcctgtttcttcatgttatgacctatatctttctccttgaattagtgccgatttaactatttgttttttaaaattatgtgtcgaatccggactattcatttcttaccttattctatctacttaatttgctgactctttatgtgaatttctctttgattgaacccttgattattctgaaatccttacttcctggtttgatttgaacatttttccttaacaaaacttttgattcttacctgtcacgaccccagttcgcccttcgtgaactgtcgtgatgacacctagtctctacaactaggtaagcctaacaaatgaggaacataagcgaaacttgcggaagaaataataaaaaaccaaaataactgaatggaaacaatagttataatgccgctcgacatatacaacaccacattttcaaaaccaagtacactatcccaaaacccggaaactcacgaaaactcaagccttttgaatatctaacagtctatctccagaatatctaacaagaaagaaaaacaatacagaagggcaatgtttaacaactagaatagaaagggacttctcggtctgcggacgcggtagatgtacctcgaagtctctagagtagtcgcctcctcaaggatgataggcctgagtagcggtacttggatctgcacatgaaaaacatgtgtataagggtcatgggtacaccacaacggtactcagtaagtgccaagcctaacctcagttgggtagtgacaaggaaggtcagggcctactgagattaaataaatataaagatgacaggataagataagcagtacaattgagaatctacagtaagaatctacacaggataataagagtacaataacggaaacagagatgaaggcaaaccacaaggaagtacaactcataacaaggatgataaccgggaatctcttggtatcttctatgcatacaagggatctcttggtatcccggggatctcttggtatcctcaatatatgttggggatctcttggtatctcgaggatctcttggtatcctcaatatatgttgggcatctcttggtatcccgaggatctcttggtatcctcaatatacatgccacggatctcttggtatcccgtacttcagtctagattataaatacgtacaagggatctcccgggatgccatcccatagtcccaaattaaaaacacacagcagcaacgtaagaatactcaataattgctaaatttcgaactaagtaaacaattaattctagtctaacatgcttcacgaaatacaattgaggtagtttaagcaaataggcaattaagtcaactaagcatgcttttctaactaacaacaggccaaaatcgcaagtagaataaaacaggaaaaaggaacttaattgaaatacttaaagaaaaaccagattttcaacaattagctcaagtacgcactcgttacctcacgtacaaagcatttcaattattaaatatgtcatatcctaaggggaaggtcccctccacaaggttaaataagccacttacctcgaatcggctcaaaatcaatccgaaaccacgctcttgccacgagtactcgactccaaatggctcaaatctattcaattcaatttcataacttaaataacacttcaagtaactgaatctacaattaaattctaagctaatacgcgaaattaggtaaaatgcccaaaacgtccctcgatcccacatcttggaatcaggtaaaatttatattatcagaaacctcacactctcacgagttccgtcatatcaagagtaccaaaattggacctcaatttgtcccacaaatcatcactcaaaggtctccaattatacaaaaatctttaattttccttaatttttcatgcttaaattgataaaaatcactccaataacgagtttacggaccaaagaccttaccccaatgaactcctctgaaagtccctcttgaaaagtgctccctaagcttctttcctaagcttatgcccagcaatttctgcatttacggccctcggaccgcatttgcagagccaaggtcacatttgcgacttttcattaaaggccaagttccgcatctgcgactcccaatcagcagatgcggtaccgcttttgcggaattaccaccgcttctgtaattcctgaagagattcccaaatttcgcgcgctgcacctgcggaacccaaaccgcaggtgtggttagacagaactagcagctgaagctgcaactctaactccaaaatctttctgtcaaccatctgaattcatcccgaggcctcagagacctcaaccaaaggcacgaaaaagtcacaaaccgctatccaaacttgtaccaatccttagaacacctaaaacaacatcaaaacctcgaattaaccatggattcaagcctatgaactccaaaattctcaaaatacgctttcgatcaaaaggtctatcagacctcgtccgaatgacctaaaattttgcacacacgtcacattcaacactacagagctactccaactttcggaattccattcctacccttggatccaaatctcactatcggaccaaaaatttcaaatattcaactttcggcatttcaaacctaaattagctacggacctccaaaacacaattcaaacacgctcctaaccccaaaagcacccaacggagctaatagaaccatcagattttcattccgaggacgtcttcatactgttctgactacggccaactttccaacatttaagctctcatttagggactaagtgtcccaaaaatctccgaaactcaaaaccgagcatcccggcaaatcaaaataatagaaataaactcgggaaaagtagttaataggggatcgaggagttaattctcaagataaccggccgggttgtcacatcctcctacacttaaatattctttaatcctcgaacgagcatagagacatacctgaagtagtgaaaagatgagggtaacagttgcgcatatcttgctcggtctcccaggtcgcctcctcgaccggttggccccgccactgaacttttactgatgcaatgttctttgacctcagtttttaacctgcctatcaaatattgtcactggttcctcaacataagatagatccttgtccaactatactgaactgaaatccaacacgtgttacggatcaccgtgataccttcggagcatcgaaacatagaataccggatgaactctggccaagctgggaggtaaggcaagttcataagcaacctccccaacacacctcaatatctcaaaagggccaataaatcttggaatcaacttttctttcttcccgaatctcataacgcccttcataggcaaaacccaaagcagaccccactctccaaccatataggatcctgaaccatgtctatgcccaataatctggcctcacctggctcaaaccaacccaccagggatctacaccgtctcccatataaagccttatacggtgccatctgaatgctggactaatagctgttgttgtaggtaaactctgccattggaaagaactaatcccaagaccctccaaactcaatcacacacgcacgaagcatatcctcaagaatctgaatagtgcgcttggactgtccgtccatctgagggtgaaatgttgtgctcaactacacccgagtacccaacttatgctgaacgaccctccataaccgtgatgtgaattgagtacctctatctgaaatgatggacactggaataccatgcagacgaacaatctcccggatataaatctccaccaaccgctcagaggaataagtaatacacacaggaataaagtgagtggacttggtcaaccgatccacaattacccaaatagcatcgaactttctcaaagtccatgggagcccaactacaaagtccatggtgattcgctcccacttccactccgggatctctatctgctgaagtaacccacccggtctctagtgctcatacttcacctgctgacaattgaggcaccgagctagaaatccaactatatccttcttcatccgcttccaccagtagtgcttcctcaaatcctgatacatcttcgcggcacccggatgaatggaatactgcgagctatgggcctcctctagaatcaactctagaagcccacaaacactgggtacacaaatccgaccgtgcatcctcaattccccatcatcactaatagtcatatctttggcatcactgtgttgaaccttctccttgaggacaagcaaatgagggtcattatattgccgctccctaatacgatcaaataaggaagaccgagaaaccatgcaagctagaaccccactgggctctgaaagatccaatctcataaactggcaggctaaggcctgaatatccatcgccataggcctcttcgatgctggtaaataagccaaactccccaaactctccgcccggcgactcaaagcatcggccaccacattggccttgctcgggtgatacaaaatagtgatgtcatagtccttcaacaactctaaccacctcctctagcacaaatttagatccttttgcttgaacaggtgctgcaagctccgatggttagtataaatctcacaaggcataccgtataagtaatggagccaaaacttcagggcgtgaacaatggcagctaactcaaggtcataaacattgtagttcttctcatgtattttcaactctctagacgcgtaggcaatcaccctaccatcctccatcaacaccgctacgataccaaccctcgaggcattacaatagactgtataagatcccaaacatataggcagtatcaaaattggggctgtggtcaaagctgttttgtgctcctaaaagcttacgtcacactcttccgtccactggaatagagcacccttctgggtcaacctggtcataggggccacaatcgatgaaaacccctccacacaatgacggtaatagcccgccaaaccaaggaaattgcggatctcggtagctgaggatggtttgggccaactctgcacggcctctatcttctttggatctacctgaataccctcactcgataccacatggcccaagaataccactaaatccaaccaaaactcacattttgagaacttagcatataacttcttctctcttagagtctgaagcatagtcctcaggtgctgctcatgatcttcccgactccgggaatacaccaaaatatcatcaataaagacaatgacgaatgagtcgagatacgaccagaatacactatgcattaagtgcataaaggttgctggggcattgttcagcccaaatgacatgacaaggaactcgtaatgaccataccgagtcctgaaagtagtcttcgggatatttggctcctaaatcttcaactgatggtaacctgagcgtaaatcaatcttagaaaacactcgtgcgccttgaagctagtcaaaaggatcatcaatacgaggcaaaggataacggttcttaactgtcactttattcaactggcgataatcaatacacatacgcatagagctatcctttttattcataaacaagacaggagcaccccaaggtgatacactaggccgaataaaacccttataaagcaattcatgtaattgatccttcaactccttcaactgaagaagattcatatgatacggaggaatagaaatgggctgagtgcccggcaacaaatcaatcccaaaatcaatatctctatcaggcggcatacctggaaggtcagttggaaacacatcaggaaaatctcatactactaggactgaatcaactgaaggggtatcaatactgacatctctcacataatctaaatacgtgtcacaccccttctcaaccatacattaagttttaacaaaagaaatcactctactgggagtgtgatcttaagtacccctccactcaatatgcggtacacctagcatagcagcgtcacggttttggcgtgataatcaagaataacataatggggcgacaaccagtccatgcccaagatactgtcaaagtcaaccatgctgagtaacagtaaatcagctctagtcttaaaatgacaaagagcaaccaaacacaaccgatagatgcggcccacgacaaaagaatctcctacaggagtagaaacataaacaggggaaatcaaagaatcctgagatacacccaaatgtggaacgaaataagaagacatataagaataattagagcctatatcaaatagaatcgatgcatctctgtggcaaaccaatataatacctgtgatgacagaatcggaggcaacagcctcggtacgggcaggaatggaatagtatctaacctggcctccccctctagggcgacctctacctcccgacctccacctctagctggctgagcaggtggagtagcaactagagttgtaatcatagcctaagaactctctgtggcacgctatggctgagaagtttgtggaggtgcactcctcccaagtctagggcaatccctcaccacgtggcgtgtgtcaccatactcaaaataagctttgggaggatgtagaagctttgactggctcagaccaggtctgctggattgacctttggaaacaccccacacagaaggtgcgctagaaaccggaggtgcataataaggctcctgaatcataggaggagctggagcactactggctgttgggagagctgaatgaataggatgaatcatataacccctattatgacgaccttcagctggggtacgggcacaagaataatggcccgacactcgagaccccttggcctccctctcctctcactccctagcatgcataccctcaatcctcatagcaatgctcaccacctgctgataagaaacatccatatccaactcacaagacatgctagacctgatgctgggaataaggccctcaataaaccggcgaactctctcctgaacagtagaaaccaaggcaggtgcatgcctagccaaactagtgtaagagacagcatactctgagacagtcatagcaccctagtacaaatgctcaaactctgcgtgccatgtgtccctaaggctctgaggaacatactctctcaggaacagatcttaaaattgagtacaagtcagtgaagaagccttatccggactgtctaacacattggtgtgacaccactcaaaggcagctcctcgaagatggaaggtagtgaaggaaactcttctcgatcctaatatacccatggtacggagaacgcagtaactctcatatagaaatcccaaagcatcctccgatgctagaccgttgaatacatgaggcttgtacttcttgaacttctcaagcctcagctgctcctcctcgaaagtcgcttccctatccccgggctgaactggtactgcaggcggtacatgaataatcttagggacctattcaatatgcactctctgctcaggagtgcgggtggcgggagtctgtgcttctccccccgcctgagaggtggctgtagcaaggggaagcaaccctacctgagccagagtggtgtacatgctcatgaactgtgccaaagtctcatgaaaggctggagtagtggtagcagtagccgtgtcaggcacctattctccggctggaattgatggtggtacctcagcgcagctcgcgtaggtgttctggttgcaccatgtacgcgtcctttgcctctaccccggccctggcctctgacggttgcagtagggggtacgggtgcctgatcatctctggtagtttatgtcctcaccatctgtgagagaatagaagatagaagtttagaattgtgatgtcaaaatatcgcacgacaaggaaatcaaatgaagtggaattttcctaacagttacataggctctcgtagataaatacagacgtctctgtactgatcagcgagaatctaataaacgggcttgtgatccatgactcatacaaacctagagctctaataccaacttgtcacacctcagttcgccctccgtgaactgtcgtggcggtacctagtctctatgactaggtaagcctaacaaattcagaacataagcaaaacatgcggaagaaataatcaaaaaccaaaataattgaatggaaataatagatataatgccacttggaatatacaacacaacattctcaaaaccaagtacattatcccaaaactaggaaactcatggaaacacaagcctttggaatatctaacagtctaactccagaatatctaacaagaaagaaaaaaatatagaagggcaatgtttaacaacttgaatagaaagggacttctcgatctgcggatgcgacaaatgtacctcgaagtgtctagagcagtcgcctcctcaagtatgataggcctgagtagtggtacctagatctgcacatgaaaaacatgaacagaaggggcaagagtacacaacagtggtattcagtaagtgccaagcctaacctcagttgggtagtgatgaggaaggttatggccctactgagattaaataaatataaatatgacaggataagataagtagcacaattgagaatctacactaagaatctacacaggataataagagtacaataatggaaacagagataaaggcaaaccacaatgaagtaccactcatatcaaggatgataactgggatctcttggtatctcgaggatctcttggtatcctctatgcatacaagtgatctcttggtatcccgaggatctcttggtatcctcaatatatgttggggatctcttggtatcccgaggatctcttggtatcctcaatatatgttggggatctcttggtatcccgaggatatattggtatcctcaatatacgtgtcagggatctcttggtatcccgtacctcagtccagatcataaatacgtacaggggatctctagggatgtcgtcccgtagtcccaaattaaaaacacacaacaacaacgcaagaatactcaataattgctaaatttcgtactaagtaaacggtttattctagtctaacatgctccacgaaatacaattgaggtagtttaagcaaataggcaattaaattaactaaagatgcttttataactaacaaaaggctaaattctcaagtagaataaatcaagaaaaagaaactcaattgaaatacttaaagaaaaaccggattttcagatattagctcaagtacgcacctgtcacctcctgtacaaggcatttcaattattaaatatatcatatcctaagggtaaggtcctccacacaaggttagataagccacttacctcgaatcgactcaaaatcaatctgaaaccacgctcttgccacgagtactcgactccaaatgacccaaatctattcaattcaatttcataatttaaataacacttcaagtaactgaatctacaattaaattctaagctaatacgtgaaattaggtaaaatgaccaaaacatccctcgggcccacgtctcagaatcaggtaaactttatattatcagaaacctcacactctcacgagttctgtcatatcaaaagtaccaaaattggacctcaatttgtccctaaaatcatcactcaaaggtctccaattatacaagccctaactctccaattaacactaattttccttaagatttcatgcttaaattgataaaaatcactccaataacgagtttagggaccaaagaccttaccccaatgaactcctctgaaaatccctcttgaaaagtgctccccaagcttctttcctttttaaaagatgaaaaatggctaaatttctcaaaggcaagaatttatatgttatgcccagcgatttccgcatttgtggccctaggaccgcatccgcggccccgcttctgcgaagccaaggtcgcatctgtgacttttcattaaaggctaggttccgcatctgtgactcccaatccgtagatgtagtactgcttctgcggaattaccaccacttttgtggttcctgaagaaattcccaaattccgcatctgcgtccactaagccaacccaaaccgtaggtgcggttatgatagaaccacaggtgaagttgcaactctaactccaaaatcttttcgtcaaccatttgaattcatcccgaggcctccgggacctcaataaaagtcaccaacaagtcacaaaccactattaaaccttgtactaatccttagaacacctaaaacaacatcgaaacctcgaattaaccatggattcaagcctaagaactccaaaattctcaaaatacattttggatcaaaaagtctatcaaacctcatccgaatgacctaaaaattttcacacacttcacattcaacactgcggagctactccaatttccggaattccattccgactcagatccaaatctcactatttgactagaaatttcaaaaattcaactttcggcatttcaagcctaaattagctacggacctccaaaacacaatccaaacacgctcctaaccccgaaatcacccaacggagctaacggaaccatcggatttccattccgatgctgtcttcacactgttccgactacgaccaactttccaacacttaagctcttatttagggactaagtgtcccaaaactctctaaaactcaaaaccgaacatcttgacaaataaaaatagcagaaataaactcagggaaagcagttaataggggatcagggaattaattcttaagacgatcggtcgggtcgtcacattacctctctactctgtttaattgaactgcttgccttaattaatttttccttgccttatttatattttgctgattcttattgattgtttccttaattgaaacccctgtgcattcacccctaattacctactctgtactcgatttccttccttaagtatctgtcccgcttttaccattgattatcctttgattaaagggaaagacttactgattttacatgtgattgattccctgaatttctctaatttctacttaattgatcccttaccttattttgctaagcttttgattactatataaactcactcctattctcacttataacaacgaacattagttcacaaaaggcacacctacactctaaagctctcttttctcatctgctacttgtgatattcactggtctagccggctgaaagccaaggctagatattggaactacatctgttttatattctgcactctttacttcaactggtatgtctctagttaaattttgaaatccaaaccctatgtgtttcattcctgcaccctatgtgtttcattcctgcactagttcatcaaccatgaatccaacttgtattcctgcttacttctttacctagcatgtctaaactctatcatgttcaatgtatgattagcatatctacactttacctagttatttgatacttaaccagtctatttgtgaatatttgttcaatccctaattatgtgatcatgttggctatttgatgtatgtgatagaccctacttatatctttaatcctgttcaagacatatcaggctttttatattacaactgtgatctatatcttaactatttactgtccatgactagcctactaagtctctaagaccctaaatgttttatgcagtttgttgactatatgtttcctctataccctatccatatacccctattgtgactctaatgccccaatccctttatctccatgtgagatctatttgttgagtgtttctaaatctggatattttatggccaattgattgtctgttgtttttcaaaagagttttggtactcttctcaatctgtcttttaccaccaaactatttcttatttcagaaaaccttttcactcctaaaattatctctatactattttaaaaaccttatcaaaactatgtcaagcactctcactttactcttagaatacaaagttatgcccctctaatatgtgtgctgccttgatatccttgagatctctctgaactctcgcatatcagagctggcctttccacactgcacctaaatcagttattatttgagaaaaggtctaagtgtgagcactacccaggatccttgaggtccttagggaactctgacatacctagacatgaaattggctatagaactttggcatttaaggctattggaggcttggaagtcatttgggcctactgtaggatccctataaattaattttatatttatgtaaatttgtcatttaattcattggtctgtaataattattgtaaacaaactgtggggtgattagtgaaaaagggagggtagtcatatatattgggtaaattatgtagataccatgcctataggatccatgctaattcaaatgtgtttgttatatttactttacttccacacaattagaaaccattcctataggatctaaaatggctttattaatagagatcatgcctatatggttaaaaatcagctctatagaagtcatgcctataagggtttcactttggttaattgaatgatgtttgttttaccttgcttaactagaaatcatgcctataagacttaaaatagttcagttacaaagtcagttcaattcatggttatatattctgaagtggtttaattaacaaaatttgtctgtatcttaaaaaggttttcaaatgctgcctaaattaatactgctagaaaacatgtctataggatctcaagttgtccatttaaaaacaattcaatgttttactgtattcctaatcgatatagatagcatgctcttagtacatcactattatgcgcttaggcaagcctatagggtgattaaaatccaggaactacaaaactgcgctttgagactgcccacattcaacaggtctaaaatcagtaggattcagtctttgacactttggccttaattcagtactgtataatctttgctcacctagatatcatgttttagggttttctcttaaaatacttgaaacttttatttgatacgtgcacttgcttgttatgttttggaggtaaatgtgagcctttaattgtttcctctttaaatgcagccctaactattttgattgactccaagacttttctcctttaaatactctagtatggtatagaactacccaaaactagaggtcctaaatacttccagggccacgaggaagggacgggtagtgcacgtataggacgtttatcaaggttattagaacgctttaggctataaccaaggagaggaaattgggtagtaaggatatgatgactacgcgataatgccacgtgtagcccctcattgaggaatgattaccgagcattgtgtgggtatgatcatgtaggctaacaaacctaggacccctctttccaatttccgttattgaaataaatttactttcctttatatatgtgcaacatattcaaaccttttcttttatttcattacttgaatcatacatatgcttagaatgtcaaaacatgcctttatttgcacacacgtgttaaagtcgtctatttgttaaaaggactaattcacatagtttaagttcggtcagtacccaccattgtggaccaagaggggtgcctaacacctttccctcaaggttatttcgagcccttaccctaaatctctggaaatgcaaaccagtctaagagttaatcgctctagttgccctaacgcaccacaatccgttaggtggtgattcttcaaatacccaaatcccaaaaggaaatgagttattaccaccatgaatgtcaaaacccggactttctccgcggaggagaaaaggggggcgcgatatataccatgcttcaattggattaatttactgagattaccgtttagccgaaagaggaacatcaacttcaagtgcaatctgattatctgttgaattcgtgagaatcaatagtatcatagagtgaactaactcaagaattggatcccgagtcaatcatcttgcatctgtctagtcaattacccttatttctctcattgatatttctttgttgcccatcagctatccttcgagatcaattattaattgcttaatttttagtagttaatcgtagtaatagtcatcaaatcaagtgttaattttcctggatagtaatcaactgaagattattcgaatgccatttaaatccaatccatgtggagatgataattaaactatactatctttgactagctagcaataattttgtgttgtgttttgcgctcgtcgaagcttggcaaagattcaaggatatagtgagaaggtgtcaacataatggaattgaattgtggatacaacttcaggacttttgggatggactgacaccctcctcatgaggaactttgagtattgcatgtggaggtccattaatgaggaaaactccggaggagatcgtcctattcttaatgaattgtctaaggacgctaatcagtggcctgttgagggtaatgacaggagaaaatctgttggggttcatgtcacgccccaacccggggaggcgtggctggcacctggtgccacactggcccgagcgaaccactttgtaactcatttactttctttataaatatcatggcccatcatggcgacaactcataatgtacaactgtaagtgggcaaatgttataccaatgaaccatcgttcataaaacatgaatacataagggtcgtcaaggcctctgacatactatacaaaatgaacatctgtttacaaagcctctaagattattcgacattaaatgggaaagtgtaccggcctacccataagtctgtagaaaaactctaacacattgactcttagactcggctgcacttcgaatgaggtggagtcttaccgatcctttgctgaatgccaatctcatctactatgagggctcgtcaaactgattatctatacctgcaggcatgaatgcagtgtacccaacaaaaggacgtcaatacgaataatgtactgagtatgtaaggcaaaactaaaacataacaataagtcaacattaattaaagaaatggaataaacatccactaaatcactcaatctataagtctgggtagctctataaatcatgaaatatttatggtatcatgtatatgcatataaatgtcatgtaatgtataggtatgtacatacataacatcataaagcctttgagggaatcccatcatatcatctcagccactgtgggcaaaatcatcatcgtataccagctgatgaggtggtagtacatatataataccgtaacctttttccatatctcatatatatatatatatatatatatatatatatatatatatatatatattatatgtatatacgtgtatataacggaatctgagtgatgggtaaatgcacatgtataaatgaatgcaatgcataatgaagtaagtcaatgtgatctcttggaatgtcatgagatccatgaatagacaatatagtagtgggatacatgaggaatcaataacatagacaaccttagtacttctaagaatataatcatttgtgaaacttacgtatttgctcatttcgttatatcatatggatcataccaaaagaaagaagggataaccttaacatacctagaccaattctcctgacagtccttctaacaactctccgtgttttttcataagattaaaatatttgcaatcctgagccatctatacgaaacaaaaaaggcaatagattctcattgcttctttaccatctgctaaaccttcgaattcgtttgccttccatctaatcatttattaatacgatgctgatactaaaatacacctttgaaggcatcaatgataaattaacttgaaaaatcagaaagataaaaaaaagcctaaaattgagaggagcaagttctaaaagagcgagtactaagaaatcaaagtataagttattttctggctaatagtttaggtggattctctagtagctgagcacaacatctttcaactttctattaaatttgttttggttttttacatggagcagatcatgtgcctatacatatgcatttaattatgttggtaaaatccatccaaaaatgtgaataagtggaaagtggggtccacatctctcgccaccatattgaaagattgttacatgtggcatagatgttacatgttagtcacaagtcatttttagaggggaggggaagggtgactgcaacgttatgtcttagctaatcttttaattaatctctcactaaactcattaattacccaattatccacataattaagaattaactcaaattacttaaaattttaatcatttttaatactttatacaccttattataatatactttactattatggtcatgtagtactatataaattaaatatacacactattatttattataacatacatgtaacatacatatatttttttcaacttataatttgtctaatatcatataaagagtaaaaaatttcctacgcttaattcttaaaatggtaaaagataaaaaaattcttgtgagaaaataatttatatctttacaataaagaaaatcttataaactttctcatactatgtgtataatttaaaacatattcgaaagtagtaatattaataactgtataaaattatatttttcaaaccattgtttttctttacaaataaagttccactcaaaataccatatcaaagatatatatacaatagtatcaaggttgttaaatttacggggtgtaacatccttcccccctttagaacattcgtctcgaatgttaactgttagagatttgcaaaattttcattagggtctcatctgtaaaacaaacttatacccaaattgtatcggaagtctggactattcacaacttgctgtatttgagtatctcgtatcttcctaacctttaccttatctacctttcaatctcgcatcgtatcttgtatttcttccataacctccttcaacataggtggaaattacgtcttaaatctctactgtaatacacacacttctagtgcatacaaaatctggcaaaagcttcatactgacttcttacgactcagctctatggcacgatctagaaacaaaagaagggtgaaatttcctaattgtcctatagtctctcaattataagcccataagtgagactttactaggcacgactttgtgaacttcctaggacacgacctgctctgataccattttgtcacgccctaacctaggaaggcgtggatggcacccggtgttgcactgttccgagtgaacaactttgtaactcatttactttctttataaatatcatgggccaacatggacacaactcataatgtacaattgtaagtgggcaaatgttatatcaatgaaccatcattcataaaacatgaatacctaaggcccgtcaaggcctctgacatacaatacaaaatgaacctctgtctacaaagcttctaagattatttgacattaaatgggacagggtaccaacctacccataaatttgtagcaaaactctaacacattgactcttagtctcgggtgcacttcgaaagaggtggagtcttaccgagccttcactgaatgccaatctcgtctactataagggctcatcatactgattatctataactgcaagcatgaatgtagcatccccaacaaaaggacgtcagtacgaataatgtactgagtatgaaaggcagaactgaaacataacaataagtcagcattaattaaaaacatggaagaaacacagagtagaggactcaacatgtaagtctggatagctctataaatcatgaaatatttatagtatcatgcatatacgtgcaaatgtcatgtaatgcataggtctatatgtacataacatcataaagcctctgagggcatcccatcatatcatctcagccactgtgagcaaaatcatcatcgtatactagatgatcaggtggtggtgcatatataacgccgtaacttatcccgatatcccctatacatattatatatatatatatatatatatatatatatatatatatatatatatatatatatatatatatatatatatatatatatatatatatatatatacatacacatatataatgccatctgagtgatggataaatgcacatgtataaatgaatgcaatgcataataaagttagtcaatttgatctcttggaatgtcatgagacccatgaatagacaatatggtaggaggacacatgggaaatcaagaacatagacaatcttagtacttctaagaatagaatcatttgtgaacccctttgagcctataatcctatttctttggtaaccacattacaagccttacccatttgtttgaattaaccatctatttgaaccattgtaacctctcatgagcacttgaattgtttatgaacattgtaaaggttaaagtgtggggtggttggtttggcttttgagtggaactaattaaataagaagaaaggtgcactattttgaaaaagtaagagccacttgaataaaaaaaacaaaaatatagttggattgttgcgaaaataatttcttgataagtggtggctcttgatgtaagtgtgcttaaagaagaatggggtaatatatattgatgtgaaggtggagttttgttttgacataagtatggggtttgaatgttaaagtatatgtattaaagtgcttagggaggtgtagtcactcttatatctaaatgtatcctaaccgtcccgtagcctacattacaattaaaaaagtcctaattgatcctagattaaatgagctcgattagtggagtagtacactacgggcaagcttatagtgcatcttttgtggcatatgaatgttatttttgaaagtgagtgaattctttcgatcttgagttcctaagtgttcttaaattttattgtgtggaactactctcttttgttttgtgagggcacttgattcatgaaagaaaggtaatgtcagtggcctctatgttagagtaagtgggtgagttgtgactaatgtgtggtacttgtgagtcaaatcttgaggtgaatatgttacgcttttgtgcttagtctattttaaatactcttggtgcgatgagttaggaaaattatttaaaaaggtggtgtctataaattatagttgattgctcgaggacgagtaatgatttaagtgtgaggtattgatgataggttataattacgtattttagtcgcttattacactcaaatttactccactttaattgagtttgagctttaattgctagtgtcttgcactaattgtgtgttttatgtcttgtaggagtgattccgagctatgtagatgtcatggaatgaattcaagtgatttggagctttgaagtctgagtaaaagcccaaggaattaagctggtatcgtattcggggatcaacggatgatagagcaacaaaacgaataatcgagtaggtatattgcatactatctagtaaaatgcacataactttttcctcggaactccatttgggctccacaatatatagttataaagataactcaaagggataatactttcatgttttatgttttgccaaattcccaatggaacagggtaaaaaacacagtgaaaatcgcgattgtcgacctgaggcaggctgaggcagtacactaggaaagtaccacactcgggccgcggccgcagacgttcaagccttgaaacatatccttttttgcgtaggagaaggtataattgtttgggcccgaccctacttggtatatatacatggaaaacggtattttgaaggaggagaccaatttttgacatagattcgacctaaagaggcagagacacaataggagcaaggcgggaaattcttctacgagtttttccttcctcttcctatttttttcattatcgttatgacttttagtattgtggttttacatactattatgaatagctaatttgttatctagggttttgatagaaccttttgtaggataaattcttgttatgtttttatataattgagccgttggatttctctacttgttcaactatgtgtttgttgttgttgattgaatgaccatcaattgactatgcctatttagtgtgttgtgctcgagagagattacatatttaggtagttgttgaacaacgtcatcctaacatatgtgagaaatcaaaacagtgggcttaaaggcatgtttggaaataacaaagccttgacgtggtcataatgagcggttagataaagccaactagcatagttcgagagaatatatccattaaattgttgtagtttctcaagagagaattacaacatctaaaatgctcaggatcagaagagaatacactggcaaaattgcagggaacatagctagaaggattccggcaattaggaaaatcataattctagacctccttaatttagtaaccctttgtctcgttagttgataattttactgttttctagtatttactagttaattagttagaaatataaatatcaatatttataatatagaaaattgttcaaacttgtctttttagtgatattaaatagatattgctaagccttagttctctgtgggattcgactccggacttttagaccggattatatttgcagcgaccgcttatcctttttaggactagagttaggcatgatcactaagatagtcacattggctataccaggtgtgccacggattgagtggtgaggtgtgactgattatgttcccagtagagtgatatcattcttgacagctcagcgtatggttgggaagagttgtctttcgtatctagcctttgtgagggatgtcggtgctgagactcctagtattgattctgttccagttgtgaaggattttctcgatgtgtttcctgtagacctacagagcatgccaccggatagggatattgatgtcgccgtatcgtatggcaccagcggagttgaaggaattaaaggagcaactttaggaactccttgataaagggttcattcggcctagtgtgtcaccttggggtgtgccggttctatttgtgaagaaaaaggatggcactttgaggatgtacattaattataagcaattgaacaaggtgacaattaaaaataagtatcacttgcatcgcattgatgatttatttgaccagctttagggagcgagggtgttctccaagattaatctctgttcaagttatcaccagttaaagatcaggtactcggttattcttaagacaacatttaggacttgatatggtcattatgagttcttagtgatatcttttgggctgaccaatgccccagcagtgttcatgcatttgatgagcagtgtgttccagccttatcttgactcgtttttcatagtcttcattgacgatattctggtgtattcgcgtagtcaggagaaacacactgagcacttgagagttgtgttgcaaagattgagggaagagaatctttatgcaaaattctccaagtgtgagttttggcataattcagtgtatttcttggggcacgtggtgtccaacgagggtattcaggttgatccgaagaagatagaggcggttcagagttggtccaggctgtcctcagccatagagattcacagatttcttggtttggtgggctgttttgttcagggattctcatctattgcatcgcccttgaccaagttcacttagaagggtatttcatttgtatggtcagacgagtgtgaggagagctttcagaagctcaagacagccttgaccacaactccagtgttaggtttgccatcagcttcagtttcatataccgtgtattgtgattctttgagagttgacattggttctgttttgatgcagaagggtagagttattgcttatgcttctcgacagttgaatccccatgataagaactaccccgttcatgatctagagttggctgccatagttcacgcgttgaagatttggagacattacttgtatggtgtgtcttgtgaggtgttcactgatcatcgtagcctccaacacttgttcaagcagaaggatcttaatttgaggcagcggaagtggttgtagttgcttaaggattatgatatcactatattgtaccatctggaaaaggccaatgcggtggacgatgctttgagctgaaaggcattgcgtatggggagtttggcatatattctagttggggagagacctcttgtagttgatttttaggccttggacaatcggttcgtgaggttagatattttggagcccaatcgggtattggcttgtattgtttctcggtcttccttatatgatcgcatcagagagcaccgatatgatgatccacatttgcttgtccttaaggacaaagttcagcatgatgatgccatagatgtgaccattggtgatgatggggtgtttaggatacagggccgaatttgtgtgcttaatgtttatgggcttcgggagttgattctggaggaggcccatagctcgcagtattccattcatctgcgtgtcacaaagatgtatcaggatttaaggtagcactattggtggaggagaatgaataaagatattttaggatttgtagctcggtgtctcaattgtcagcaggtgaaatatgagcatcagagatcgggtggcttgcttcagcagatggatattcccgagtggaagtgggagaggatcactatggactttgttgttggacttccacggactttgaggatgttcgatgctatttgggtgattgtggatcagctaaccaagtccgcgcacttcattcctttgtgtactatttattcttcatagcggttgccagagatctatatccgggagatttttaggttgcatggtgtcctagtttccatcatttcagataggggcactcagtttacgtcactgttttggaggtctgtgcagcgagagttgggtactcaggttgagttgagcacaactttttactcagacagacaggcagtccgagcgtattatttagatattggaggacatgttgcgtatttgcgtcattgatttcggagggtcatgggatcagtttttaccacttgtagagtgtccttataacaacagctaccagtcgagtattcagatggctccatatgaggctttgtatggaagacgatgtagatctccagttggttggttcgagcccggtgaggcttggctattggggacagatttggtgcaggatgatttagaaaaggtgaaggtaattcaagagaggcttcgtacagcgcagtcgaggcagaagagctatgctgatatgaaggttcgggatgtgtcctacatagttggcaagaaggttatgttgaaggtttcacccatgaagggtgttatgagatttgggaagaaagggaaattgagtcctcgattcattgggccttttgaggtgcttcgggggattggggaggtggtttatgagcttgttttgccaccccgcttatcgagtgtgcatcaggtatttcatgtttatatgctccggaagtatattggggatcggtctcgtgttttggatttcagcacggtttagttagatgatgatttgacttatgatatggagctagtatctattttgggtcgtcaggttcgaaagttgaggtcaaaggatatagcttcggtgaaagtacagtggagaggttgacccgtagaggaggctacctggagaccgaacgggagatgcggagcagatatactcacccgtttgaggcttcaggtatatttcttgactcgtttgaggacaaaggtttgtttaagttggggaggatgtgacgacccggccagtcgtctcataagttatcgctccatttttcccatttctgcttctttatgttttgttatccgtattatgtggtatcgggctggtcgtaccaaatccagaatgattttggtaaggtttgagacacttagtctcttttgagaaagcttaagttggaaaagtcaaccggatgttgacttatgtattaaagggcttggatgttaattctgatggttcgactagcttcaggaggcgatttgggatttaggagcacaatcggaatgagttttggaggttcggagtataatttggtttgaattggcgaagttgatattttggcgatttttggttggtaggcgagattttgatgtaggggttggaatcaaattttgagagttgcagtagtttcattgtggcatttgggatgtgtgtgaaaaatttcaggtcattcggacatggtttggttgagttttttatccgatgtgttttggttgatttgatggtgtttgaggtgttttgaagattggtacaagtttgaataaggttttaggatatgttggttcctttggttgaggtcccgggggcctcgggtgagttttgaggggttgaacggatcatttttgagttaagaaaattaaagattttggtttcagttgttgaagatattttggtcttcgcgttcgcgagtggaccctcgcgttcgtgaagggtcaggaagggaggcgtcaggtttgtccttcaagttcacgaaggggagtcctgcgtgcgcaaagggccggaatggtatgcatcgcgttcatgagaggcctggttgcattcgtttaggttggtgaagctgaggcatcgcattcgcgatggtgaggtcgcgttcgcgaagaaggaatttaggcatggacagaatgtttaagtacttgtcttgtccgcgattttggggtttatttcttccattgttggtcgtttatggagatttttgaaggggattcaaggataatcacttggaggtaagattcttggacttaaaatacgattctaatgtgaattccacctaaataaccatagaaattatgtcaaaaattgaagaactagggcttgggaatttagacctttaattgaggatttgaaggaccatttaaggtcggatttcagaacttttaatatgtatgaactcgtggggagataaggaatctattgatgtaaaaattatcgaattccgagacatgggcccagggtcgggttttggtaatttcgggatttgtatcgtattttgattattttcgcttgggcttcgttcccttagaatattttgacgtcctcgttctgattttggatagattcgatgcgagtgaaggccgattcgaggggcaaaggcgtcgcgatctagagatttgaccggttcgaggtgagtaatgattagaaatgttgttctgagggtatgaaaccctcgagttgcacatcgttgtgctatattgagatgacgtacacgcttgatgacgagcgtggggtcgtgcactgttgggaattgtgacttagtccgtcctgaatgactattttaccgcgtatttgatcgaaatctatttgctatcatcatgatttgggttgaatgccatatttggttgttgtgccaactatttgaacccttcgaggatttgtattgatttttctacactgttttgactttatacttaaacccagttatgatatatttcactgttttcgtactcggccatgtttactatgttttaacacttaaatgatcttttaaatgatattttgggctgagaaacatgctttgctgctgcccgagtggcttgtgaggatttttgactgagtaaggccgagggcctatattgtgaggaaacatttgatactgattatgtggctgagagcctgagatatgtacgccacgaggtgacttgattaatatgaggccgaaggcctagtgatgatgccacgaggtggcttgatattgcgcttgggccgcaaggggcccctccaggagtctgtacacccccagtgagcataagtacctattgtgatatgagattgagcctgaggggcgggtattgttttatgtgattgcccgaggggctggtattgttctaagatgttgtccaaggggcggatttgttggtactgtgcccgataggcgaacctttctgtgtttattttcataattgattgtcaattatctgcttaattgttgaaaaaggcttttcaggaagtaaattttgagttaaaggattttacctatctttcactggtttactgtttttaatggttttactgcttcattatagcatgcttttgtgccttatgtgatttcctgcttttagtctttatttattattattactcactgagttggagcactcattttactccctgcaccctgtgagcagattcaggcgtatctggtcccgctcccgagtgctgatcatttccgactcaggaggatccgaggagtctctaggtagctattggcattcgcagcccggagctcttccctatcttattccttcctgttcttagtttctgtattaaactgtgtagttatatatatttggagtattctgttttgttagatgctcatgactagtgacaccccggtatcgggctgtggttgggttgtattccgcatattatagtatcatttgcttaaactttggttcatttattcatgtttatactgtttcttaatgcttaattgttacaaattggaaaatggaaagtgttggctggccttgtcttcacgagaggcgtcatcactaacgggtccaggtttagggtcgtgacacccgtgccctactcctggatgactgtgccctgagtctcaaatattttcatctgatttgttgatgaacgctttcatgaaatattccttactggactgatttgattgatgtggctagtattgctgcctctattggttctaaaaatctggtggtccttgaccctagggtctaggattatttcgctgtcgtgagttcaaacttagtgaactcaacgaaaaacctagatgtctttgccccatagcattagttgttcctaccttggtagtgtcacgacccaaaatcaactaagggtcgtgatggcgccggacaccactgtcaggcaagccaactacaattcactagcaatttctcattttagttattttgaaacatttttttaaaacaaataaataataaataataaaccccacttcacaaatgaggatgtctttacaaaatttaactactgaaaaatcccgtgattatcccagaacccggtgtcacaagtacatgagcaatttctaggaaaaaatgtaatacagcaaccgcccggaatgcaatattggacagaaagtaaatacaaaaattcgaaagagactctgctggctgcgggtagtctcgagaagtgcaacttacctaattctccgtatcaatcatgcttctacacccattaggccactggggatgtgtgtacctatgcaaaaaaaatgcacagcaagtgtagtatgagtaccgaaacgacgcgtacccaatgagtatcttgtctaatctcgaagaagtagagacgagaggtcgacttcgacacttacttgtggtccaataataatatttgtaaaaattggaggagatcgtggattctataaagcaattataaactcataaagccaggtagcaggtagacaacttcccaaataataatggatttccaaagatttacttttcatcatctttataaatttatctccgaccgggaaaggcaaatatcaacatttataaatctcagataataatacaatcttgcgcatatcatgccgaggtcgtacggcccgatccaacataaatgtaaaatgtgcactgtcgagggccgaacggcccgaaccatagatgtatctattaccccatcgcgaatcatacaacgacgcgatcaacataaataaacaaataccctactcgcgaatcatacatgtgacacgggcacacatagatacacacattcaaacaatcaattaaaaatttatcggggaatgtttatccaaataaaagccaattatcttttaatgatttaagaaaaatgaagtttaatccttttagaaattcattcaccaattcgataggatttaagcaattcaactatcaataagattacaatttattccaagtatagcatgcttttgggtcctagacaacccagacttaaacatgatagtagctacacacggactctcatcacctcatgtgtacgtagcccccaaaaataggagcacataaccaattattttacctttgaggacaattccatcttacaaggttagaaaggagactcacctcgctccgaagaccaataaccggcattccacgcccttccaaagactcgaatcgattataaatgctccaaaactagccaataattatgcaaatccatgagtacattttcaactacccattacaatccaatttataataatttctaacctcgatcaaaatgttaataaaattgccctcgggcccacgtacccggatttcaaaatttctcgaagataaagtttacccacaacctcacgaactcaatatattatctactctcaatttcatacccaaaattgtggtcaaaatccaagaatatcaattttctaggttttactcaaacccccaaatttctaccaatttacatgctcaaatctgaaacaaaaccatgtatttaacgtctaatgagtgggaacaacttaccttgacatagatgaagaaaatgtctcttccaaaagctctaaaatcgtccaactcaaagtgaaaatgtgtggaaatgaaccagactcgatttttaaagagagctcactgactctagtcctttcgcacctgcagtcttttgaccacttctgcggtcccgcaagtgcagaccaaatgcctcttctgcggtctggggctcccagcccatttccgcttctgtgctccttctttcataggtgcggtcccgctcctgtggtgacctgaccgcatctgcggtcccagtcttcacccttcaccaccacatctgtgccattttggccgctgctgcggctccacacccgcgagacttgggccgcaggtatggttacactaggaaccagcaacttcagctcttcctccaagttccaatttgatctgttaaccacccagaatccacccgaggcccccaggaccccaaccaatcataccaaccaatcccaaaatacattacggacttgcccgaggccttaaatcatatcaaacagcagtaaaatcatgaatcgacctccaatccaagcttaatgaactttagaattttaaactcctacattcgatgctgaaacctatcaaatcacatctgattgacttccaattttgcacacaagtcacatttgacattacggacctactccaacatccggaatcggattccaaccccgatattaaaaagttcacttccggttaaactttttaaaaactttcaaatttcaatctttagccaaacgactccaaaatgacccacggacctccgaattcacttccgatcgcgctcccaacaccagaatcactatacggagatattcccaggctcggaatctcaaacggacattgataatactgagatacacttcaacccaaacctatgaaaattgctccaaaatgctaacttccacaataggtgccaaaacgttcacgggtcttccaaaacccgatctgtacatatgcccaagtcctaaatcatcacatgaacctattggaaccttcaaatcccgattgcgaggtcgtttactcaaaaattcaatcttattcaattcgtctaacttaaagcttctgaaatgagaattctctttccaattcaaccctgaacttcccaaaattcaattctgaccatgtgcacaagtcataatacctgaagtgaatctactcatggcctcaaaccgctgaacgatgcactagaactcaaaacgaccgaccgggtcattgcaggtagtattctctattaaagtttcctatcgtgtttacttcctcaagtgaagcttgaaactcaggtgtggagtgtcccattccacaaaaatcacatgctgcttgcggttcactctgtatcttgggcaatatcaactttttttctctttgaccatggtgtctagctgggtttacactgatgtgttaaagtccacctggtgaactgttacacctcgtaaatttaacaactttgataccgttatatatatatattcgatatggtattttgagtggaactttatttgtaaagaaaaaaattggtttgaaaaatatgattttatatagttattaatattactactttcgaatatgtttcaaattatacacataatatgagaaagtttataagattttttaattgtaaagatagaagttattttctcagaagaaaaaaaggctatctttttaccattttaagaattaagcgtacgaaattttttactctttatatgagattaaaaaaattataagttgagaaaatatagggatttttgcatggatgttataataaaataatagtgtatgtatttattttatatggtactacatgaccataatagtaaagtatattatagtaaggtgtataaagtatttaaaataagcataattttaagtaatttgagataattcttaattatatggataattgaataattgatgagtttagtaggagattaattaaaagattagctaagacataacgtgtcagccctcctccaaaaatgacgtgtgactaacatgtaacatctatgccacttgtagcaatctttcaatatggtggcaagagaggtgtaccccactttccacttattcatattttttgatggattttactaacacaattatatgcatatgtacagccacatgatctgctccatgtaaaagaacaaaacaaatataatagaaagttgaaagatgttatacttagctaatagaggatccatctaaactattagccaaaaaataatttattctttgatttcttagtactcgctcttttaaaacttgctcctctccattttatacttttttttctttctgatttttcaagttaatttatatgtgatgctttaaagctgtattttagtatcagtatcatattactacatgattagatggaagcagacaaattcgaaggtttagcagatggaaaagaatcaatgggactctattgccttttctatttcgtatagatggctcaggattgcaaatattttaatcttatgaaaaaacacagagagttgttagaggtattgtcaagagaattggtccaggtattttaaggttatcccttcttttttttggcatgatccatatgatacaacgaaatgaccaaacacgcaagtttcacaaatgattctattcttagaggtactaaggttgtctatgttattgattcccaatgtgtcctactactatattgcctattcatgggtctcataacattccaagagatcatattgacttacttcattatgcattgtattcatttatacatgtgcatttacccatcacttagatggcgttatatacgcgtatatatatatatatatatatatatatatatatatatatgatatgggaaaaggttatagtgttatatatgcaccaccacctgatcagctggtatacgataataattttgcctacagtggctgagatgatatgatgagatgcccttagaggctttacgatgttatgtacgtacagacctatgcatcatatgacatttatatacatatgcatgatactataaatatttcataatttatagagctatccagacttacaggttgagtcctctactccatgtttcttccatgtctttaattaatgttgacttattgttttgtttcagttctgccttacatactcagtacattattcgtactgacgtccttttgttggggatgctgcattcatgcctgtagatatagataatcggtttgacgagccctcatagtagacgagattggcattcagcgaaggatcggtaagactccacgtctttcggagtgcacctcagtctaagagtaaatgtgttagagttttactatagacttatgggtaggctggtaacctgtcccatttaatgtcgaataatcttagaagctttgtagacagaagttcattttgcatagtattttagaggccttgacgggccttatgtattcatgttttatgaatgatggttcattggtataacattttcccacatacagttgtacattatgagttgtggccatattggcccatgatatttataaagaaagtaaatgagttacagagtggttcgctcggaacagtgcgacgccgggttccagccacgccttcctaggttggggcatgacaaagtggtatcagagcaggtcgtgtcctaggaagtccacaaagctttgcctagtagagtcttacttatgggtttgttatacaccacgtttataatttagaggctatagggcaattcataaatgtcacccttcttttgtttccagattgttccatagagctgagttataagaagtcagtatgaagcttttgccagattttgtatgcactagaagtgtatgtattacagtagagctttaagacgtaatttccacctatgtttaaggaggttatgaaataaataaaagatacgatgcgagattgaaaggtagataaggtaaaggttaggaagatacgaggtactcaaatacaacaagttgtgaatagtccagacttcagatatagtttgagtattggttaatttacagaggataccctagtgaaaattttgcaaatctctaagagttaacattcgaggacgaatgttctaaagggggaaggatgttacaccccgtaaatttaacaaccttgatacaatatatatatatatatatatatatatatatttgagtggaactttatttgtaaagaaaaaaaatggtttgaaaaatataattttatatagatattaatattactacattcgaatatgttttaaattatacacataatatgagaaagcttatgagattttctttattgtaatgatagaaattattttctgacaagaaaaaaaggttatctttttaccattttaagaagcgtacgaaaatttttattctttatatgagattagaaaaattataagttaagaaaatatatgtattttacatggatactgtaataaattaatattgtatgtatttattttatatggaactacatgaccataatagtaaagtatattatagtaaggtgtataaaatatttaaaataagtataattttaagtaatttgagataatttttaattatttgaataattgggtaattaatgagtttagtgggagattaattaaaagattagctaagacataacatggcagccctcccccttccaaaaatgtcgtgtgactaacatgtaacatctatgccacttgtaacaatctttcaatatggtggcaagagaagcgaacctcactttccacattcatattttttgatggattttaccaacacaattatatgcatatgtacaagcacatgatttgctccatgtaaaagaataaaacaaatttaatagaagttgaaagatattgtactcagctactagaggatccacctaaactattagccaaaaaataatttatactttgatttcttagtactcgctcttttagaacttgctcctctccattttaggcttttttttctttctgatttttcaagttaatttatatgtgatgctttaaaggtgtattttagaatcaacatcatattactacacgattagatggaaggcagacaaattcgaaggtttagtagatggcaaagaagcaatgagactctattgccttttctgtttcatatagatgactcaggattgcaaatattctaatcctatggaaaaacatggagagttgttagagggattgtcaagaaaattggtccaggtatgttaatgttatccgttctttcttttggagtgatccatatgatacaacgaaatgagaaaatatactcttccttaatacaaaatggcgatatgcagataatgtacatgtccataatgctttgtatactcttgtaaggccatacgttgagttaaattcttgcaagtttgtcctctatttatgagagaatcttggctggaatccacgacgatttaaactccccataaacccttacattcgaggacgaatgttcctaagggggaagggtgttacaacccatattcacacgcgttagttcatgccatatattagttaacataaatccaagaagtaattacctttgagatgataagaagttaatcctattggtcttaagtgatacaagggtatacaagggtgattaacaagtattagaagttaaacgaatcaaggatgttgtaactcgtattttcaggtaaacctagaggttattaatacactcaagaggtcatgtattaaggtgtttgaatcatataatatccatatcataagtcttgaagtcaaatgagttatgaaacaaaagtcgacaaacgttgtcgcaacttaggttcataattttacttaaacattaggtcaaatgtttctacacttttctcctaatttacaagtaattacggggtgatatacccaccaaattaaatatatatgagtctagtttctaactcattaaaccgtttgtcaatacgatctcggagtatagagatattcatattttcgcaagcctgtgcagattggtagatgacaagtagatgcatcacctacttgccaaaatgataggacaaaattaaaagacctaagtcggacaagagagaaattttaaggggttatgaactcagttatttcatctatattttagaccctcaaaaccaaagttaacccctgcaactcctccccaaaaatcccatacaaaccctaatcgattttccttctctttcaagttctatttgaaggtaaaacctatagtttgaagaaccaagggaagggctgagttatccaacaagtaaggtaagttactgacatctttcatacatttttctcttctctgaattcatggtaattcattctatacatgtaagaactcacgggatggtgatcgaaagctgtgagtttgagttatttacttgtagcggactgttctgtgttgctgttgggatgcgtgttttactaatgttttgtggagttttggaggtggaagagtgtggagaaataccatatatatgtagggttgttggctgatagttattcataatattttcgggttgtttgacacgactacggtggccatcgtatgtatgatgtaattaggttgtgcgtgcactgttttgggaggctcaatatgtttattattgatgttgtttgggctgtttggtgattgttttgaatggtgtgaagtcatatctataggggaggtgctgtccgtttcagcataaaataggttgtggtcgatacataatagttatgacgcttaaatgataacgatagtatcgtttctcttgttgctgactaaggagttgtgacaattgcatagcttgcgattggggaaatatatacaagttatgtgaggctatccttttccttcttttgcatgactccgattgtacaaaatataatgaacgagcttccaaagatactctactcttagaagctagcagtacttacattgctttccctcttatggaacgattgatgttaatgttgcttctcttattcttatgttatcaatgttgttggtacttcctgattcttataagggtcatagtgaagagttaatcctaataacggcacacaggatatcgaccttacttcactccgaaaggtttagaatgtgattccatgagttgagcacgcattatatatatgtatctattttactctaccgagccgcgctatagtcgatcgggtgtggcacctattttgaaaccacttatcagttgggttttaccaagctccacatggccgggtacgattctaccgagccttatgatggccgggtatgtttttttccgagcctattacgactgggtacaatatgatgatgatgatgcccgcagaggcgtatgttttaaaagtttatgtatacatacatatgtatcatgcattacatgtcagtagccctcagaggtactcagatgttccaggttgtatattctctatccctggttacattactgttcgtatttatggttccatgccttacatactcagtactttattcgtagtgacgtccttttgtttgtggacgctgcatatcgtgctgcaggtcctgatagacaggcaggtgcagctcccccaccacagtaggttgtccagttcagcagtgattggcgagatcccttctccggacttgacgtagtcttggtatgcattttgttatagacattatgggtatgtcagggccctgttctggctatgctgtagcacttatgttcatttagaggctcatagacatgtgtcgactcatgtatagtttggtatgccttgtcggctggtttttgttatatcgtctttcatggtagcgtggtagctcgtaccttatatgtattttcttgattgtctgttcattccatgttatgtatgttcatgccatcatattttattgttggttttccatgatccatgtctaccatttatattgatcttgtcaaccctaaaagataataaaaaaaggttagataaaatgtacgttggtgctcggcaagtatggtcgggtgctagtcatggccctccagtttgggtcgtgacatcttgaaactgagaatcaagtggttgatgaggatgaactaaaagaggaggcttctaagcctagtgtggaattgaaagtcctccctactcacttgatatatgtttttcttgaggctaacaattttttgtgattatttctgcttacttgataggtacataggagcaaaaactggtggatcttcttaaaaagaacaaaaggccattggccggagtatagctgatattcaaggaatcaatccatccatttgcatgcacaaaattctactggaagaaaatagcaagccagtggtgcagccccaatgcaaattgaacaaaaatctggaggatgtagtgcataaggaaatcattaaattggaagatacgagagtgattttccgcatctctgatagctagtgaattagtccagtgcaagttgtacccaagaaggggggaatgacagtgatgaagaatgaagataatgaattcatcccaacacaaatagtcacagagtggagaatgtgcattgattatagaagggtgaatgatgcgacaaggaaataccatttcccacttctctttattgatcagatgctcaaaaaaagtggctggacatggatgctactatttcttggatgggtactcaggctataatcagatacccattgccccagaatatgttgaggaaactacattcacctgcccttcaggtatttttgcttagaggagggtgccatttgggttatgtaatgtatcggccacttttcagaggtgcatgatatctatattcaccaatctaaacgagaagtgtctagaggtattcatggatgattttaccctctttggtaatgactttgatgattgcttgatgaatttggagcttgtgcttgaacattacaaaacaactcacctgattcttaattaggagaagttccacttcatggtaaaagatggaattatcctaggccataaagtaactgcacacgtcattaaagttgatattggaaaggttgatgtaattgctaggctccctccaccgacttttgtgaagagcataaggagtttcttgggacatgctgggttctataaaagattcattaaaaacttatccagcattaccaagttgttgactgcattgccagcgaaggatgtcaagttcgttttcactatggagtgcttaagagcattggaattgattaaaaaaattgtgagtactcctattatggtgacacctaattggagccaaccatttcaaataatttgtaatgtgagcgatatagctgtgggggcagttctggggaaaagaaaagataagttgtttatgcacatctactatgcaagtaggacgttgaaagatgctcaagtaaactatgccactactgagaaagagttctttgttgtggtctttgctattgacaagtttagatcatatctagtggggagtaaagtgattgtacacactgatcactcgtcacatcagatgcggtgtgtttttaatccaagagtttgacttggataccaaagataggaagggcacagaaaatcaagttgcagattatctatctcgatatgagagaccttaggtgagacaattgaaataaggaaagagtttcatgataagcagattttctgcattgttgtcgtctctgaaagaccgccttggtatgctgatgtagccaactttttggctagtggatggttgttgtgtgacctctttcgtgatcaaagaaggaagctttagggtgaggtaaaaagttatttttggaatgaccctttgttgtttaaattgtgtgcagatggtatgatatgaagatgtgtgcttgaaacagagatggcaattattatttctcattgccatgatggagcggctggaggacactatgttggaaatcatactgcaaaaaaggtcatagaagccaatttatacaaagacgcacgggcatagtagttgtatgtgacaagtgtgaaaggccaggtaatattagcaggagggatgagatgctgaatccattcaggtatgtgaaatttttgatgtttggggcattgaattcatgggctcgttcccatcgtcttatttatacgagtatatcctagtagtcgttgactacgtttctaaatgggtcgaagcaaaccatactaggaccaatgatgcttgggtggtttgtgagttcttacgaaagaacatctttgcccgctttgggatacctcgagtgatcattagtgaaaatgggtcacactttgtgagtaagtagtttgttgcactgctgtccaagtatgggatcacacacaaaataggaaccccataccatgcccaaactagtgggcaagttgaagtggctaatcgtgagcttaaatgaattcttgaaaaaatggttagtgcttctaataaggattggtctatgaagttggataaagctctatgggtgtacataattgcgttcaaaacaaccataagacttcactattcaaattagtacatggaatatcgtgtcatctacttgttgagatagaacataaggcttattgggcaactaaaatatttaatcttgatcttagtcttgtaggtgaacacatgcagatgaacgaattggaggagtttagacaggaggcgtatgaaaatgcatgaatctttaaggataagacaaaaatatggcatgatcacctgattaagccaaaggaatttcatgaaggggacaaagttttactatataatagtagccttaggttgttccccggaaagtttaagtcgagatggacatgttcatatatagttaatcaagtctcactgtattgcgccattgagatccaagatgagaaagagaatgagagctttaaagtgaatgggcaaagattgaaaccgtaccttgttggacgatttgacaagcaatactctagcatcgtaatcaaatgagcctaagcgaagatgtcaagctgacgattataactcataactacttctaaccttttttctttcttttgtagaatagtttatataattgtagattaagattattatagtttaggagttttgatacttatttggacagttataagcatgaattggacacaaaataaatatataatagagagaggggagtgcaacccttgagttaaaaatcgaaaacaaggtgaactctatgaaaaatatcctagcgtgccacttgggggcgtcgtgctctgcgccatgccagtccaaatattctctctcttactccaaatctcttcttcttcaaaattttccactcaagttctcccacttccatgagtcatcaaggtaagttcttcttctcattttttatttttttctttcttatcagttagatgtagaattaaatagttttagtttgatttccttaaccctaggtagttgatttttgctaatctttaagttaatttctttttaattttggcggaaaattgtgcttaaacttgtgcgtttttcattgttcttatgattgtggatgatttgtggtatgttgtggtggcattggagtattttgtgataaagtttggcggggtgcctatatgaccgaaaattggtgaatattgtgtaaagttttagagcactttgttattgttacaatatggtgatgttttggttattgttgggtggttgattattgtataagtgtggtggttcttcaccatgtggagttgaaaataaaggggtgaacttagtgcctacaatgtgtttgataaaataccttattgaaaaaattgtgaagtttgttggttaattagggtaaatgaagaaccgagaaaatctcagattcatgccataatgagatgaaaaatgaacatagatggaaagaagcaaagatctgaaccagatttggttcaaaataggagagatcaggttgccatgttaggcaagaaattatgtaataccataaatgtcacgacccatttccataataggtcataatggtgcccaaccccattgccgggcaagccaacgcggaacaataccaaataagctctcattttacttttaccaacatacttgcaataattccttaagttaagattagaacgagtaataaccagtaatgtaccaaaaataattatacaatccccaaaagaataatctactaatgtgtgtgccaagatctggtgtcacaagttatgggcaactagtagaatatacaaaagaatcaatctatcctactgtacgaaataaaatagatagcaaaagtgaataagagacactccatctagttgttgaacgatactggaagggaagcaacacaccgtagaagtctcgaaatctgctcaggaatgcacaccagactgataaccagaggtacctgcctcagatcctgtacaattaagtatagaagtgtagtatgagtacataaacaatatgtacccagtaagtataccttgaaatctcgaagaactagagacgagaggtcgacttgatacttaccagggtcaaataatatgagaaagaatttatactaagcatggatagtacaattaattagcatttcatggcaagaaataatggttcctttttcctgataatatcatagttaaccatttgaattccaaggcatatacgaagttcagtccacagaaaaatactaagtaaaatatgtgcacttaatgctgagggtcgtacggcccgatccaacataaaagtaaattttgcactgtcaatggtcgaatggcacgaaccatagatgcatctattaccccgatcgcgaatcaaacatgcgatgcagtaaaatataaatatcacaacaacaagcagacaatggtgtatatctgggaaacaattactcacagaaataatcaatttctctttaaaaggccaagaaagataatgttcctcttactagtctcatttactctaatcaacatgatttatacaaatccgagttaaacatgaacttacaagaatatcacatagagcatgcttttgggtcctagactacccggacttagcataatagtagctacgcacggactctcgtcacctagtgcatacgtagcccccgcatatagtagaaatttattcaattattatacctatagggacaattctctcttacaaggttagaaatgacacttacctcgctccaaattatacttccaattccaagaacgagcccaaactctcaatttggagccgaacgatccaaagctagttaaatgagataggacctagtcaatataagctcacaagatcgtatgctagctatttaagcaatttcccaacccttaacactagtttcctaaaatccgaccccaagcccacatgcccggattccaaaaattttcgaagaaagttgttctctgtaacctaaggatcaataatatatgatccccatgattttacattaatcctagtgtttaatctacctaagacacaagtactaaactaggaatagatggaataaacttgcctcaaggtgctaggtgaaagttttctctccaaatctccaaaatcgcccaaatgaggagtgaaaagtggcaaaaatgacttaggacccatattaaatgaagctcactgctttagcgatttctgcttcaacggtcaggggaccgcatctgccgtcccacttctgcgaggaagaggaagcatctgtggaaatggtccaaacgggctgggaccacttctgcggcttgggagccgcttctgcggtctttgctggtctgcctttgccgcatctacgagagggcgatcgcttctgcagtctcgcacctgcggccgtccaaccacaggtgcggttatgacagataccagatgcttcagccctttgcaacttttccagcttcacttgagcctcgtccgattgatgctcggggcttccgggccccgccgaaacatactgataagtctgaaatcatgaaacggacctactcgaaccttcaaaatgcctgaaacaatgctaaatttacgaatcaccccctaaaaccaattgaatcaaacttatgaacttaaagttcttaaattcacttctatcgtgcctaaaagtacttatactactcggattgacaccaaattttgtgggtaggtcttaaatgttatattggacctgtactaggctccgaaaccaatataagagtatgataccaacgtgatcaatcattaattagtttctttaaattcttaaaatttcagtttaataatttctaataaaaattcattactcgggttagggacctcggaatttgatcccggacataagcccaggtcccatattttcctacggaacctccgagaccgtcaaaacacgaattcgggtccgtttgctaaaaatgttgaccaaagtcaaacttagccttttaaaaaaatttaagcaatcaaatgagcatatttcaacccaaactcttccaaatcccgaaccaaccatccccgcaggtcgtaaattagttaaagcaagcacgggaagttttttaagggaacgaggttctaaaaagcaaaatgagcagtcgggtcgttgaatgggtagccagtagcaagacaatatgaacaaggtaagaagatcattgatggatttcatgtctgagttggaatcaaagaggaaatagggttacactgcttgggttttaagaagagaagaggaagagatgagagaatatagaggcagcgggtttgggtgaatgagagttagggttaggagtttggttaattaaaatagggaaaagggatgtgggtcgttgatcttgaaagatcaacagcgtgatttaaaggtgactggggcgggttataatagacgggtaccgaccggatctagtgggttgggttaattatttgggctaggtattttgtgctggtgtatagttttgggcttgtgtattggttagttttaggtccgaaaataggagtaatttagggatagtttttaaatacccaacatttaataaataaataattgataaaagcgattaataaatattaaaaatattatatgtgcactaaaatgattaagagtaattatttaatattataaaaatataaaaagttattttctgtataaataatgtaattatacatgcatatgggattattgtaaaatgagcaatttagccttaaaatataaatataattataaaaatgcactgagaaatatttaaacattatgctggtaaaaataataagtttagatgtttaactcatgaaaccggagcgaagactgctcccgtttgaagaacagttacttcttggattacctgcaaaacttaaaacacgatgcatgcaaatatatatggattaatgcgagaatttaaacatgatgcagactccctttggatcatgaaggttgtctttggacagtgaggatgatgtccttagaccaagacgtcctcgccatgaatcatgagataagggattcacaggccatgaaatgatgttctcgagccatgagaatggtgcctcggaaccatgactcctttgaataatgacgtgcaatactgagagatcctcaggcatgacatggtgtcttcaggctatgaggatgacgccttcagactatgacgcctttggacaaattggctatatatcagcccatgagatgcagtgacatgatgcttgatataaaacaagatagagcttagtcttgtgcagggacgggtgcagagcttagccccgaaagaagtgaataatgcatggtttggaatagatcaacatttgtgcagagggagacaatgcttagtcttatgagaaggcagtgcttagcctaatgcaaatagagaggcagaggttagcctcacgcaagaattgagacaaagcttagtctcattaaagagaaggcaatgcttagccttatacaaataaggaggcagggcttagcctcatgcaagatttgagacagagtttagtctcatgcaatgagaaggcaatgcttagccttatgtaagcagcgaggcaggacttagcctcatgcaggaatcgagacagggcttagtctcatgcaaagagaaggcaatgcttggccttatgtgaataaagaggcagggcttagcctcatgcaagatttaagatagtgcttagtctcatgcagagggaaggaaatgcgtagccttatgcaaatgaggaggtatgccttagccttatgcaaatgaggaggtatgccttagcctcatgcaaaaattgagacagggcttagtctcatgtaacgagaaggcaatgcttagccttatgcaatcagggaagcagggcttagcctcatgcaggaatcgagatagggcttagtctcatgcaaagagaaggtaatgcttagccttatgcaaatgggaggcagggcttagcctcatgcaggaattgagacagagcttagtctcatacactggacaaaatgcaagtaggagcaaaatatttcttaactggagatatatttgtgcttggcagtccggttgttatgaaggtgatgattttaaggtgtgcatgcttgtggttattccttgttcttgcgtccaaagaaaattgtgagttttgcgggtgaggttggttcgtgcctttatcttcttatttttctttgctttgctttggagattctgtttgagttgccctgggtaacatctagctaccatagaaataacgttttcgagaaaaatatgcacttatttgatgaaatagagttatttagaaaatatagtggtatataatatcatataaattagatgaactaacgactatgacacttttagagacattgcggcctctttgcattagaattttaagggtcctcctcaaaattctttcctagtttagtgagcgagccttcgatcgttctacatgtgatgaagtttgttggacctgctccaaaattttgagattccttctcaaatttctgccccagttacttaactaattctctgactatcttacatatgatgacgtcgactggacttgctccagaattttaagggtacctccttaaaattctgtcctagtttttggttgtgggaaaatgaaaattttattgagatgtgaccgaacccacagggctgcctacgtatcctctcttaaacggaaatcaggtccaacgtagttcagttacattagatgaagaaatataaataatttaaatatagtatctcttgaccgcatccgaattgataggctttggccaaacttctctgtccatttctgcaagtatgagtgctcctcctgttagtaccttgtgaaccatataaggaccttgccagttaggtggaaatttccctttggcatcatcttgatatggaaagatccacttcaacaccagctgtccctagtgtgaactgtcttggtttgaccctttggttgaaagctctcgacatcctattctgataaagctgaccatgacatactgaattcatcctttttctatctatgagggataattgctcaaagcgactccttatccattctacatcactgattttggcttcttatacgatccttaaagaaggaatttctacctcggcgggaatgacagcttcagtaccataaaccagcaagtagggagttgcccccgttgatgtacgatttgtggtacggtatcccaataaggaaagtggtaacttctcattccattgcttgtgattctctaccattttccttagtatcttcttgatgttcttattggcatcttccacggctctatttatttgaggcatgtatgttgtggagtttttttgcttgattctgaaagtttcacacatggatttcatcagatcactgttgaggttcgcggaattatcagtgatgatagactcaggaaccccgaatcaacaaacaacacgatccctgacaaaatctgcgacgactttcttggttaccgctttgtacagcgcagcctctacccattttgtaaagtaatagattgccactaaaatgaacatgtgcccgtttgaagtagtgggttcgattggaccaatgacatccattccccaagcagtaaaaggtaaaggtgcacttgttgtattgagtttgtttggtggcacccatatcatatctgcatgtatcttgcattggtggcatttctggacataccggacgcaatctgtttccatagtcatccaaaattatctggctcggagtatcttcttaactagaacaaaatcgttcttatgtggactgcaagttccggtatgcatttcctcgagcaatttggaagcttctttggcgtcaacacaccttaatagtcctatattaggtgttctcctataaaacattcctcctcttggaagaaattattggacagcctatgcaatttccgtttctgagtatggtttgcctactctgggtattctcctttcaccaaatattccttgatatcgtggaaccatgggtttccgtctgtttcttcttcaacataagcacaataagttggctgactatggatctttactggaatgggatagatgaaattcttgtccggatgctgtatcatggaagacaaagtggccagtgcgtctgcgaacccgttttggactcttgaaacattttttaattctattttcgtgaacctcttcatcagttcttgcacatgacacaggtatggtagtatcttggtatttcttgtcgcccattctccttgaacctgatgtaccagaagatccgaatcaccaattaccaacagctcctatatatttatgtcgatggccaaattgagccccatgatgcaagcctcatattttgtcatattgtttgtgcatggaaacctatgctttgcggatatcggataatgttgacctatctttgacactaaaactgctccaatactcactcctttgaagtttgcagctccatcaaaaaacattctctaactgtcataggcttcagcaatgtcctctactatgaatgacacttcttcatcaggaaaatacatttttagtggttcgtattctcctcttacatgattttcggcaagacggtctgccaacacttttcctttaactgccttctgagttacatagatgatatcaaactcactcagcaatattttccacttgtccaacatcccggtaggcataggcttctgaaagatgttctttagaggatctatctttgatatgaggtatgtggtataggcgcagaagtaatgcctcaatttctaatctatccatgtcaaagcacagcaagtgcgttctagcagagagtattgtgcttcataaggtgtgaacttctaactcaagtaatatatggcttgctcctttcttcccgtctcgtcatgttgtcccaaaacaaatcgaagccccatctaatacagagatgtagagtagcagtggcctaccatgctctggtgggactaggactggcggtgtggacaggtattccttgattttgtcaaaagacttctgacaatccttagtccaattggttgcagtatccttcttcaatattttgaagattggttcacatattactgtggactgtgctatgaatcggctgatgtaattgaggcatcctaggaaactcatcatgtccttcatgttcttcagtggtggtaattcttggatagctttaacctttgacgggtccaactcgattcctcggtggctgacaattaatcctaacaattttctagcaggaaccgaaatgcacattttgcggggttcaattttaaattgtacttctgtagccggtcaaagaacttcctcaagtctgctatgtaatttgttgctttcttggatttgatgatgacgtcatcaacatatacctctatttccttgtgtatcatatcatggaagatggttgtcatggccctcatataggtggccccagcattcttcaaacagaatggtattattttgtagcaatacactccttattgtttaatgaaagctattttctctgcatcttcttcatccatccaaatttgatgataacccgtgaatcaatctgcaaaggattggagttcatgcttagcgtaattctcgatcataatgtgtatatttggcagtgaaaaatcgtccttgggacttgctctgtttaaatcccgatagccaatatacaccctgacttttccatctttcttcggaaccggtacaatgttggctaaccaggttgggtactcaactaccttgaggactttggctttgatctgcttagtgacttcctccttgaattttaggctcatgtctggtttgaactttctgagtttctgcttcaccggcggagacattggatcggtaggtaacttatgaaccactatggatgtgctcagaccggtcatatcagcatatgaccacgtaaaaatatcctcatattcttttaagaaatgagtttattcttccttctctaatagcgacagtgaatacttatgcgagtttctttgatggtttcagaatctccaaaattgactttctcggtttcgtccaggttggacttaggcttattctcaaaattttcaacttctctgataacttcctgaggtatctcatcttcttcttccgagtcactatccttatgttgtgtgcctcattacatgtcgcagtcattggttcatcaaggtaagaaatagtaatattgtagaagaaaaatatgaaagataacgataataaaacaccaaattatttgataaaaacgttaaacaaaatatcgtctagatgacttcaaacaatgttttccaaaacaaaatattgaaagaaaagttttttcaaaactaaatgctcaaaagacttgtttttcacataacattagtatccatgctaccccgggactcatctggaccttgatggtggggcggtccagtttctaagaaatgctcccctctttactgtctatatggttaggccttttactcctcctcctcaattatcacattgcaatccatatcttcgtcttctagaaacaggttccttagcccagccaaagcttcttcttcttcagatccccatattttatcggcctgataaaagatctgactcagatgtggcactggctgctcaagagggtaatagggaccatgccatggtggcgaccaatcatcatattcttgctatgtatacggatattcgttcccaaaagttgtaccatgacgttttaattgtatttgtttggtaatgccctggagtttcttcccaagccttttgccgggtttgtaccttgaccatgccagtatgctttctattttgttacttcaccatttatctttctcaattgcattgacatgctcgatgcggtgataagtttctccacccagctctcttctattctcgacaaccgggatggtttgactggtgtaaatgggattacttccatctccatgaatgattacctcctgatggttccattcgaactcacaacctggtgtagcttaaaaaccacagctccagcagcatgtatccaaggtcgtcctagtaaaagattatatgtagcagatatgtccaatacttgaaaaacaacatcaaaccaaattgggcccatctgcaaacaaaggttatattcctcaattgtggccctttaagacccatcaaatgctttcacattcatactccctgctcgtatctcatggaaatctttacccaaccttttcagagtagtcaatggacaaatgttgaggtttgaacccccatccattaggactctggtgatgaatttgtcctcaaactgtagtgtgatatgtagtgctctgttgtgacttagtacttcaggtggtagtccatcttcgtgaatggtgatcttgtggctttccaatacttgccctaccatgttggtaatttctcccctggtgatattgttgggcaggtacacttcattcaacacttgcatcagagcattcctatccacctcaaaattttgtagcagcgacaggatggatatctgggcgggaactttattcagatgatcaataacagagtattctcttgcttgtactttcctccagagatcatttggactagtttcaatgatgggctgtttggcaactgcttccttgctttcccccccccccaaattttcaggtgtatagattcttccagtcctagtcatcccttgtacaacaccagactcttccatttttgctttttcttttctcctagcttcggcaacataatcccaaggtatggcattagaagtgaagggtggtgtggatgctaccgacactgtgaagggtgtggctacttctacctcgaatggagtaggtgtagtcacagttgttgtcactttgatttcaaatggagctgatatgtctacttcaacttcgaccggtggttgtatctgtaccacaatagaagtaagtgtgtctgcaggtttcttagggtcgtcactttcccgaataagcctaattgccccttcaggatcccattcttcatcagtttctatcacatttactccatcacccctatgatttgggagggtattgttgcggacattgggtgcggcttcctttgcttgtatgactttggtatcaatcagggtctgaatcttgtattttagagtgcggcattcatcaattgtattccccttcatgtcggaatggtatgcacatgttttgtttgggttgacctatggagaggagttttccatggcgacacgggaataggggtgtcatatccggcagcttttagtctttcatatagctggtcgatgggctcagtaataggggtgtattgtctaggcggcttgcgatcgaaattgggtctgggtttttttatagttttgaagggttggaggtgaatggtaataggctagctgggttttataagtgtggtaggcagtagcgggttgagaatatttaggaggtgaagggtagtatgtgggtggaggtgtttggtatgtgagtgcatattttggaccttgggataccatcactgcccctacttctttcttctttgatataccccttgattgtaatgctttgttcgtaccctgcaatgcctcaaaattagttaccatcacgctcttgatcccttcttcaatcctttacccgagtttgatgatgtcggagaaattgtgattttcgatgaccattaacctttcatagtattgtggaccttgggccctgacgaagaatttgttcatctgctcttcttctagtgcccgcctgacctttgcagcttctaacctccattgagtagcatattcacggaaagtttccgttggtttcttcttgaggttctgtttgtagaagacgtctggtgcattctttgtattaaacctgaatcagtccatgaagtctgattccatacttacccagctaactcacttattggaattttgactgatgtaccaagataaggcatctccagtgagactcctcatgaacagcttcatgcaaatcctttcatccttcccaaccaccacgagcttgtcatagtatatactcaaatgtaccttcgggtcacccctcccgtcaaacatctcgaacttaggaggtttgtaaccctccagaagttctacttctagctgaatacacggatctttataattcaaaccttcaatacctttgccttcttctacaccctcaactcggcttgtgatcttcttgagctattccgccatattcttaataagcaggtccttctcggcggattctggtatgtatgagattggttgagtagagtggggtaaggtttccacgtatatgggattattttggtaggtgccgggggtttgagtgtagtagtaatcattagatgaattttgcggatcaggaataggttgtggggtattctgagaagtatggtaagtagtttgtgggtattgagtcaggagatgctggtgttgagggggtgtttgtactggtggaggattaggattttggggaggtgttgcgtatttacggggtgcgggtggattttgtggtcattggtgtggtgtattttgaggaggtactgggttctgggcattttgcttgttaataactgggaggtttagggtgagggaaagtcttgccaagttgcggacctgctcaagctccccttacaattctagtatcttttgttccaaccgtaggaccaagtcatgttgtgccggagtactccgaccgtctaaagtttcaacattctccacttgagcaacattttctttccggataccactcatatcatccatctttgcctttcccttgctttttgggttacttggagtaggaggtgatggagggcctctggatctggtgtgatatgttaacgatgccagtatgtgtgaaccaaccttagggtatgagaataatcaaaataaagaaaaaggcaaaaaggtaaacaagtcagtaaggattctgaaaagtatttgcaatatttaaacacgtattgtaggaatgtaaatttgcgtcctaatttagggaaccttgttgtgcccgaggtaggcctagcgacaagtagatttggagaaatttaatgtcgataaaggcctcattttattaatataataaataatacgaacctaaaaacgacaataaataaatgagttacaaatggtgtttgccttattacattcgaattccaaaacaattcaaaaaatagataaacctaatctacttggtcgtagagggaccttcaccatacttgaccctcttggctccgtcgatcatattccccaggtcatgcatgtccagtagcaggtacgcccttgttaggtgtcctctctctttaccctctacattctgacagtctatgacccttttcctcatcttcccttccggttccattagaccctgctccaaatattccaacctttatgtcgaccatgtagccatttccttccactcattaattgactccatgtctaacttatgttgttccaaatgcctggattcgaactcaaggactctttttcgtagcctctcatactttacctgtgcttcagtagcctcatctatgaccctgcttccttgaccaacccctggctcgactattcctgctatgttatcttctaatcatgatgggtacaagtacacatgagatacgggatatcgatctggctctatggtatccttttccacgataatcttcaaatgcacatttgaatggaatggcgtcatcctgaaaatctgctttgtaatgactcattttgaagacttgcggtatgacttgttttctaccagcttgtatcatgaccctgatagtaacatagggatatatgtcccttaacccaatcaacaccagatgcggaacatccctagatctgatgttgaattccctagtagggaacaacttgaacatccaatgaaccttgtcctcgatcaaattgctgaaaaactatacccattatgtagcattctctagttgtggaaacctgtatgggataaaggtcattcttttcgaatgatggaaagctatgtgatcattccatggtctccttggaaacctttggcggtattggcctctctgaagatgttctaacaaccaaatttgcagcagcaagttacaccctcaaaatgtttgaacccttttttgcaacgatccagagcctggtatatttctgctacaatgattgtaacaatagtatttgtttgtctctctattccctccattaaatatttggttaccatgtccaacctggtatgtattctgtccccttggcttgcaaacactatcatacccagaaagcagacgatgaatacaaaaaccttacgatgagtccaacctagagaagtgatggagaattcgttatgaaagatacggtaagattttttgtgtctgtatcgttcatacaggaagtcaaagggtatgtaggacttctttaggcatgccaagtcgtcattctttctcaggcccatcatttttagaaaccccctggtagtgcgattttctggtactagtaaactgagactatccatggtaatccaacgaatcctcctatttcctccaaaagaggagtcatttctatattgccaaaatagaatacagctctttctccatctcaaaacatagtagcagcctcgatcagcatgttgtttggttggatgtccaataaggaggttaagtttccaggaacccttttcgcgtgatttttgtcgcttggcgaaaggttttcctaccaatccagcaataagagtggcatatttcggaccattccaacctggggacttcgtgcctcattttctacaaaaataaatagagttagacccttgccccctccggattctactacatacacattaactattagcgtgttggcatttatctctccaaataattcacatatcgtggttgcacctgttgggattatggaaatcccggtggactttggacaaggtttttcttagagggttattacgcggacaacttattaactcaggataggtttgtgcatgatgcatgtacagttattatcaaagtaaggtttctatagaagtctagactggtaccctcaagcggacagcttgagagggaaaagaacaaaaccgttaatttcaccactgatcgactagttttaccccaaataagcctttccaaatttaaagggtgattttaagaaaagtgtggacactcatcaagtggcactatggtattagtacgcacaagtggaatatgatgttgagcatgctttatgcaaaaattaacacattgtcaagtatttttacatgtttgaaaataaatgcagtattgaatgaaagtaaagacataaaggaaagaaaaaaagggaagaagttagttcgcgaaatcaaggaattataataaagcaagtaaagggggtaaggattcgggagagacatgatatagcaaaattaaaagtttggagcaggtgaacatgattaggaaataaggggaaacacacgttgtaatcgaattaaacgaagagttgcatatgagttcatactggaaaatagggaaaaagatgtgcatgtagcaataaaaggggaaaacaagagcaggatattctaataatagaaaaataacaaaaatacacctatgaagagagactaatttatgcaggtcaagtttgtgatggtaagagcctaaagacaatccccagtagagtctccatgctgtcgcgccccctttttctggaaaaatcggctttcgaccttttgacaactcctttgagagggtagggaaaaggaattagttagagtcgccacctaacggattaaggtgtgttagggcacctagagcagataactcatattataccagtttgcatcactagagatccgataagggctcgaagttaccttgaggggaaggtattaggcacccctcgaggtccacgacggtgggtcccgactgaacttaaattatgtgtatttgtctaaagaagcgcgtaaaactatttaaataaggatgggggttcctgaattttttagcctataggatcaccccgtgcaacataaatagtacttcgtaactcccccaagacaggggtgttactcatattatttgcgggcacagactatcatctccaactacccgattattatctttgagtttttgcttaaagagctctaatcaattctaacttgtatcatatgtgtgtgttacccatcccttacctatggtactgggggcattgggacctctattttggatggttctagactcagcttaggttgctcaaaattgtaaaactaagcgacatacaaaacaaattggacttttcatgcaagagcagataaaggctcagtttatcctccgcacataaggcagcaaatacacgcaaaacatattggcgtattgacagtttaatcaggtaaggatattagatcctatagacatgatttctacatgattctgtatttttaaatatgctagcagtaatttctaaatgatcctataattcactactgatttgaatcggagcaatttgaacctataggcgagttatctaagcattttatgcagtaactaacaatggtgattactggagtatattaagaattggataactgaatcatataggcatgatttctagtgataatggttaacccagcattgatgactattaaagaaacgagtaaagtagttaattaactagttcagatcctataagcatgatttctataatcaaatcgattttagatcctataggcatgatctctaaaattaaactaattttagttcttataggcatggtttctaatattgagcagtacataagcaggaatttatacacattgagcaaaaaacagttaagccaaatattggtcctacaggcatggctgttgatgcataattactggacaaattgatacacctaaaggcaggatttctaacaaatcataacgttggtcttataggcaggatttctatcatgtaaacaaaacatagaacctataggcagtatttctaacatacaacagaatgagccaaacaaacacgtataggcaagatttttacccattctcatgcaaacattaaaactaagccgagttttcccagttcactattgccccaatcgttattacaaataattattacaaaccacaatcgaatgaataaattacaaagtatataaactataagaagcctgcagcaaagcccaaatgtacctggacaaaccaagtcttcaactcgcagcatctccaaagcccatgttcataggtacaacatgaccaatggtgagtgattcacccatgtctcaaagatatgcataaagaacccaaatatctagtgtgtcagagtttccaagggcttcaagaacccggggaagtgctcacactagagaagaatgatcagaatagttcaaggaaaactatggaccaaattctggtgcatcagagttcacgagggtctcataggaaccctgagtagtgctcaaccaggaaaaccaagggacaaggccaagattactttggtttttagccaacagggattagaattcaggatagtgtaaaaaaagattgggaaataggtttaaggagagaatcacacatagaaaagaggcaaacacattgaaactaaacatacatgaaactaaaaagtttgaaacatgctgacaaagaacattttttaaacatgcttcacaaaggcaataaagagttcagattgggagtcatatgaaatcaatcatgaatcaataggcatattggttattaataaacattaataaagaggatgcagcatggtgggcacaggatcaagtgaatacatgacaacagacttagcaataaactgacgagtttacatggtgaatcagtgtcacaaacacaattaataccaaatggcagtcttaagttacacatattcacatgagttcatcaattaattcacgaattttaaacatgtctaaaatacatagagcattgaatctaataaaagtagcatattggacaagtgacacagtagggaggtttcaatgtagtttagatgaaacagaaagaagttaggtaatgcagcaatgatcatcaatagcagtaaacagcaataaggtttctggccttggcttccagtcggccaggaattaaagcagagtagaatatagtatatatcatttcagtagtgagagatactctgattcctaagggaaatgggggagaggtttaaatagcattggactaggcaaataaatatgacaataatcaatcaaggaaacatctaatagtcaattaagggaagaaaactcagaactttatttaaggaaagccagaagtaacaagtgcataaatgcgtaaaatatggagtcagagattttaacacggtaactagggacttaaacagatttgaggaatcaaagactcctaagtttagggtaagtgaaattggtcagcatttatcggcaagaatcacaaaacatatagacaaaatcactgagtgaaataatgaaagaaagaatcgaaaaccctaatttttagagtaagtaaaaattagtcagaaattaatggcaggagttataataaagataaatagagacatatagacggaataattaaagattgaaccaaatttggttcaattttaatgaatcaaaaaccctaattttgggtaagtaaaaataagtcagaaatatctaagaaaaaatcataatagagatgcacatagatagatatacggaaacattatagagaaatatttaacaaaaatagaaaactataacagatcttgaaagatatgaaccctagctttagggtaaatgaagaatcgagaaaatctcagagattcatactataaggagacgaaaaaagaacatagacggaaagaaataaagatctgaactagatttggttcaaaataggagagatctgcttgccatgttaggcaagcaattatgtaacactataaatgggtagccagtagcgagacaagataaataaagtaagaagatcattgatggattccatgtctgggttggaatcaaagggtaaattggtttacggtgctagggctttgagaagggaaaaggaagagatgagagaatacaaaggcggctggtttgggtgaatgagagttagggttaggggtttggttaattaaaatagggagaagggatgttggtcgttaatcttgaaagatcaacggctaggatttaaaggtgaccggggcgggttataatagacgggtaccgaccgggtttagcgggttgggttaattgatttggactgggtattttgggttggtgtataggtgttgggcttgtttattgggtagttttaggttcgaaaataggagtaatttagtgctagttttaaaatacccaatatttaataaataaataatttataaaagtgattaataaatatcaaaaatatcatttgtgcactaaaatgattagattaattacttatcattataaaaatataaaatggtattttatgcataaataatataattatacattcatatgggttgttattgtaaaatgtgcaatttagccttaaaatgtaaatgtaattataaaaatgcactgaaaaatatttaaatattatgatggtataaatgataggtttagatgattaacttatcataaaaatttggagggtaattattggatatttatataataaaatgtataaacaaattgatttagagcttttaaaaattatggaaaattatgaaaaaatacttgtgcatacctgtaaatcaaatgatgatgcatgtgcattattttgaaagtgtatatatatatatatataaatttaaaaaatatgagggaaaaattgggtatcaacaaagtgttgaggtgagttggggaggttgcttatgagcttgctttacctcccagcttatcaggagttcatccagtttttcacgtgtttatgctccggaggtccagtcgtagaagcgacttttggaattttaatgagaaaccacagaaaaggttggttggaccgcaaatgcggtattgcaggtgcagtaaaggggtcgtagatgcgaaaacccctgggcagaatgtatatatgtctctgcttcgcgatttttaaagggtttaaccatttttaacttcggacttagaatttttgggcgattttgaagagatatttcaatggaacttcgataaggtaaggattttggacttcaaacacacttttatggtagtatttcatgaattaggactgaaatttaatcaattaatggactaaaaatggaggtttagggcttgagtttaatagggcttaaattaaggatttgaggggtcaattgaactccgattttggtgtttttgatatgtatgaactcgtggggaaataaggaatctgatgatatgaaaatttatgagtttggagaagtgggctcggggctcgggttttgccaatttcgagatttttgacatttttttattgttttcgcttgtgctttgttcccttaacatattctgatgtatttgttcttgttttggtcaaattcaacgcacgaggaggccgatttgagaggcaaaggcatactgaactcgagttttaggcggttcgaggtgagtaatgattgtaaatgatgtcctgagggtttgaaaccccagattgcacaacgtagtgctatattgaggtgagacatgcgcttaatggtgggcgcggggtcatttacttttggggattgtgacttggtccatcgcgattgatatttttatcacgtatttgactgagacttaattgttatcatcatgacttgggcttattgccatatttgggctttgtgctgactatttgaatccttcatagacttttatcactttttcctcactattttgacatactacttgaactcagtcctattgatttacactgctttacaaactcagccacttttacttgaatttgagacttaaatgatctttcaaatgttatttgggctgagcactactgttttactgattcccaaagggcgtgtgataatttatggactgaatgaggccgaggtccatatgtgaggacatgctgagtgatatgagatactttctatgccatgaggtggcttgagtgatgtgaggccgattgatgtgaggtcgagtgccgagtgatgttgccacgaggtggcttgatatagcgcttgggccgtaaggagcccctctagagtctgcacacccacaatgagcgtgggtacccattatgatctgagagtgagcccgaggggctgatactgttctgagtgattgatactaagcccgaggggctactatactaagagtgagcccgaggggctgatactattcggagcgactgatactgtgcccgaggggtgggtttctacttgttatttacctgttaaattacctgttttacttgtttttaaaaaggaatatcatttgatttctttattgaattactgctttaagtgattttactgattgatatagaattgttttgtgcctttacgtgttttcatactttcagccattatttataattattactcactgagtcggagtactcacattactccttgcaccatgtgtgcagattcagatatcgcagagtccgctcctgagtgctgattctcccagttcaggtagtgattcagagactacgaggtagttgttggcgttcgcaaccccctgcctcccttatcttatcattttcatgtttgtagaactattatatcggatttggtgtttagtagacttgtatccggatttcttagttgctcatgacttgtgacaccccagtttgggctatgttgggatggtttctactgttgttatcattaattctgcaatttatggatattatatcatgctttagaaccatttatgatatttaactgtttaatagaggtgttctgtttggtctggttggccttgtattcatgataggcgccatctcgaccgggatcgggaattgggtcgtgacaagttggtattagagcctaggttacttaggtcacgagtcatgagcaggtttagtagagtatcgtgaatcggtacggagacgtctatatttatcatcgagaggctgcagaacctttaggaaaaacttcatattcttgaaactcttgtcgtgcgaacttatttgtacaacaactaaacttctatattctattctctcgcagatggcgaggactcgtgctaccggacgaggcggaagaccaccagtaccacccactgaggccaccaaagaccgtggacgcggtcgtgatcatggtagaggcagagcagtgagggcagcacctattgatccaccagctgccctagctcaggaccaggctccagctatggatactccagcagcaccagttcaggcaccagctgtgcccatcatgattccgagtcttcaggaggcccttgctcagatcttatcagtttgcactagactggctcaggcaattttagctaccacagcagcatttacttaacaggctgggggatgcaatcagacccctgctgctcgcacacctgagtaggtagtgtagggattgcagatgccgggagcacctccagctcagccagttacaccagttcaggagttcgtagttccagctatgctagacgatgagcagcgtcgtttcgagaggtttggtaggctccagcctccttcattcagtggtgctgagggcgaggatgcccagggttttctcgacaagtgtcagcggatgcttcgtacggcagggattattgagtctagtggtgtggtatttaccacctttcagttctcatgagatgcctttacttggtgggaggattttgagaggcataggcctgtcggtgcagcacttctttcttggcagtagttctccactctattcttagagaagtatgtaccgcagtcccgcagagaggagctgcgtaggcagtttgagtggttgacacaggggaatatgaccgtgacccagtatgagatgaggttttttgagttggctcatcatgccattttgatgattccatcagatcgtgagaggctcaggagatttatggatggccttaactaccatctccgtattctgatgactaaagagagagtattgggtgctacgttcgaggaggttgttgatattgctcgtgagattgagacggttcaccatcgggagcgagaggagagggaggccaagaggcctcgaggatcgggcagttacagtggtgctcctttgaggggccagttcttgtatggtagaggtcattctttcaggccactcaatcgacccgtcccgagtatcgtggggcatcttcaggccatggttatcatagttctcagcagggtcagccttcactcagcgcccttccaactaaaagttcatctcgtgccccgtctgttcagagttattccatgccgagtggatcagctagtcactccagtgcgaggggttcccttcaatcccattctccagcacctaagagttgttttaagtgtggagagtttggacatatgtggaggaagtgtcctcatcgtgctgctagttcatcacagcagaggggtcagccctcgtcttctgctccagttacttcagcacccgcccagccagttaggggtggaggtcaggtaaccaggggtcgccccagaggtggaggttgatcaggcggtggccaggcccatttttatgctaatccaggcaggaccgatgctattgcttccgatgctgtcattacaggaattatttcagtctgccacaaagatgcctctatcttaattgatcccagttccacctattcttatgtgtcatcatattttgctgatcatttgggtatgtcccgagggtgtcttgctttacctgtccacgtatctaccccggtgggtgacactattgttgtagaccatgtgtaccggtcatgtgttgtgactatgaggggtatagagacccgagttgatctattgctattaatcatggtggcctttgatgttatttttggcatggattggttatctctgtgtcatgctattctagactgtcatgccaagacagtcactttggctatgttgggtgtagcgaggatcgagtggtgtggtgtgattgattatgttcctactagagtgatttctttcttgaaggcccagcgtatggttgggaagggttgtctttaatatttggcatttgtgagggatgttggatctgagactcttagtatcgattccgtcccagttgtgagggattttcccgatgtatttcctgcagacctatcgggcatgccaccagatagggatattgattttggtattaacctagtgtcgggcactcagcccatttccattccgccatatcgtatggcaccagcagagttgaaggaattgaaagaacagcttcaggaactcctaaataaggggtttattcggcctagtgtgtcaccttgggtgtatcggttttgtttgtgaagaagaaggatggcacgatgagaatgtgcattgataataggcaattgaacaaagtaacaattaagaacaaatatcctttgcctctcattgatgatttatttgactagcttcaggaagcgagggtgtcctctaagattgatctccgttcgggctattaccagttgaagatcaggaattcagatattcttaagactgctttcaggactagatatggtcactatgagtttcttgtcatgtctttcgggctgaccaatgccccagcaacgttcatgcatttgatgaacattatattttgaccttatctggattcgttcattattgtattcattgatgatattctagtgtactcgcatagtcaggaggagcacgcggagcatttgagagttgtattgcagagattgagggaggagaaactttatgcaaaattctcgaggtgtgagttttggctcagttcagtggctttcttggggcatgtggtgtccagcaagggtattcaggttgatccgaagaagatagaggcagttcagagttggcccagaccgtccttagccatagagattcgtagatttcttgggttggcaggctattatcgccggtttgtttaggaattctcatccattgcatcgcccttgaccaagttgactcagaaggctgctccatttgtatggtcggacgagtgtgaggagagcttttggaagctcaagacagctttgaccacagctccagtattggttttgccattagcttcaggttcatataccatatattgtgatgcttctagagttgggattggttgtgtattgatgcaggagggtagagttatcgcttatgcttctcgttagttaaagccttatgagaagaactaccatgttcatgatttggaattggctgccatagttcatgcattgaagatttgaaggcattacttgtatggcgtatcttgtgaggtattcactaatcatcgcagtcttcagcatttgttcaagcagaaggatcttaatttgaggccgcggagatggctagagttgcttaaggattatgatattactattttgtatcatccgggaaaggccaatttagtggccgatgctttgagtcgaaaggtagtgagtatggggagtttggcgtatattccagttggggagaggccccttgcatttgatgttcaggccttggccaatcggttcatgagattggatatttcggagcctagtcgggtgttagcatgtgtggtttctcggtcttccttatatgatcgcattagatagcgtcagtatgatgatccacatttgcttgtccttaaggacagagttcagcatgatgatgccagagatgtgaccatcggtgatgatggtgtgttgcggatgcagggccagatttgtgtgcccaatgtggatgggcttagagaattgattctagtagaggcccatagctcgcggtattctatcaatctgggtgccgcaaagatgtaccaggatttgaggaagcactattggtggagaagaatgaagaaagatattgtgggatttgtagctcggtgtatcaactgtcagcaggtaaaatatgagcatcagagaccgggtggcttgcttcagcagatggttattcccgagtggaagtgggagagaatcactatggattttgtgagtggtcttcctcggactttgaagaagtttgatgttatttgggtggttgtggatcggctgaccaagtccgcgtacttcattctggtgtgtactacctattcttcggagcagctggcagggatctttatccgggatattgtttgattgcatggtgtgccagtgtctattatttcagatagaggtactcaagttacttctcagttttggaggacttttcagtgagagttgggtactcaggtggagttgagcatagcatttcatccgcagatggacaggcagtccgagcatactattcagatattagaagacatgttgcgtgcttgtattattgattttggaggttcttgggatgagtttttgccgcttgcagagtttgcctacaacaacatctatcagtctagtattcagatggccccgtatgaggcgttatatgggagacgatgtagatcttcagttggttggtttgagaccggcgaggcgaggttattggggacagatttggttaaggattcttagagaaggtgaagatgattcaggatagacttcatacagcgtagttgcgtcagaagagttatgcggaccggaagattcgagatgtatcctacatggttggtgagaaggtcttgctgaaggtttcgcccatgaagggtgttatgagatttggaaagaaagggatgttgagtacgcggttcattgggccttttgaggtacgtaggaggattggggaggtggcttatatgcttgctttgccacccagcttgtcgagtgtgcatccggtatttcatgtttctatgctccggaagtatgttggggacccatctcatgttttggacttcagcacgtttcagttggatgatgatttaacctttgatgtggagccagtagctattttgggtcgtcaagttcgaaagttgagatcacaggatatagcttcagtgaaggtacagtggagaggttggaccgtggaggaggctacctgggagaccgagcgggagatgcggagcagatatcctcacctgtttgaagcttcaattatgtttctttactcgctcgaggacgagcgtttgtttaagttggggaggatgtgacgacccgacccatcgtctcatgagttatcgctctattttttccattttcagcttctttattcttcattatctgtaattggtgtgatcgagtcgatttggattggttttggaaggaaatgagacacttagtctctttaaagaaggcttagtttggaaaagtcaaccggatgttgacttatgacttagagggatcagatgtgatttcctgtgattcggttagcttcgggggatgatttgtgacttaggagcgtgatcggaaggggttttggaggtccggtgtagaattagacttgaattggcgaagttagtattttggcgatttctggttggtaggtgagattttgatccgagagtcagaatggaattctgagagttgcagtagcttcgttatgtcatttgggatgtgtgtgcaaaatttcaggtcatttgggcgtgttttgattgggtttttggtcgaaaatgtatttcggaagattttagaaaattaggcttgaatttgatgtgatttagtagatttggtgttgtttgaggtgttttgatgattggaacaagtttgaataaggtactgggtcatgtttgtctttttggttgaggtcctgggggcctcggggtgatttcggatggttaacgggaagatttgaacttgaattattgcagaaagtgtactacttctgatgttttcgcacctgcggcttggaaaccgcgggtgtagtgccgcacgtacgaggggaaaatccgcagatgcgaagtttgggctagagtgcagtttccgcagaagcggtcgaggtggccgcagatacggaagtccagtcgcagaaacaactttaggaattttaatgagaaaccgcagaatcggttggttggactgcaaatgcggtaccacaggtgtggtaaaggggtcgcagatgcgaaaacccctggggcagaatgtatatatgtctcttcttcgtgatatttaaagggtttaaccatttttaacttcggacttagagtttttgggcgattttgaagaaagatttcaagggaacttcgataaggtaaggattttggacttaaaacacacttctatggtggtatttcatgaattaggactaaaatttaaggaattaatggactaaaaatagaggttttgggtttgagtttaagagggcttaaattaaggatttgaggggtcaattgaactctgattctggtgtttttgatatgtatgaactcgtggagagataaggaatctaattatgtgaaaatttctaagtttcgagaagtaggcccggggctcgggttttgccaatttcgagatttttgacatttttcgattattttcgcttgggctttgtttccttagcatattgtgacgtattcgttctagttttggttcgattcgatgcaaggggagttctatttgagaggcaagggcatagtgagctagagctttagccggttcgaggtgagtaatgattgtaaatgatgtcctgagggtttgaaatcccggattgcacaatgtagtgctatattgaggtgagacatgtgcttaatggcgggcgcgaggtcgtttactattgggaattgtgagttggtccatctcggttgatgtttttaccacttatttggctgagacttaattgttatcatcatatcttgggcttatttccatatttgggctttgtgccgactatttgaatccttcgtggacttttatcactgtttcctcattattttgacatactactcgaactcagccctattgatttacactactttacaaactcaaccacttttacttgaatttgagacttaaatgatctttcaaatgttgtttgggctgagcactactgttttactgatgcccaaggggcttgtgatgatttatggactgagtgaggccgaggcccatatgtgaggacatgctgagtgatatgagatactttctatgccacgaggtggcttgaatgatgtgaggccgtgtgatgtgaggccgagtgccgagcgatgttgccacgaggtggcttgatatagcgtttgtgccgtaaggggcccctccggagtttgcacacctacagtgagcgcgggtacccataatgatctgagagtgagcccgaggggctgatactgttctgagtgattgatgctgagcccgatgggctgatactgtactgagagtgagcccgaggggctgatactgttctgagcgattgatactgtgcccgaggggcagatttctacttgttatttacctgttaaattacctgttttacttgtttttaaaaaggaatatcatttgatttcttcactgaattactactttaagtgattttactgcttgatatagaattgatttgtgcctttgcgtgttttcatactttcggccattatttttaattattactcactgagtcggagtactcaaattactccttgcaccatgtgtgcaaattcagacatcgtagagtccactcctgagtgctaattctcccagttcaggcagtgattcggagactacgaggtagttgttggcgttcgcagccccgtgcctcccttatcttatcattttcatgtttgtagaactattgtatcatatttagtgttcagtagacttgtatccggatttcttagtttctcatgacttgtgacacaccggtttgggctgtgtcgggatggtttctactattgttatcgttaattctgcaatttatggatattatatcatgctttagaactatttatgatatttaactatttaaaagaggtgttttgtttggtttggctggccttgtcttcatgagaggcgccatcacgaccaggatcgggaattgggtcgtgacactgggagtccaagaagtacatgcgaagcagatacccacacttattcagcacttcaggtatgaatctaaacttgttcgaggacgaacgtttgtttaagaggtagagaatgtaacgactcgaacgatcgtttttcttgttagaaacgtgttcccttaaatgagacttcccgtactttcttttactaatttacgacttgtgagaattcaagattttgaagagtttgggttgaaatcgaaacacttagtaccttaaggttggctttaaaggccaagtttcacttcactcaacattttgaccaaacgatctcgaaatcaggatttcacggttccaataggtttgtatgatgatttcggactagggcgtatgttcgtatcgggttttgggtgactcaggagcgtttcggcacctaatagtgaaagttggttcttgaagatttttgaagttctttaaatttggatttgaagagattttggtgatattgaggtccaagtggaatttcgaaaattggaatagttccgtaatgtcatttaacacttgcatgtaaaatttggtgtcaatctgagtagtctatgtatgattggacgcgatcggagccttgaagttcaaagtttgattcagtttgggtttggggtgtgattattggttttgttgtattttatgcattttgacaattcgagcaagttcgtattatatttttagaattgttggagtagttggaccgggtcccgaggggctcgggtgcatttcggaccgcccggagttgagttaaacacaccagatttctgcttctcatttccttcttcgtgaacacggtcatactctcgcattcgcgataaaggatttggggtgctgtgggctgggaagctttttcccttcgcgttcgcatgcctaggatcgcgttcgtggaggcttgggtcatctagccatcacattcgcgtgacctggctcgcgttcgcgtagaagaggctgagctgggtggtcgttgtttattcttcgcattcacgtagggtaagccaagcaagccttcacgttcgcgaggctcttgtcacgttcgcgatgggtaatttacctgggcctagaccgtttgacttcgcaatcgcaaggcctctatcgcgtagaaggaagacctgggcaaaacacttttcaaaaatgggacttagctaggttatgttggctcatttcttccgttattgagcgatttaaggagctcttagagaggggatttgacttagcactttgagataagtaatttctacacaatgtgagttaaatacatagtttatgggtagattataacatgtaaattggtgaaaatcacgggtttaggtggaaaaaatgagatttaaccacgatatttattattgaatttagtaaaaatcatatatttatgttccttaggttattggtaacaactttctttaaaaatttccggaatccaagcatgtgggttcgggggtaaattttaggaatcttgcaaattaggttgggtaatcacttaaatggtggaattatgaacttttgagcatggatgattagtttatgtactgtttgactagcttcgagttgttgggcatcatatttggaggtttgagcgcgttcttgaattttggaagtaggctttgatacgaggtaagtctcctttttaaccttgcaagagggaattaaccccacaggtgaattaaatacatgtttgaacatattgtgggggctacgtatttacgaggtgacgagagtccgtatgcagctactagtatgctattgtccgggtagtttaggacccgtatcatgctataattgaaatgttgtgcccttacttactaaaataatcacttaaatgatgttagaaatttataaaggaattgtatgaggttaaactcactaatttgaaagtttgcatgaaatacttgactataaataggaaatttgtgttttcttgaaaataaattgttatttatggatcgggccgagcgcctcggtagtaaatagatgcatatatggttctcaccgttcgaccctccagtagtgcacattttaatactatattggatcgggttgtacgacctcgacataattgtgcatgttaattatttggaactctccataatttttactgcttaaatgctttgaaatgtaagttgttacatgatatgactgaaattgacatgttatttatgaaagaatatcttatatcttcctattattgaacttttagtattattcatgatatctatgcctagcataacactttaattatatgattgttggcccaagtaagtgtcaagtcaacccctcgtcactacttcttcgaggttagactggatacttactaggtacattttgtttatgtactcataccttgcttctgtacttaattgtacaggatttgaggcaggtgcatctagttatccgccaggcgtgcattcttgatcttgggctgagacttcacggtgagctgccccctttctagccgttcagtagcatgccagagtttctcttttgcttgtacctgtctattctatttcacaataggatagtcattttttgtatattccattagttgcccacacacttgtgacactagatcttggcacatattagtagacttgatttttggttgtattcctataattatgatttcttttagttgtttccgttttggttgccttaaaaatccaatacatatatatatatatatatatatatatatatatatatatatatttaaatttaaataaagttagatgttgggattgcttaataaaaatgggaaaccactaagttattcactgttggcttgtctagcaatggtattggacgctatcacgacctgacatggagttgggtcatgacataagtgaaggataccttatttagacttgtattttaaagtacaagagggggtgaattataaatatttaaacctaatcacttattagttgactagataatcgagtagtcgactggatataataacctaatagttataatgatagaaagtaagatcagaaagtaaatgcaggaattaaagacaccaagattttatactgatttggattcaatgtgaatcctagtccagtccccttgggttgcaagagagttctctttagtaatgtgtttctccaagtacagttgaaatgaattgacaaaacggtttctctagcactcgtttctttttgatacaatgtctcaccggtgttatactctctttttttctctgaattattacacaacagatcttagtgaactacaatgtttgtttgcagtagaacaaagagaggtatttttggtttgatcaaagtatatatgacgaaggtttaaggctgggtataaatactttgatgaaggtcgaggcttgacaacccaaaagattttatccttagaaagatattgattctttccaagaataagatagctagatgttacttttccttttccttctttcagcagatgtatgtaatgaacacttgctccttgattgttggttcttctgaaattagttgcgtatcaatctttacaggatcttcgatcttcctagatgctggccttgattcatgccttaagtttaggcttgcttgattctctccatcgcagctagccgttactctttgctgattgatttgctgattgagttctttccttagttatccagatttgcgagttctttccttgggcatccagatttgctgattggattgtaatctttgctgattgatttctttccttaggcatcaaaattgactccagcgatcttgtagtatcttcttgattccttgtaattgatttcctgcatatgtatattatttgcatcattaaaactggatctaacaatctcccccttttttatgatgacaaaataatatacaaatgtaaacaccagttgacttccctatgttttactcaccctcaatgtatgcagttgactagtccatgatactccccctcaatgtatgcagttgactagtctatggttgagtcgactcctgccacaaactgaacctgtacagatataacatatactctttctccccctttttgccatcagcaaagagggaacaagctaagaactaaacagaatatatagcaattaaacatgagagttataggaatcatccaatggctgagaaaacagcccacaaaaatagcacagcaaaaaataaattatccaaaggctgaaaacacagcccaaaaccagcagagcaaaagaaatatttttaaaacaaccacagtaacggtgcagaaaataagtaagggtgttgcagatgacctccttcaattgttcaaagcttgcattggctgagatgctcactccatccaacctgtcatgaatctccctgaaggctttgacagccttctccctaactctgaaaacagcaactctaattttggacacatcagaccctatttccttggaaatggcatgaatgtcacgaacagtagattgagtggctttgagaagattttttattttagagagttgagagtcaatagcatgaagcttttcaccaagatcagggctgtcaagactaggatgagggacaacgggtgaaggtttaggctctacaggtgcatgctttgcttcactatcgtgcttcttaacctaataacactttaaactcacatatcccatactagcaaaggctctaaaattgtaagacttagaggtagtgatgaagggatagttggacagggaaatttgataagcttccagaatgtgagtgatttccatgccatagggtagactggtgggatcttcagcactctcgatcatgaaattgataacccaggaggaaatattgattttgagtttggtcacgaggcaatagatgaagaaagtgcctctttgagataaggttgaaaaggaaccagtacggggaagtaaagtagttgctacaatgtaggccagaatccgagtttcgaaactgacattactgggacctaactggtttggtagggagtcagagggacagtcagcaatacactatttggcttggtcaaaggaaatttcaaagtcatcaggccaggtatttttaaacaacataggaaaaccagaacaacgacactgaaagagcgaatcaaatagggcacactgaaaaaggttctccgccttaagaagagggtgtctgacggttgagtacagaaaaggaaaaattgtcagttgaagagacgtgatgattggcttttcaactttgcacgacgaactaatgtaaaagaagagaaaagagagggaaaatggaggcgtaataaatgcatgggtaaaggacaatcattgcaaaaaaaaaattaacaatacacataggtcttaaaagttattagtaatgcaagtaataccaagtaattttcttaaatcacaaaatctctcttctaatgaaggtttagtaaaaatatcagctaactgatcagtggttccaacaaaagatatttctatgtctctcttaagaacatgatctctaataaaatgatgcttgatatctatatgctttgctctagagtggtgcacagaatttttggaaagacaaatagcactagattgtcacaaaaaagtttgtataggcttaaaagaaagttcatagtcacccagttgatgagacatctacagtagttgtgcgcagcattgtccagcagcattgtatccagcttcagtagcagacaatgcgactgatccttgttttttactgttccaggatatcaatgcctttcccagtaattgacatgtaccacttgtgctttttctatcgtccttatcacctgcaaggttagcatttgaaaaaccttctaatttaaaagagtttgagcgaagataccatagtccatgagatacagtcccaataagatatcgaatgattcttttcacggcggtcaaatgtgattccttaggagctgactgaaacctggcaaatttacatacactgaacataatattcggtcgatttgttgttagatacagcggtgatccaatcattccacgacatttagttttatcaacaggaatgccatgttcgtctttgtctagatttgtggaagggctcattggtgtgccaatggattttgcattactcataccaaatttttaaatcagctttttgtgtatttggtctaacatataaaggttccttcttcagattgttgaatttgtagtccaaggaagaacgttagctcacccatcatgctcatttcgaattctctttgcataatatttgaaaattccttgcacatgagagggttagcactaccaaatataatatcatcaacataaatttaaataataaggttacctcccgatgatcttttaatgaacaaggtagtatctattttacctcttgtgaagccatgatcaacaaggaaggaactcagtctatcataccaagcacgtggagcttgttttagcccatatagtgccttagtgagcttgtatacatggtataagaattttgaatctacaaatcctgaaggttgtttcacatatacttattctttgataaatccattcaaaaaggcacttttaacatccatttgaaacagcatgaatcctttaaatgatgtgtatgccagaagaattcgtatggattcgaaacgagctactggggcgaaagtttcatcatactcgtctccttcctgttgtaagtagccctgagcaactagtctggatttatttcttacggcctttccatcctggttcaatttatttctaaaaacccactttgttccgattacagacacattttcaggtttgggtatcagattccacatttaattcttactgaactgatctaactcttcctacataacttgtacccagcttgaatctttcagtgcttcttctatcttttttggctcattctgagagattaatgcaatatttgctttctttctgagggctcccctagttttcattccttcatttggatcccctataatgaattctgaggatattcaggtttgcttctccattcatttgggtgaactacattcgtagttgactcgattctttaatctagtacattgctgctattttcactagttgactctgtcgcagtagatatatcaatcgactcttgagatttgttggtctcctaagtttcttgagcttgatcttcatcacctacaataattcatttctcgaccaagggattattttcatcgaatataacatgtacagattcttgcacatataatgtgcatttattatagactctaaaagatctactatttaatgagtggcccagaaaaatatcttcatcacttcttggatcgaattttccaagattatccttaccgttattatggataaaatatttacttccgaagggagggaagtaactaatattgggacgtttacctttccataattcatatagagtcttcttcagaataggcatatgaggcaacggttgagaatgtgacatgttgtacttacaccttctgcccagaagtggtttggcagagaatgttctagtaacatggttcttgccatatcttggaggattctgttctttctttctacaacccaattttgttgtggtgagcgtggtgcagagaaattatgggtgtatccctgatcattacaaaatcttcaaatgctctactttcaaattctcctccatggtcattatgaattgttgaaatcagatgtcccttttctctttcaacctttttgcagaaaatttcaaaatttcttaatgtttcatccttatgagataagaaaattacccaagtgaaacgtgaataatcatcaacaataagaaaagcatacctctttcctcctatactagcagttctagtaggcccaagtaaatccatatgaagtaattgcaaatgttttgaagtagatactatatctttgtttttgaaagagtttctggtctacttacccatatgacatgcatcacaactatgagttctagaaaattcagtttgggtagaccaacaactaactcatgtttggacaatttttctatcaaatgcatgctagcatgaccaagtttcctatgccacaaccatggatcatcagacatagaggataagcaaatatgtccatctattttttcaaaactatcaaggatataaacatttccatacctttttctaggaaggactattttacctgattcatcttcaatagcacatcctgttttcttaaaatttacctcctatcctgagtcccagagttgacttatgctcaagagattgtagttgaggctatcttataactctatcatgtttgagtttccagtctttaacttccttattgagtctcttaaactcattcatcatttttttgagactctttcaaagttaaatcaataatatcctgcaattcattgcatctttcacagttataagatcttacctcactggtttcacctcgtgctatgaaacagttttcattttcttcatgtgaagtgcccttatctgtccagcatcctgaggatttgttcatttcattttcaagaattgtcatgaagcggagatttgctatctcttcgtggtctgaattatcctcatcgctccagcttccaaaggatttgttcttgttgaagcctctagagatctccctttttagttctgggtactcagcttgaatatgtccaaatcttccacattcactttctatcattcttatcattttcgttgtattgcctggatcgtcttggtggaattcttcctttctttgtgttcatgtatcttctcatcaatccatcaatgtttcttgatagcatagcaatctcttcgtgcaaagcttcaggatcatcatcaatttcgtatttagctatttcagtagaggttttgaatgtgactattttcttttttcttcttgactggtcttcttgagatgcgtcttttcaaaagctaggagttctcctcgtagtttatcataggataatttgtgcaaatcttaagattccagtgtgacaactttggtctgccaagtggttggcaaactcctgagaatttttctaacttgatcaccactggtgtaaggcttgccaaatgcctttagatcgttaattattttgctaaacatggcaaacatctcttcaatagattctccttctttattgaaaagagttcgtaatcatggaccagcatgtttatatgtgtttcctttacattgttggttccttcataagtgacctcaagcttgtcccacatttctttatctgtgtcacagcttgagattttctcatattctttaccacttatagcgttatgaaacagatttctcgctttgttgttaacttgtaccatttacatatgctcttttgtatatgaatctatatcttcaggatcagcaagtggtggagtggcagctggtaagggatagtttccttttttgatgactctccaaactttgatgtcataagttttggcaaagatctccattcgcactttccaatgggagaaatgttgcccattaaagtatgatggtctaacttgtgaaattccttccagaaagagagctcctatgataacttgatttgccatgatcttttcttacaagctgttaagcaaaagtagaatgtgagcattgctctgataccaattaaaactacacgagggggagtgaattgtaaatatttaaacttaatctcttattagttgactagttaatcgagtagtcgacttgatataataaactaacagttataatgacagaaagtaagatgcagaaagtaaatgcaggaattaaagacaccaggattttatactggttcggattcaatgtgaatcctagtccagtccccttgcgttgcaagggagttctctttagtaatgtgtttctctgagtacagttgaaattaattgacaacacggtttctttagcactcatttctttttgatacaatgtctcaccagtgttatactctgttttttttctctaacttgttatacatcagatcttagtgaactacaatgtttgtttgcagcagaacaaagagagggatttttggttcgatcaaagtatatgtgactaaggtttaaggctgggtataaattttttgatgaaggtcgaggcttgacaacccaagagatttgatctttggaaagagattgattctttccaagaataagatagctagtcgttgcttttcattgatttccttctttcagcagacgtatgtaataaagactcgctccttgattgttggttcttttgaaattagttgcgtaacaatctttacaggatcttcgatcttcctggatgctggccttgattcatgacttaagtttaggcttgcttgattctctccatcgcagctggccgttactttttgctgattgatttgctgattgagttctttccttagttatccagatttgcgagttctttccttaggcatccagatttgctgattgaaatgtaacctttgctgattgatttctttccttaggcatcaagattgactccagcgatcttgtgatatcttcttgattccttgtaattgatttcctgcatatgtatattatttgcatcattaaaactggatctaacagtattagggttaaaactcatctactatataaagtgggggacgtttttattttttgggttactgttggcatgcatatcaaagtactaaagcttattctggcttatggcaaattgtctaagtattcttcaatcgctcattgacttagccgtatccgaactccatctcgagagctcggttgtggtcgattgttagtatttaagcttaatacggggcctaattacttttacatattggtttcatcgttttattctcacttcaattccattatataccgttctttaatcattttttgttaaattaaaccacttaacctttaaaccgcatataaatttaattgttatccgttttaagggtaaagagaaaaattaaaaataaaaaaatttggccattgaacttagggaaaggccaattgatgcacactcgtataatatttttgtactcattctatattggaattctccatcaatcatagggtgatataaattattaaacaagttttaaaattcagaaaaagctattggtacacccataattaggccaatccagcttgttctttaacaaactatttgcaggtgtattatcactaacacaacctgcaacacttcgataatttaatttattacctcaaccaaccgaaattagaatataaaatgctttcggatatttggtagctcatgttgtcaccaacagaatacaaacttgtttatcaaataaaatctttcctttatatatgtgcaaagattatattccagtgatcttaaataaataatctgaagttttttgaaatgaacgtgatctcgtcatacatgatatactatattaatatagttgtttactcacttttcaagaaggaaatataatattcattacatagtaatagattatcagttcacattatttatttctcttgaaattttacaataatgaatgtaaaaaagcacaatatgtgggtgcttgaaatgtaatcttcgtggaagttcctaccaacatatcaagaaaaaaaaacctgaaaatgtataagtagcagtagggtttcaaatattccattaatttagtaagtgaaagtgcaacaaattaaactagtcatccaaaacttataggggaaagaaaatgaatccagctgatgaaaccatatctttctctgaccttggtttccttgaatctatcaagcagcaccttttgattgattcaaatttttctgagaatttttcaaatgatgcattatttaatagccctagcccaagttcagctgaaaacagctttaacacctccctttgtgatgaaaactgtgaaaagtccgagttccaggaggaaagaaaggggcctaggtggcgcgtgaggaaaacgcgccgcaagattggaggcgctacataggagtgaggcggcggctatgggggacgtttgcggcagagatataagagatccgaataggagaggcgcgagactgtggctaggaacttatgagactccggaggatgcagcattagcttatgaccaagccgcttttgagatccgcggctcgaaagcacggctcaattttccgcacttaattggctcgaacatgactaagccggctagggttacagcgaggtttcgtatgcgctcaccggagccatcgtcttcagcttcttcagaaaatacgacaaggaaaatgaagatagatgtgataaactccatagctaaagtaaaatttattcgtcatagcttgattaatctacaaatgttggtataattgtgaggaagtaaggtttcttcgtgtttaacaattgcaatataaattatggaggcggtttcaggattttaattttatgggttcaaatttctaattctaccgctttcatctaattaactaggttcaaagtctattatttttgcacatttagtgaatcttttaaaacatatacatagtctatgccaaaatttagggaggttcaaaaccaaaccttaaccaaaaattgaaccacaaaattggcttaatgtcttatttgtatcgggttatcatattaactgttggtgagtggattgaaattttataattaacgatttattggttttgaggcgaattattcaattttcttaacggataaaccgttaacccgttaagaatttttatatttgtattttttacccttatgtatattaaatatccttccactatttaacaaacactacaagaaatatgtgatacggcgacatttaattagtgacaattaagataaatgtccgaaaaaagttaatttagtgacatttgttagaaaatgtgataagaataccgacatttgttgaaaacatgtcaaaaatattttgacatttgatttaaatgtcatattattaggaatataacaacatttaattagtaacatttataacaaatgttaaaaataattttttcgcccaacaagaaaaaataactttaagcactttatgggcctttaaacttctcttctttttacagaaatacaagaaagttaaaaataacattcaacccgattcctccacaactcttcaagccgcaaccatctccgtatctttcactcattttgatccaaatccgccggtaagatttttcttcatataagtgctataaatcacaatcttctgtattatatttcttgtctgcttttgactgtttgttgatagccctaaatttgccgtctatagtcttgagatttcttttgattgaaccttttgattcgtttcagacctagaagggccgcctgccagaattaaatttcagcaattatcgctctcagaatctggagttgcaatcagattcatccactctaactcgtgttctgtacgtttggacttttctttttgagtgaaatgagatttgtgatattttggtttctgaaattcttgaacttttttctttcttgttgtttatttttgttttctttttgaaggtgaatttcctgcaaaagagtctagtaacgttgatattactccatatgaggttaaaatgtaattttgctacttaccttttcccttaatcactttggtgataattttttttaaaaaaattcagatcttggatacatcagattttgaaggttgtgagatcaattaatgtgaaggaatcctgatttggtgaaagtatatggaacacttcatcaagaaaaatacatggatgctgaagctttgaattatgttggtgtatttgaaaattataagagaaaagttatggttatgtggtcatgtgttgaagtcattcattacgttgtttgaatcgtatatggtgtacaactcttgaaacttttgaaaggaataaaaatatttgtagtattgtaggatcagcaatagttgattcattgttttctacattcttaccacatattctacataatacttaaaggaacaaaaagagaatatttttctttttaatcataatataaataatgattttgatattcaaataatatgtcaaaaattgtaaacgatttatctgacatttctatgtatgtcgcaaacaagatagtttaagagctcaaattgttgacatttgataaacatcaaataaatgtcactagatttttaccgacactaatttaaatgtcgtaaaattaacgatatttaagtttccgatatttgaaataagtgtaaaataaaggtcggtaaatgaatttacgacatctaattgacttatgacgacatttatataatgtcgccgtatcccatgtttcttgcagtgaaagtagcagttatgattcgagttcagaaggtttactaagacactaactgttattgttttatcttagatactaacttagtgctattagattattgaaaattcactctcaaattctagtgacttctgtcggttagtgaaaatgcacttgcatgtgactatatggtttgatgcaatagcagaaaggaaagagccatactcaacactgatttagtatatggctattacataaattttcagttagtgattaatggtttgaatattcgggcatgacagtgtcatataaacaggttgaattcaacatttaaatttagtgatttaatgttaagtggtatatgcactcatgtctatttgatttagccgataaatcgctcgataatcgctaaactgatattaatccgcccgatatcttatcgatttggctagcgaattagtacatttacgagccgataaccgataagtcgaaccgttaagtataataatatgtctgaccagcacgataagcagccctaccaaaatctaatgaacccatagattatacattggataccaggcaatattctcatgaaagaaaaagaagaagaaaaaaaaagctgctggacgacgacttgtaaatgtactttctcttacgtgacctttcttttaacgagattaattagttgacagataaatcacttccataaatgtcgtttgttcttctgcttcccttgttcatataaagccttaacacttggaggggaaagatgaatgttttgtattagaaaagcattgatcattgtgctggtgtttagtttggtaaaaaaaaaaaacatgtaacaaatgataatcttacaaggagtagtatatggtataaggatcgtgcttcaataatattttgaatattaaagatcgagaagaatgtatagatgttgattgagctaagtgaaatgaattttttttattttaaaaatgaaaatagagggaaaatttccacacccatcaatgatgatccctttaggtgaaacaattaaaaaagatttcatcaacaacaacattttataaaatatttactcttatcaaacacaaataagtccctccgtcctattttgtaggcatattcccttactagttcgttcctaaaaaattaatatattatcttaatgataaattttatagttaatcacacaaatattgctgtgtcatgtttaagccaaaaagtttgtcttatatcaacaagtaatactctgacatgtttataattacaagttttaaaaaaaaattatttttaaatttcatgtgaggtctaacaatgcaaaacaaattataatagagggaatatattatttctcatttactatattttttttttcctccctcttcatatccatcgagagcttcccacatgctagacaccaaaaatctataagattctttccacattgtcataaagaaaatcattaatttaatttgttgatgtcacacctccttttttcgcccccgcgagagacgtaggagttttttccaattaaaggacaatcgaaacgggatttgtttatttatttcagagtcgccacttgggagatttagggtgtcccaagtcaccaattttaatcccgaatcaaggaaaagaatgactccatattacagtctgcgtaccagaaatctggataaggaattctgttaacccgggagaaggtgttaggcattcccgagttccgtggttctagcacggtcgctcaactgtcatatttggcttgattatctgatttaatacatgttgaacctatgtgcaaaatttaacttttaaccgcttttatcatttactgttatttttatcaaggaattgcaacgttttgaaaatgtatctcaaaccgcgtcacaatcaatgtactcgtggtcgttgacacactttgactccgttgagatttggatttgggtcacataaatgtgcacccgagtttaagaaggtaagatttattaaggcgcgccctaaagagactaacgtattgttatattaggaagaggccgtgaaggttcattaaacggccaaatccaaagtctagtcaatggttatgtatttattgagggccccagcgatgtgtgatttatttggcgaggctcgtctcatttttattttttaaggataaacctacagtgactacatttcttctattaagtttgtctctaaaataaaagaaaatccctcaattaattacgagtttttattttatttatttaagaaagcatgacatactagttgctagattaatacaaatattgatgaaaaggaattttactcaaaaaattcgaaattataaataaaataaaaattcgacaactaatattcaaaagaatcaaatacagctagattaaaactcagcattgttataaaaaaaactattgagattaattattcacaaccatttgaaactagatttaaccataattactaaagcttattagaaagtttattagacttaaacattcttctaatcttgcctggactcaaatcatgccttaatgcctaatttacgaaatttaatttaaattcatgccttagctaaatttagctacttgttcatgattaacctactgttgataatcttgaaaccttcataactagtgaattaacccattttgccaaaccgattcattaaagactaacttatgttattttttcttattccaattattatttagtaatacatgaaatagcttaaatacaatcaataaaaggaacaaaaaaatgaatttaaaacttcaaaatttcattcttcatatgtattcatgcttctacattattagcttgcaatagctagtattacagtcgtgtacctggtattggaaacaaaagaagatgaagatgagaatcagcagcagtaataacaatacagcacagcaacaacaacccagcaacagtaacaacccaggaacagagtttgcaaaccggtggagtagtaatccaaaaaaaaaagcttcaagcttcggtgaaacaacaacaattaatgttgatttcaaacaatggaagaaagtagaagattttttttccagtttttgttctctcctttagttttgaaatttctccaatttttatctcttctgtattctgtcccctcttcttgtgtattctctgttctctcttttctttttctgttttcccgataatcttcttttctttttcccccactctatgtatatataataaccaaacagatccgccctcctttgaaaaatttcacttacccgaccaaaatctcaaaaaatctgcccattttcaacaaaatcctactaaggaatgtttttccttattttattccctaaattaaggcatgatataagggtctgtcctccactaacattaaactaatatataagcttttgtcttattagtgcttgacttacggaccattaatttagtcaattctgcccattttccattcccaaaataccccttttaatcccactacctaatgttttgtcccccattatattaaataaatgtatcaatcccaacccattacctcttgtcccccatgcctaacataaacaattatatcacccacgccccattacattttgtcccccatgcttaacataaagaattattcaaaatgttcaattaccaaactacccctccaaccttattgcaattaccatctaccccatcagctataaccaattcacctaatcaatctcaaccaaaatataaccaatatgaccaatttctaaacaaattcaacaacaaatcatatgaacatagatgaatcatttaacttccaattaatggaaataaattaaccatattggtaaccaatcctggttaacttagaccaaaaatggatgagcaaggaaacaacaatattaacaacacacacatgattcaaactaaatcaacaaatcaaaaaccaaaacaaactcaaattaaattactggatgaacttcaaacaaagaataagcatgcattaaatccatattaaataacaaacatgacggattcaaatgattaaaccaacatatttccctattacaactaaattcttttagaaaaataaaaacaaaaccgaagaagaaacaattatgaaattaaacttgaatctaacaacattaacaatttctgaaaaatacataaaacacatgaaacaaattgaaaaaataattaattaaatttcaatttgaatctaataaacattaaactaacaattcctttttacaaaaataaataaaattaacatgaaataaacatgaaaaacaattaattaaatttccatttgaatctgaaaattaaatcaacaaaacacatgaacaaactaaaaaattaattcaacgataaacatgaacaaaacaagaatcaaacatttatcgattttagatccgagaatatcaaaacaaaaatacgggcaaaatgaaactcaaacctactaaccggatcgaagcgacgatgaagaagaacggaaacagaaaactcgaatcaagactcccaacctcccaacggatcccaaattcaaagaaaatccaccttctcttttagacttgacgaacttcaactggacctcactaaacgacgaacaacaacggactcaaacaaaccaatcgaaaccttgacagaacttcgtcggattttaaccggactgctttgcttttcctccgtgtgcgtgcgatggggagcagcagctatggtgagcagcagcagcacttagctgcgactgaagctgcaccaaactttaaccgaagcagcagcagctatagtgagctgcatgaagctgcgactggagaggaagaagcagcagcgatggtggacgcaatggttattgttgagctggagcttgacgaactgagctcgagctggggttgtcgctgcttgctcgttcatggctgctcggagatggagatgctgatcgtttggacgcgaggcgttggcttctgccgggtagtttctcgaaccaactgctcgaccatgctggatgcagcaggagcagcagaagccgcttggctttggagcaaaggcgacgaagcagtggtcgttcatgttattgggtttggatggagaagatgaagcagcaggggcagcggtaggactggttgtcgtttgcgacgtgaggttgagggcagccatggacgagcctgagctcgccatggagaagatgaagacgcagcagtggcagcggctggatgcgaggaggaggaaggaggggtcgttcatggcttgggttgtcgaagctagagcttggaggggttgtttggttttaatggcggactgggggtcgacttgggtgtgaaggagaagacgatggaggctcgggcagccattggagaggcttagagttttggatatggtgaagaagaagagaggggatgggggcggatagtctaggttttttagggtttgggttttgttttgttttatgttggaaaaaatgaaaaatgaagaggggttgggtattggggttatggggcggaccgggtcgacccgtatggagatggaccgggttatggggaaggttgggcaattatttgggcttgtggtttgaaatttgaagaagaggcccaattccgattttctttatatctttgctctcttttctttttttatttttctaaaactaaattataaaaatacttaaattattattaagaactaaattaagttataaaagcgcaaattaactcccaataacaattaacgcgcaattaagtaataattaagcataaaattgtatatttggacattaaatggtaaaaatgcaaaagatgcctatttttgtaatttttattttttgtaaaacaaacttaattactaacaattgtagaattaaatcctacaagcaaaatgcgacatatatttgtattttttattaatttagcaaataaacatgcacaaacaaatacaaataattatccaaaaatgtcacaaaaattcccaaaattgcacaccaaggaaaatcattttattttgaattttttgggagtaattctttcatagggcaaaaatcacgtgcttacagttgatatttcatttcccaaaaaacatagaaagagaagaatccaaagtaaaaatgtagtagagcaatatttacctttgtttacccttaaaataaataacacaattaaatatattgtgatttaaaggatatgtgatttaatttaacaggaatgaactaagagcaacaaataataaaattaaaagaaaacaatgcgatcaaacctaatgtgatgaaacaattaagctggttttaagtttggatgctgaaaccagtctcgaatgagtcctctagatgggctcacttgaaactaaagaaatgaataactgaagaacactttgaacaataactagataagaacctttcaatctcgtacaagtctaaataaggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatccaagaacctgaaaccctaaaaattttccaatcttggaatttttccgattcgagtgaaggattgaggtccaagatactttaatcgaggtattctcaactgagacttcgaataaagtctgttcagcctcaaaaatgtctgaattcaagttgagtctgtgtctgaataaatttgaagattcagaggtattttttctatttcttttgtgtattctacgtgtattttatgtttgtttcattagtctgtgtaattttcccatcttttattgttatactgtctcatactcgtctatatgatcaaaatatgaaactgtttctgttggttgtgattatttacaatgtgagtaatcgactcgattaagttcgtcgattagttatattatgaattctcatttatgataatactgattgaaacaatctgtttctatttttatggactgtttgttgacagatgttatagataatcatttttaattaatactcgtcagttaaatcatcctagtttatatgaatctgtcaaaataagtactgtatatatgttattgtctgaacattaagtttcagattgccaatgctcctgtgtttgtttgattttagttcaaagttgaagttcagtataatttgttatgttgaaattcagtataatgttgttgagatgttaggtaaattcaatttcacaattgttgggtagatacaactgtgttaggaacttaagagaattggtattagctgttttaaatcaggttgataattaggtttgaatagatttttaaatctgtttcataatagattctgatcttgtattaatgggtagtaataacagtaggatttcagggcatttctgggaatgaaacagtaaaaaatagtattagtgctagtgtgctggaagtggagtgttaggggctgttaatctaataggataataggaaaccaaaggaagtggaggggctgaaaataaagtaaaggtatccttagtgctgtttgaataagaaaaagcagttcagtggcagattttaagggaaaatctgccttagataacaaaaagggggtccaggcagcacttaaaaagaaagggacagacctgtataaatacaggaagcaaacagatttttaagatcagattttagagagagagtttgaaaagaaagacaagttgagatctaatttttgaaggcattagagagaaatctgaaaatagagagagatacattgagaaaaatcagaaatagaaatttgaaaaaagaggaagagaacagaaaagaaacagaaaaaatgagaatacacacctatacgcacaatctgaaacagatatagaaacagaaaagaaaatcagaaacatacttttctttggatctgtccgggtctgtttgtttgatattacttggattaaatctgaaagttttcccaaaaatcctgttactgtgcatctgggctcctcggatcctattattattcaaatctgctgaacgctgatatattctgctgactttgttgttgctattactgctgaaatttactccttctacctccatttccaggtacataccttttaaactcatgttgtgaaaagcttcaacacggcaaataaatgaagttttggagttataattctgctttctactcatctaagtcctgtagtttaaatttcaattttatttcgtgttggttaactagtagtgaattcaatacgatggctataagttaattgtcttgttttgaaattcgtataaaagtttgtaataatgttgtccatttcgaaatctcattagtatagttatatttgaattgtcaaaatagagaacatggcagaaagttagccattatttaaactttatggtattgttagttaggtatagcataatatggaaatatcaaggaaaaatacgttatcagtttattttattagttaagttagttgttgtttaaagctagatgatattggttgcaatttactctatattttggcataacaatggttatgtttataatcaatagttgaaagatgcattagtaaaatccgctatgttcacaatgtcaaaatatggcaaataatgttgtatgcaatatcattttattaagttaacaggtagacttgttctctttcttaataacaaatggcttaggaatttatacaatgcgaaagttggtgtttagcaataattcacatagattgagaacaaaaaattggtttgattaagtatatcttgaattcaatcaatagcaatcaatcaaaataattaggcctattagattaggaacaagcaatgtggaaagagattagatttataatgtgtaacaagtttaagactgtaaaaataacatttgttgcaaataaaataacgagaattcttcgaaaatatcatttcctttcaagaaatgaattttttaagattcatgagctattcaccttttgagtatacatatgttgtatttaaaaaaaatagtgttaatcatatgtttattcctttctttggatttgaatagcttggaggaatataattcatacgcgaaaaaaaatataattcgcaataaacatttaataaattgtgaattcttttcaagattttaagggtaccttaaatggagatttatcatgatttttacataaaatgtatagatataataaacaatttgtggaaaatccataataccattacaaatattttgcgcgattagggatgcgttcgcgtaacctgattatatttttaaaagcaaaattcggattatgcgttcgcgcaatttcgatcaaacatttaataaaagggatttatccaaggatgttaaaataatttcatatgacccgaaatgtgcagatcactgtttaatcatacaagggcgacggtgtttttaatgttatttctaacttcgaacatatgatttttttaataaaaatataaaaaatattatcaactttttgtgtacacgtatgcgtgacacgattctctgcaattataaaaggtatataatacgaatatacgtacgcgtaattcgtttatataattgtaaacaataaataaaatcggtaacaaaatcatgcaataaaaatgtatttagtaaaatcacgacaattaagccaagaataaaaacagttgagcgaccgtgctagaaccacggaattcggaaatggctaacaccttcttctggattaacagaattccttactcaggatttctggttcgtagaataataaacagagtcatattctcctcgattcagggattaaaactggtgacttgggacgccttaaaattcccaggtggagactctgaaacaaataaacaaatcccgtttcgactgtccttcaattggagaaaactccccaagcgccccgcgggcgcggaaaaaggaggtgcgacaaatattactagagaacatgcctataggatctaaactgccattttaaaagaaaaattgtttgctgtttcattgcattcttaatcaataatagatatcatgcttctaggatatccctattaagcatctaggaaagcctgtagggtgactaaaaccctgtaaactataaaattgcaccttgttatttgagactgctcatattcaacaagtttaaaagaatcagtacgcaagtaggattcagttctttgacactttggtcctaatttaatactgtatgctctctgctcacctagatatcatgttataaggttttctcttaaatacctaaaactgttgtttgagacgtgcacttacttgttatgtttgtggaggtaaatgtgagcctttaattgttccctctttaagtgcagtcctaattgttttgattgacgcttagacttttctcctttaaataccttaagatggtctagaaccacctaaattagaggtcctaaatacctccagggccacaaggaaggcactggtagtgcaagcatatgatatctttcaaggttgctagaacgcgttaggctatgactaaggggagggaattaggtagtaaggatatgatgactatgcgctaatgtcacgtgtatcccctcattgaggagtgattaccgggcattgtgtgagtatgatcatgtaggctaaccaacctagggcccctctttcccaactcccgttgtttaaataaatttacttttctttataaatatgcaacttgttcaagccttttctcttgtttcattacttgaatcatacatgtgcttagaatgtcaaaacatgtttttacttgcaagtacgtgttaaaactgtttatttgttaaaatgactaattcacatagtttatgttcggtcgggacccaccgttgtggaccgcgagtggtgcctaacaccttcccctcaaggttatttagagccattaccctaaatctctggtaatgcaaaatagtccatgaattacttgctcaaggtgtcctaacgcaccaaaatccgttaggtggcgaatcttcgaatacccaatccccaaaaggaaacgagttatttcccccatgaatgtcgaaacccgactttcccatcaaaaaggggaaaaagggggcgcgacaacatggcgactctactggggatattttaggcttttaccataacgaacttatcttttgtgaattagtccaagcatgctctatcccacgtaccatttccccttatttgagtttaactgtctattttcaagcatttatgattcttttattcctgaaactgacttgtctctttgttttgttttctgtaactatcttttaattatttaaataccgcatttatcattttcttacatgcaaatacttgacaacgtgatatttattgctgcaaaaatcatgctcaacatcatattccactcgtgcgtaattaatcctatagcaacgcttgattattgtttgcactcttcctatatatcaccctttaaattcagaaagacatatttgcggtaaaactagtcgatcagtggtgcgtttcactatttcatgcctttccccctcaagttgtccacttgagggtcctagtctagacatctatagtaaccttactctgattaaattgaatatgcatcatggtcaaacctagtctggttaatatgttgtccgcataataactctttaagacaagcctcgtccaaaaatccatcgggttttccataatcccaatggatgtaaccacgattatatgcattaatttggagaaataaatgccaatatgctaatcattactgtataaatagatgaatctggaggaggaaagggcctaactctctttattttgcagaaaatgaggcacgagtccccagattcggtatagttagaacaccctcacttttgctagattggtggagaaaccttcctttatgtgaccaaaaccatgtgaaacgagtcttaggaaacttaccttctctaatggatatccaactcaacaaaatgctgatcgaggatgcaacaatgttttgggacaaggaaagggcagtgttccattttgggatagtcctaatctattgtcacctgaaaatcgcctgctagggaatttctgaaaatggtggggctgaagaagaatgacaacttgaaatgcctaaggactcctacataccttttgagttcctttatgaaagataagatcatagtagtttctaccgtatttttgatgatgagttctcaatcacttatttaggttggattcatcgtagggtcttcgtattcattatgtgttttttgggcatgctggtattcccaatccaaggggataggatccatactaggatggccatggtaaccaaaactctaatggacaggatcgagggggagacatacattatcgtccctatgattgttgcagacatataccgggctttagagcgatgtcagaaagggttcaggttcttcgagggttgcaacttactgctacaagtctggttgttggaacatctccaaaagggataataccgtcaagaatttccgcaaaggtcgtggaatgatcacatagccttctatcatcccaaaaggatgaattatattccagacatgtttgctcagccagaggacgctgcaggatgggtttagctttttgaaaatttgactgaggatcaagtccagtagatgtttgagtggttccctaccgatgaattcatcattagatccagagattttccgcacttggtgttgatcgggttgaggggcatatacccttacgctcctctcagggttataagacaagcaggcaggagacaaatcataccacgggttgccaaaatatgtcactttagagccaatttccaaagtaacgccatcccgtataagaatgaagtgtaacacatgtggaccttaaagattattgtggagaaggatattatcgagccagacagatatcacacgggccactcatacctttacccttcgtggttggaggacaacacaactagggtcattgagccaagggctgggctaggaaacaaggttatggacgaggttgctaaagcagaggtgaggtacaacaagctacggaaaagagttagagagtctgaagccaagcatatggcactgcacaaggttgatatggagatgattaacgagtggaaagaaagatttgttaaattcagcgagaggctggaatacctggagtacagtttaatggagttggaagggaagatgagaaaaagggtcactgactgccagaacgtgaaggaaatgaaggagggcatcttgcaagagcaatcctgctgcttgtcgatgccccctttttgctaaccgtggggtcagaaatcgggtatacgacattgggaggacaactctattccctttagagaattgggtttagaagttaaagagtctccacctaatgattatagtgcattaggacactttaagaagggtttgagatgaagagaccagagattagggtaagggctagaaattatcccgaggggaaggtgttaggcacccctcaagatctactagtgtggtcccggctatgttacaattgttactttacaagtaaacaatcaaggctcaaataaggattcgcatataacattgcaatcatgttgaaaactttcgaaggtaagtagagagggcataaatttatgaaaaagaaaaaaaatatttgagtagttttacaagaagagatgaaagcaaataaagggaggggggtcctaagtttataattaatatggatcacttcaatgcaatacccagaaatcactcctcagaagaggggtcgcacgtgatattagcgcatctgtcaacatatccatatctacccttcccaccccattaaggtgttaaagcgcaaaatggtatcattacttattgcatgccattactcgtcccaatcctatcagtcccggaggcatatgggactcctaatcctaagggggagggagttggggcttttgcggagttttcaaaaggataaaatctaggtgacaaacaataacaaatagcaattaaaagggaaacaaatagcagttaaggctcaagtcagcctcctcattcaaagcagcagattatctagcatgacttacaaatattggtttggtctgtattaaacttaacgtaggaagggtggctaatttatcacatattctttcaaataagaagtctgaatgaggcctgctcactggttgtaattatcaaaactgatacaagtataaaattttaccctaaggcttgcctaggcattaaacagaacctataggcatgatatctattagtttcataaataaagaagtaaactgattgcaaaaaaaagaattgtcaattacagggacataagatctgcggcgttaaacattattgctactgattttaggcttataagcgagttgacaattcaggttcagttaacagctcctatagacatgctttctaggtgttactgatttgagcactgttattgtttatgcaggaatcccataggcaggttgtctacatgcaattgattaggtatttaaatcctataataggttttcctaatgacggatgcagaatgcagaaagttctataggcatggtgtctatatgaagaagcagaattttaaaattggcttacaggcatggcatctgttatgaaatcgtagaaaaccctatagacatagtatctatatgagaatgcagaaaatccgataaatatggtatctatatgagaatgcagagtttcaatgacttataaaatgcagaactttagaaaaaatattaatccctatgaacatggtatctacgtgagtgcataatttcagaagtatagtaattccctatgagcatggtaactaccccttgcatgcatagtcccctacctttttccactagccgaccccaaatgtttattacaagattattacagacccgaatgaattagaaaagaaagtaaaattacatcaaaagttccagctacatctaaacagcctaattcagattcaaagtccaacaatatgagataaactaacttccaagatcagattaccaaaagattttctcatatttggggtgtgtcaaagttcccaagagtctcaaagggactccaggcagtgcttacaccccaaaatattgcagaattaagaacatggtgcagtgtggaaatgccatccctcagatgtccaagtttagagggaactcaaggtcccaaagcaaggctcataagaggggggcagaacttaaaattctaagaataagtgtaagtgcataggggttagagagtgacaaggcaggctagtggttatgcccaaccatatgctaggctggcacacccctggccagcctgtcggccaatcaattatgagtaaagacctattgaaggtcagactagggcctggacagtgattaggacactatcagacaaaagtctcaaactcggcatacatgtaaaggggaatgtggatgggaattgaaagagtttaggactcaagagtgtccagttcatgtccatggacaataatatcaagtattgccatgtttctgaaccataactcaaccaaatagtggggcttagggtttgggattcatataagagcaggaacgatgaaataaacaaacttgcagaaaatcacagcatgaaaacagaaagagataaactatataataaacacataaggggaagagacatgacttgaacataagaacataccagttgcagaaaagtaagcaccgaaaaagcaggattctttcaagcaaatccataatcagagaagaacactttatgcttgtgagttcagagaactcgagctcttatgaaaattctaagtgtatttgagagtgagaagtgatcagaattgatcgcgtcaaattgattctctaaagtgcagaagggcagccccctcttatagtgtagagaagcaagcaagaatggtaagaaaaccttttaaaaatcagtctcaaatattctccctttagccaagggatttaatttcagacggaaaaatgtaaacaaggaaagcaaatttgagtaaaatctttcatagtagcctaagaagggaaaatacatgaagtatatttaaggaaaggtcttaatagtacttgatttgtaaagagaaaggaaagggaatcaatcagaccgttaacaaaatcaaagtaaacaggtttgattcgaatgaacccagtcaggaatagggagagaagggctcaaacaaaaggaaattaagggcaatcaatcaagaccctatcaaaggggtccaaaatcaatcaagcaatcgtcaaaaatcttgaaagaggggtttctcacatataaagcaaacaattcaaacagaatagtctagcattgaagggtttaggatcacaaacaaaagaatatgagttcagtcatagattcatgatgagtttgaaagttcagggttccaaagtggaaccctaatccaatttatcgaagaaacccccaaaatcttgggtttcaaattgaatcaaacacagaaacgagaaggcaagtgaacagactcaaggagtctcatgaggaacaaacagaccacgatagcaggtttgaaacaataagagaaagaaaatcgatttgagagcataaaaggacacgttttggaaacccggagctcaacaagtccagaatagatgaaacatgcttaacaagaacacaaacagagttcagaaaagcaaaagtcaagaagctcggtagtagatacacatggtagaagaatgaggaaagtttaacaccaattaatcatgtgagcacgcatataaaagaaaggaaaaaaagacaatacatgcgtaatagagaaggaaaacatacgagcataagacagacgaacatctaaaagaaaagaacaacaagaatcaaaagaccttaagaaaccctaatttgaaatcgaacgatttttaagaaggaaatttggggaaaacactcaaatcgtcaagaaaagcacagacatagcacagatctaaaaaaataacgatgaaagaacctcgattagcttagggtttcagagaaaccctagaagttagaaaggcttggaagaacatgatcagatcctgagccgaaacggtcaggaatagagcttctagcgcttgaatatgctgaagcatggccggaaaaccatagatctacggatctgagggaggaccattgaggtcaagcctccagacttcgtgcaactcaggcttgggcgtgagagagggtgagtaaaggccatctatggtaggagatgccatggattctggtgggaatgaggtgagataaagtgggaggtgattagggtttcggagaggttcaagaggatttgagggagacgaagagagttagaggtggagtctctatacaaatgaagtagggttaggggtgttaggtgattaaaaaaggaaagcctaaactacagccgttgatcaaaacgatcaacggctaggatttaaagaaaatcggacgggtttaaaaattggtctaaggggtcgggtcgaaatgggaatagggtcgtttaatttggggtggaattgggccaattgagcctacaattgaaagggagaaaggatgttattgaaatagaaataggctaagtgttaaatagccaatttttcttttttattttataaaaatagttataataatttaaaaagtaaattaaaaatactgagcaaaaaatactatataaatatcaatttaaaaatattggaaccagttttataattataaaatgctattaatcataaaataggccataattgtaattacatgtaattagcttaaaaatgccaaataaatttgtaaaaaatatgcaaaaatcaccttaattatattttggtgtaaatacgggaatgaaataagttattcaccaaaaatgataattttgagaatacttattggattttgtggtattaaaataggtagtaaatcggtttaaaaatcattagaaaatactataactcttgggtgtgcttatatatgcacatacatgctattttggaagtattttgggtacaaaaatacatagggaaaattgggtgtgagcacgtgatttttgtttacaggacaattactccaaaagaaatcaaaaaaataataacaaatggccttgctgtacaatttttggaatttacgtggcattttgttagctatttgtggttttgtccgtgtttatttagtcttatcaaacaaaaatacaaaaatatatgtcgtgtgtaagtttaggatatcattctactattaggaattaattcaccattatttggttttaaaaggcgaagatcccaagatatgtatttctgttctatttcttgtcgtcgtagtgattttattaaatgctttaattcgtgtgataaccgtttttaaatgttgattaatatttgggtagtttaattttggttttaggaatttttggtttaaattataagaaggaaatattggatttgggccaaaaatctaaagaaaatcaggcccaaatcaatacaaatgacccagtccaagccaggtcctttagagatgtccaaacgacgccgtatagggccttccaatcggaaccgttcatcccctccaatccaacggctcccaagccttccccagatactcgacccactgaaacccggtttgatctgttcccagcatgagaccaaacgacgctgttcccccagtggaatgatcaaggccgttgatcattggtgatccaatggctaatatcaaaccattcactccgtatataagcttacctccttcaccccgcaccccccgagccagaccccccctcctcactattcttccgtctctctcatttcagagacggacctgggtttagaaccctagccgccttagccccccttcgtttgaaacccggtggcatcaactccgtcggccaccagactaacaccctaggaccactcaaccaccctgaatccaaatccacaaaccattcagttcgaatcttcccccaccgtctcgaatcttcgtttgaagattcgagcccagacctcgacccatgccaaacccccccaaattcataccaggtatccccttgaccttcctcgtgaccaaaccaatcttggtttggtctgaatctacccacaaatcccaaaatcccaaatctgaagattcgaaccctagaacacaagaatttgaggagtctgtttagatttaaacggaagtttggggtctaatagaccctaaacgaagcgttctcggtcgagaacacctcgattaagatctgttcgacctcaaatgggcaaatcaagctcgggcctgggtcatctgtgtttaagcttttctgatttgttcacttttcccttttgttgtctattttagtttagattagtttttcggcatgtttatttagtttgtttgtttattttgggatttctgttgtcaattgttctccatctccataagaccttttatttggtcgattgtttattctgttatattgaatccgtatggtggtatacatatttcaattggattgatatcgtcgaatcaataatgcctgtagtttccctgtgtcgtgcaaattatcgagaacagtttgatgccctatttgttttatttgtttaatagaccaattattccacgttataattagtatagttgattagataaacgacgtcgattagtttcataggactgaatgttcaaatgccctgattctgataagcttcatatgattgatcaaaccattgtcgtttaactgattgtttgaaactatctgtgaatggtttgttggctgcagtacaaaggttggaactcagttaggatagttgtgaatttgaactcccattagtttggattttcagtttgatgaacttagggtaatacggttaataatcagtggattcagggttagtctaaggttgtaaaagctttgaaaagcttaaaggcaagtgggctgacagtaaagtattaaaacattgattcaactaatggaattaattgaccaatagtgggattaatgacatattgagtacctttaatggctggaaaccagtaacaacatgtgttttgtcagaagttagggaattagagtagaaatggacagcatgtgctgtcaggacatgcccacactgcccatatttgcttaattaaataaagacaggccactttagcagtaaagaaagggtctgtcaggggaatctcatgggaagggtttttattttaatccttgagtggaaaaacaggaggagatgggaggggattcagttgttttaacaggctgttgaatgggctgatgctaggctataaatagaggaggtttccattagttaaaaacggttcagagagggagagttctaaaaaaaatcagaaagtatagttctgaaaataggaaggcagaatagttctgaaaaatcaaaaaagataaagagtgctgaaatcataaagagagcaagagtttttaaaaaccaaaaagaagaattttccagggcctgagtgtgttaaaagtgtaggtttcacaacaaagaacttcagttttgtcttctgctcagaaattcaaaatcagaaactactgttttattgtctctgcttgcaatcttagcaatcttcttgtactgttgggatttatcgggcagcctagttgtctgttgatttttaagcactacttttcaagctactggtttcttctttgggttctattctttcctggagattcctgctgctgttgttattggttttactagtcctgctgtactgctgctttgtgtatgctactactgctctactgacttttctgcctcttcaattgtaagcactttccaggtacacatttgaatctcatactgatgtaacagttaaaaacatgaaatgaaagatgcaaagaagtttttatcagtcgatgctttacttacagctttataaatgttgttaaaattgtgtaattctttagtttgtagctcaatagagaacacattagtgagctcgtacttaattgaaatttagttggtctaaaactgcgatatgtggtttgtttagtagaatacatgatgtagctatataattcatggaatgtgcaatcacttagtataattgttaatttgaactccttctccagttatgttttgaatatgtagggcaggtggcttttaaccttgccaaatgtaatacagttttaatcttttgagtttcaactttattggatcccgcttaggtagttaataggacacgttccgaataccattagtagcgtcttctaataagtaattccattaatcttgtttaaatgggttagtttaaattcagcttgagaagcgtttggagtgagtttagcatttaatcaatcttgcatgcaattccctttaccaaattaaaagcatgttcacccatggaataaggcacgaaacaattcccgcctcataaacaattaatcagataattaacaagaatccggagttggccaagcatgcaatttaattagaatgtattttctttcttccatttattagagacgaacataataaagatgtagtcattgtaggtttacccgtttcataaaatgagacgagcctcgccaaatgagatgcacaaactgcggggccctcataaatgtatatattgaatacttacaatctgggatgggtcatttagcgaatttcatgaccctccccaaaaataataacgttatagtctctttaggtgcgttttaataatattacttttcttaaattcgggtgcgcatttatgtgacccaaattcaaatctcaacggagtcgaaatgtgtaaacaactacgggtgcattgattgtgacgtggtttgagatacattttcacgacgttgtaattttataaaaataaatgataataataaaagcggtttaaatttaataaaagcacataagtcataacatgtatttaaatcagatatttagccattataacaatttaagcgaccgtgctagaaccacgggattcgagggtgcctaacaccttccctcgggtcaacagaattccttacttagaatttctggttcgcagacttcatttggaaagtcgaatattttcctcgatttgggattcaagataaaccggtgacttgggacaccaaaagccaaacctttaccaagtgacgactctgaaataaataaataatcccatttcaaatattgtcacttaaattggaaaaactcccctcgcgcatttaaccctccagggcgggcgcgcaaaaaggaggtgtgacagctctggcgactctgctggggaactataacccagaacctttggttcagggttcaagaattcaagcttagaataattgttatatttggctttattatctaatctttattacatgttttgacataacgtgctaaatgttgtcttttactgctttgatattatctgaactgtatataaactgtgccgaaacccttctctcctcacctccggggatgtgcttactggttgagactccctattctgttagtgtcataccctgaaataaaaaagaggctcggacaagttacgaagccggatggccttttggttcccgataagttgccccctcctcgactcgagttgtccactcgggtacacagtctagaacatatacccaggttataaacctagtataatgaaacctcatgccggatccctagtaggaacgtttacttgcatcatgttacatttgacataggggactcaacacaggggttgggtccgtctaggacaggcaacctaaaatgaaaagaccatcttgctgcatcccgtttgttttgcgcatttttttgcttcagatctgcatgttgaccgacttctaaaaaaaatttaaaaaaagggggaaagaaaaatagcagcgtaggggagataattacctatttttggaaaataaaaccaatgtccaagtagtgtcgaaacctcgccggaattttctaaaaaatgaaaacaaaaatttgtcttttagttgatttattcctttaatcactttcaaaatccaaaaaaatatatatttatttaaaaaggggaaaaattcaaaaaaaaatgttgtttctgttgtagtgtctcttttataattcagactaatagtccaaatgcatccctaaaaaagattttctttagtctttatctcttttcaaaaaaaaaaaaaaatccagaaaatatttttttttctttctaaaaaagagtgtattcaggaggggtttagtttatttactctacacttgatccagcccgaactacgccggtttgattctcacagggtgtgagatacgtaggcaaccctcatcgggtccaactttccctttttcaaaaatagccaaacagtcagaattttaatttatgagtcaggtgacgctgttttgtcaagaatagccaaatgttcccgaaagggacgccggaaggctgactttgcacaaagagccattttggtcattttttttaattttgaccaagtggcccaatggccttaggatcctcgtccccgaggatctgcgaggccatgttcccaatatcgggtcaccattctaaaaaaaaatataaaaaaaatacaaaaaaatcaagtgatgctttcgttgtaaaaaaaagccgaatgttcccgaaagagacggcggaaagctgacattgcataaacggtcatctttggtcatcgttttttttcgaccggttgatcctcgcagccttaaaatcttcgttcccgaagtgctaaaaggccgcattcgaaaaccgagtccatcattttacaaaaaagaaaacatagatagttttattttttgagtctaatgaaagtttttcgttggcataatcaccttaataaatgtgcaggatgagcacgatacaaaacaaacccttttcaataattaccaagatcccttttaagttgcgattatggtggaatgacttaggcaaaaaggggcaagacaaagtaaagaagtatctgaaagatctcccggatttactagacattcagcctcggggtgatattatcagatcattggtcacttgctgggattcagcacacaatgtatttcatttctcggactttgagctcaccccgacattggaagaaatagcgggatacatcggaattgatgaagccccgttaaggttcaagtacttgattgcaccttgggccgtcacggtacaccggtttctggatttcctaaaaataccccgaacatttcaccatccagatcttgccaaaggttttgcagtctccacctcatatatgctagatacggccacgtgggcgggtttaatgagccagacttcaaactatgcagtagaggtaatcgacaaaagtgggacgaacacaggttggtagcttttatgacagcttttttgggtcttatagtgttcccaaggaaagacagaaacatcgatctaaaagtaattagggtcgtctgtaccttgctcacccaagataaaagtactctggcgcctatgattatggctgacatctttcgggctctcactgcttgccgagccaggggcgactttttcgaaggatgtaacctattgttgcaaatgtggatgaccgatcatttatgccaccgctccccgctcttgggttacagttcgcccgagaaaacttgtattggagaattctacacaagaatcaaagggtttagtctacccgagggagtcacagcttggacgtcatttttccgaactctcactgccaaccaaatccagtggacgctcggatggttgcctgttgaggaaatcatatacatgccggcaaccaggccccactttttgttgatgggacttaaaagcatccaaccctatgcaccgtatcgggttttgaggcaacttgggaggtatcaagtagtgccgaaagatgaagactggagtacccaagtgatcgaaatcagtccggacggtcgtttccctgaagaagaagttcgccaaatctggagtgagtgccaacatctgacagcaaacacttgtgtgatggatacggctaaaggggaagctgctccggggtatcacgcttggtttagaggtgacatgtcctgcgagagaccagctaaaagacctcatctcaaagatttcgttgagtcatcccaagagcaatggaactggttagcaaagggaaaggggtatcgggcagagatcggtgatttgaagcaataggttgacagtctgaaattcaataatagtatgcaaatcgttgcggatcgaggcgaaaagaatagattgacccaagaaaatgaagaacttagggcccaaatccagaaattgagattggctcttgataaacaaccaaggagtcgatcagacgagcagttgataaaagggttgaaaagtgaagtcagggaatggcgagatggtttagaagagtctgaaaatgtcatggcagagatcaaggtgcagtggggtacaagagcagataagcatcgccgatacttgaatcaattgaaatgcgaccacgagaaaactgttgccaaaatgaagagagagatggctacacttgaggttaaagcagttaagcaagccgaggatttccaaattgatagcagatactgttacgacttgttggcccaaatgaaggtagaagtacggcaactgaagaatcagcatatgcatgattctcaggttttaaaaacgtgcagtgatcagataaaacgcctgctcatagagaagaagcaaaccagagataagatcaggaccattgcccacgccatcatcagacggtgtctacggtgtgaaaacatgaccagcattaccgttctctcggtagtgatgggttatgtcaagcagaccatgcatgagctggaacaacctgaaagggatatcacacctaggaccgcggcgaggccgaacgatgccccgcgggcgccgattctcgaaaccttaatgtattcataggtctagtctgttcgtcttttacatcgaggtgtattagtctgttgagtctgtacctttttcagggcttgttattttccttttttgagagtgttcgtttgtaatcgatcgttcagtaataaaatgtgtgcttcttttacactcatctgtttgaactacgtaatgatctgattcatgcagcatcgtgatacgtaggcaatcctcatcggatccggtcacattttaacttcaaatattgaaaacagtaataaaaaaaagaaagaaagaaaaatgaaaaaaaattataaaggggaagcctaaaaagaagccggaatgacgcatgcttttgttgcaaacatgtaggaattcacttaactgtataggtgcatcatgccccaacgtgagattacctatctgttatttgttttcgaactaaccgttcgtttgtcgttgagtccttccaggttttagaaaaggcggttggtttggtgaaggtctggcctcacattcatacttcacgaggtcgaaatggagtgttcaatacctgttgttaagtcaagagggggtactcacacttacttcacaagatcaaagggaagcatagaaatgtcttcagaaattcctttgccgacagttcctatttccgaggagagttcaatctcgaccgtcctcacgcccgaatccgcaactgcggaggaaaatagaatcctgcggctctgcatgttggaaatgttggatgactagaataacagaaaagagccaccaagtgttatccatgggttccctgagttgttctcctggacaagtcggacttccaatgtccccataagctatccggctaccctgttcggatacccagccatttcggccttctctgctggatcgccctctgattcttatccccggatgtcaacaacagatgtagctacaaacgtattcactgcacctccctgtccgatcgtggcacaacccgctacacacaagccaaattttgactcatcctcattcacattccaagaaccgtccttctccctggaaccaactcggttctccaccggcactcatcctccacagcctcaatacgagtttgcacctgggcaggatcaaagccccaaaactactgaacaaaatgagatggcaaaaagaatgaggagccttgagcagagtttgaaaaacatgcaaggtttaagcggacagaagagtgtctcctataccgatctatgcatgttccctcacgtgcacctacccatgggtttcaaaactccaaagtttgagaagtacgatgggcacggcgaccccattgctcatctcaagaaatattgcaaccaattgcggggagccggcggcaaagaggaattgctaatggcatacttcggggaaagtctggtaggaatagcctcagaatagtatatggaccaagacatatcccgatggcatatatgggatgatcttgccagagattttgtgagacaattccagtataacatcgacattgcaccagactgaaattatctgtcaaacttgaagaagaaaccttcagaaagcttcagagaatatgctattaagtggcgcgagcaggcatcgagggtaaaacctcccatggacgagatagaaatggtcactacttttctccaggctcaagaatcagactatttccagaatatgatgtcagccatgggaaagcctttcgcggaagcaatcaagatcggggagatggtggagaacagtttgaaaacgggtagaatcttaagtcaggcagccataagggcaacctcccaagccgtccaaagcgggtctggaggaatggcaagagggaagaaaaaggaagaaacgtccatggcagaattagaagcaagggaatatcgtaatcccaggccccgttttccagaaagaacctcacaacattactacccccaccaaaatgtgacgtacgctcctcaaccctacatggtcatgaatacccatccctatgtccatgcgccacagcaagccaatcgaggccaagctccacctcccagaaattagcctccctaccgcaaccactataatccacagcctcctcaaaataacttccgccctcaggaaccacctagaagacgaactttcacacccatcggtgaaccatattctcctttgttcccaaagctagtccaattgggtttcctgcagccagtccctcagacaaggcacaatccggcatcacctacttacaaagccggtgttaggtgcgcctatcattcaggacagaagggtacgatacaaataactgttgggatttgagaagggtagtagagaatttaatagagcaggggaagatagtactaagagacgaggaggtcccaaatgtgactaacaacgtgttgcccgctcacaataacgggccgctaattggaatgatttgcgaggacaaagaattcgatcctgctttaaaagctataatcgccatcgtcgatgcagggaaaaggcctaaaaccacccggaagctagagaaaggggaaaagaaggacagtactatcaaggttgagcccaaagagaagggcgaggaaaagacagtgacgatgatgcctgtgaggaataaagttctttacgttccacgaggtagagcagagaagccgcatagcttcgaagtcaaaagggcaaaaccaatgtacgtaccaaaaggggcctatgtggtccagaggacgattcaaccacctcggctgaatgagccagtggttatcggacgcgtgccacaaaagccgatgacaaacccgtccacagtaccgtggaactatcaaagaacgttggttacgtacaaaggaagagaagtcacgggagaacttccagagaatacttttattggaaggtattcgaacactcaagagttgaacaacgccacacggagacgcttcccgccaaagaagcctgtaagcgttgaagaagcggaagttttattccaaaagatgaaaatgccagactatgaagtggtagatcaactaagcaagtgccccgagcaagtgtccatgctatctctgctgatgaggtcgaccgaacaccaaaaaatcttgatcaagaccctgaacgaagcatacgtacaagttgaaacctcagtcgaacaactggaatggatgacggagaggttcttcaccgttaaccaggtttctttcagcaagaacgacttacctccagagggagcagctcacaacaaagccttacatctaacagttaaatgcgaggactacttcgtcaagcgggtaatgtttcatgggggatcaggtgttgatatttgtccgctctccacactgcagagaatggaaattgggacaggaagaatccaccctaataatgtctgcgtaagggctgttgatggcgtcaagagggatacccttggggaagtagacttggtgttgactataggaccagtggagtttgaaataactttccaggtgcttgacatggatacgtcttacaattttctccttggcagaccttggattcaagcggcaggggctgtgccttccactcttcaccaaatggtgaagtttaagtacgaagaccgggaaattgtggtccacggagaagacgaacagtctatttatcgggactcatccatcccatatcttgaaccaagggaagggagcgagcacacgttttatcaggctttcgaagttgtgctagcagagcagtatgaagaaggaagaccttgcccccagcctttcttgtccaacgcctcaatcatggtggctaaagaaatgatccgacatggattcaggtcagggaaagggctcatacaaacattgaaaggaataacggaacccatcaccttgccttccaccaagaaactttttgggataggttttcaacccactccaaaagatgaagagtggtcaaagaagagggaaaatgagggttggaaactgcctcggccattgctagatctatacgaaactttcgtcggaccgaaatacatcgaagaagaagacgatgaggttttcacggccgaagagatcgaggagatatgtggggcaatgagaggaatgctctacgaagctcacatggttcaaccgggagaaggtaccagcaccactgagatgctatatgtggggccgaactccaagcttcgaaactgggaggccacgccattccctactagacaggtgtccgggtagacctgtcctgccacccttcctgcatcacgagttatccccaggatataacttggatgtttttcccttcattgttgttttaaattcctgagttataaacattgttatcttccaaattccaagaaaataaaaatcattgttttctcatttttcctttgttctgatttttgttatttttccttatctcttctttcagttataataatgcggctttaaataatatgacatgcttgcggacttcatgcctagatcacaacgagctatttaattgtgaaataatgaaccaagaaccagaatatgacgaagaagaggcttttagggaaataaaccgagaattggaacactttgagaataaacctaagccgaatcggaatgacactgaaccggttaatttgggaactcctgaagaaatccgagagaccaaaataagcattcacacggatgagaaaacacgagatgcgatagttcaactccttttttaatttaaagatgtgcttgcttggtcatacgatgacatgccaggattaggtgttgatctagtggtgcataaattgccaattcaccctgattgtcctccagttcaacaaaggcaaagaaagttcaaaactgatgtcagtgacaaaattaaagaagagatcaccaagcagctaaaaacgggagtgatcgggtagtccagtacaccacgtggttggcgaatgtagttccagtgccgaaagtagatgggaagactcgggtatgtgtggattatcgagacttgaatagggcgagtcccaaagacaattcccattgcccaacatccacatccttgttgacaattgcgccaaacatgagatacagtctttcgtagattgttacgctgggtatcatcagttgttgatggatgaagaagacgccaagaagactgtattcactacaccttggggcacttactgttatcgggttatgccatttggtctgaagaatgttggggcaacttacatgagggccatgaatgccatttttcatgacatgatgcatcaagaaatagaggtgtatgtggatgacgtgataatcaagtccaggacgcgggacaatcatatccaagacttgaggaaattcttcgagagactaaggaagtacgacttgaagctgaacccagccaaatgcgctttcagagtcccatcaggcaagcttttgggtttcatagtaagcaggagaggtatcaaattagatccaacaaagataaaatctatcatagatctacctaccccaagaacaaagaaagacgtgatgagtctgttgggcaggttaaactacatcagtcgattcattgcccagctgactagcacgtgtgagcccatatttaagctattgaggaaagatgcagcgatcaaatggatggctgagtgtcaagaagcttttgacaaaatcaaagaatatctttcaaatcccccagttttggtcccgccagagccagagagacccctgttcttgtatctgacagacttggaaaattctttcggttgcgtcctcgggcaacatgacataaccggaaagaaggagcaagcgatctactacttgagcaagaaattcactggctacgaggccaagtacactctgttggaaagaacgtgttgtgctttgacgtgggttgctcaaaaattgagacattatctccaagctcacactacttacctcataatcaggctggatcctttgaagtacatatttcagaaaccaatgcctactggaagactggccaagtggcaaatcttgcttactgaatttgacatagcctatgtcacccgcacggcaatgaaagcccaagcgttagcagattatttcgccgaaaacccggttgatgaagaatactaaccgttgagtacttattttccggatgaagaaataaacaccgtagaagtagtctcagaaaatgctcatgtttggaagatgttctttaatggggcagtaaatgccaaaggtgtaggaatcggggcaattttgatttcgccctctggtcagcactatcctgctacagctagactgcgtttcttttgcacgaacaataccgttgagtatgaagcctgcatcatgggcatgcatatggcgatcgatcagcatgttgaagatttattgattatgggagattctgacctgattatccggcaagcccaaggtgaatgggaaactagggatgtcaagattattccttaccgacagcacgtggaggacctcggcaagcgtttcaagtcaatagagttcaggtacatcccgcgatatcacaacgaactagcggatgcacttgctacttggcttcaatgctaccctacccaggcaacacccacgtcgatcccttggaaatccaaatcagggaaagacacggttactgtaacgtaatcgaggcaggatcgtgtacacatccatggtaccacgatatcaagaggttcttgaagacacaagaataccccgaacatgctaccggagattagaagaggactatcaggcggcatgtaggaggtttctttttgagcggcgaggtattgcataaaaggaccccggacctcaatctgctaaggtgtgttgacaccgaggaggcgggaaggatcatgcatgaagtacatgcaggagtgtgcggcccccacatgaacgggtatgttttggcaaagaaaatccttcgagcaggttattactggatgaccatggaaaaagactattttagcttcgttcgaaagtgtcatcagtgtcaggtgcacggtgatttgattcatgcgccccccacagaactgcatcccatgtttgcaccttggccattcgttgcttggggtatggacgtcattggttcgatcgagccgaaggcctcaaatggacacagatttatattggttgctatcgactacttcacaaaatgggtggaagcggtcactctcaagtcagtcgctaaaaaggctgtagtggattttgggcattcaaatcttatttgtcgttttggtattcctgcaactatcatcacagataacgcggcaaacctaaatagtcacttgatgggggatgtatgcgaatagttcaaaataacgcataggaattccactccttatcggcctaaggccaatggcgttgtggaagcagcaaacaagaacatcaagaagatcttgaggaagatgatccagagttcccgacagtggcatgaacagttaccctttgcattgttgggatatcgcactacggtgcgcacgttagtaggagcaaccccttatcttttggtttatgggaccgaggctgtgataccagcagaggtagaaattccttcgctccgaaccattgtcgaagcagaaattgaagatagcgagtgggttaagactcgattggagcagttgactttgattgacgagaaacgaatggctgcagtttgtcacgggcagttgtaccaacgaagaatggcccgtgcttacaacaagaaagtccgacccaggaatttcgaagtgggtcaactggtactgaggcgcattctgccacatcaccaggaagcgaaaggaaaatttgctccaaattggaaaggcccatacatcatcaagaagatattgccgagaggagcgttgtatctaggtgatattgaaagaaatgaccctgaaacagcagtgaatgcggatgcagtcaaaaggtactatgtctgagttatactccagtggtcctgacacatttgagatgataaaggttttattcccactacccaaaacactatcaactctctctataagccctttgagccggttacatttctttggctacctatcaaaaaaaaggaacaaaaagaaaaaaaaaaaaaaaaggaaaaacaaacaaacaaacaaaacaaaacattgattgagcctgaactacgtctgacttgattccgaaaggatacgcaggcagcctctctctggggttcagtcacaccaaaataaaatcccatttaccctgaaattgaaaccggggcacatcaaacggcttagaagttgtagtttcatctacaattcttttaccaagcacaagtccttcggatcaattaccaaaggtagggggagccaagagatatcacgattggaggtcggtacattcagaattgagagaaataaaacgagagagtcttgtcggtgaaaaccttcgggcaccgttgaggcgacgggagtagagaaaccaaaatgagagagattgtttagtaaaaaactcacaaagagtgctatcaagcgacaacaagaagagaaatgagagaggtcgactagcgaaaacccgtaaagggcgctgtcggccgaaaggatgattccacctcaggaagtcttggcaaagttccaccggtttggaaacacagttccgcttttgtttcatggggaaatacaagttcgtgaaggtcgggcgtccagtccaaaaagcatgtcatgtcaatttaaagtcagcatgttttccctcagataagtctttcttgccccgaaagggacacttctcttctaaaatttgctttctccgttctttgttttatttttctgtgaatccctttcattttaactccaagttccagatatactggaaagaataagtggcagggccggtttcatggagtttcgtttcgtaagaagtaaataccccgctttagtggtacgtttgtccaaacccgatggatcatgatgttggctgcattcgaagtaaagccacacacacacacaaaaaaaatacaaatccccacggggtctccctttgtacaaatccccacagggcctccctttgtaaaaatccccacagagcctccctttgtgaaaattccccaaagagtctgccccagctaatccccgacgagtcttccttgtacaaagacccacagagtctccccaataaaaatccccactaaaaatccccaagcagagcgggatgtaagaaccaaagcctcacatgggcaaatcatcacaaaatctggaaaagcgagtctgggcagtccaaaggggtttcgccgttgaatccaatcgatggcagagtttctcaacagaaataaggacgcgacaaagcaattggaacaatcaaggtcaccgaaccaaccgccatttccaaactgacaattgttctttgtttggagaattgaaataggtgtgatccaaggcaaccatgcaagaagcaggtgtcgcccaaaaaaaaagaaatacatgagtgcaagaaacggcttggcaataaggaatccacttaaaagggaagtttccccaaaattctcttttacattttactaaaagaagaaaactcaaaaaagagggtcagttagaatcacgagcattttccatttagctagcattagggatccaaccctgaactgagcatttttctgttagccagcattagggctccaaccctgaactgagcgtttatgttctgtagccagcattagggctcaaaccctgaactgagcattttactattagccagcattagggctccaaccctgaactgagcgtttatgttctgtagccagcattagggctccaaccctgaactgagcatttttctcttagccagcattagggctccaaccctgaactgagcattttttctgttagccaccattagggctcctaccctgaactgagcatttttctgttagccagcattagggctccaaccctgaactgagcgtttatattctgtagccagcattagggctccaaccctgaactgagcatttttctgttggccagcattagggctccaaccctgaactgagcatttttctgttagccagcattagggctccaaccctgaacagagcattttacatttagccagcattagggctccaaccctgaactgagcattttttcatttagccagcattagggctccaaccctgaactgagcattttttcatttagccagcattagggctccaactctaaactgagcatttttctgttagccagcattagggctccaaccctgaactgagcattttacatttatccagcattagggctccaaccctgaactgagcattttttctgttagccagcattagggctccaaccctgaactgagcatttttctgttagccagcattagggatccaaccctgaactgagcatttttctgttagctagcattacggctccaaccctgaactgagctttttttctgttagccagcattagggctccaacccctgaactgagcatttattttctgtttagccagcattaggcctccaatccctgaactgagcatttattttttgttagccgacatcagggctccaatccccgagttgagcacttttccattcagccagcattagggctccaatccctgaactgagcgtttttaccttatggcgacattaggactccaatccctgagttgctttttatagactagagttttccaatcccctcatcaattctgtaagttgttatggcgattaattcacgaaattttcctagtgaaactggggcaaaaaatttcgttcgtttgttttgtttgtctcagcaggtctgacctcgaggcgtatggatcgagatgacctacgggatgagtctcaatccagaataaagaaaagaagaaaaggacaaaaagaagatgttccgaggtgttggaacaaacaaagggcggatcactccaaaatttgatcaaggtcccgaactctgccaatcccgtctcactcaatatcgcagaaataaacaggcgcctacaacttgcaagcattaagattcggattgaagtctacaaacagaatcagctaagacccaagatcaagttgcaaaagaattatagataggaatcttgtaactagcggttgacaggcataaatagttagtccagtttcaatttcctttggttgtaataaggcggtcggtaagcagtagtggcaacagcaacggcagtaacggcaagcattgcaatcccatggtagtcccagctaccaaagtttcccgaactacattgacctgattcctgtttagcccaggatatgtaggaaatattcgaggcaaagattcggtcaaatctttcaaaaatgcgcttcacacggagtattccaatatgcaaaatcgctcatatccgctcactttatttttgtacggaaactcttcgtgtgttcgcacaaagaggggcagctgtgagcacgtgatttttatttacacgacaattactccaaaagaaatcaaaaaaataataaagtggcgctatttcagccatgcaggattgagacagagcttagtctcggaatgcagagaagtagccttatgcaatgcaagaaatgcagatggagacagagcttagtctcggaaggcagaaaggtagccttatgcaatgcaagaaaagtagatggagacagagcttagtctcgaaaggaagataagtagccttatgcagatgatgatggaggtagagcttaacctcggaaggcagaaaagtagccttatgcaatgcaaaaatgcagatggagacagtgttagtctcgaaaggcagataagtagccttgtgcagatgatgatggaggtagagcttaacctcacaaggcagaaaggtagccttatgcaaaatgcagatggagacaaagcttagtctcggaaggtagaaaggtagccttatgcaaaatgcaaatggagacagagcttagtctcgaaaggcaaaaaggtagccttatgagatgcagatggaggtaaagcttaaccttggaaggcagaaaggtagccttatgcaaaatgcagaaaaatgcaagatggaggtagagcttaacctcggaaggcagaaaggtagccttatgcaaaatgcagaaaaatgcaggatggagacaatgcttagtctcggaagctagaaaggtagccttatgcaaaaatgaaaatggagacagagcttagtctcgaaaggcagaaaggtagtccttatgcgatgcagatggaggtagagcttaacctcgaaaggcagaaaggtagccttatgcagtgaaagaatataaaaggatgattagtagtaagatctcttagctgatagccgattacgacaatatgactgctggggatattgtatacggatagcaattgtggacaagtgatgattctgagaagttgtattcttgagagtacataaatatacctaatgatgttgcgaattgagtgcctgcatccaaagaaaaatcgtgagttctgtaaggggaaaggttagttcatcttccccgggctcttgacgttgtgtgtcattggggtagcgtcgctaaacaacagcaatccggataatagttatgcatgctttagtaaatatataatcaaaaatagttttctttagatgaaccaacgactacaacgtggttgcagacattgcaacctctttcgcttcggaattttgaggatccttctcaaaattctgccctagtttactgtgctggcgctcctggcgatgcgtggactaaaatcaacttcgaaattttgagggtcctcctcgaaattctgccctagttccaatagaggtgaaaatggaatttttattaaattatgactgaacccatagggctgcctacgtatcccctcttaaacgggaatcaagccaggcgtagttcaaattacatcatagaggaaatcataagtggttacacataatatcgtttcactgcatctgaattgattggcttcggccagacttctccatccatctctgcaagaataagggctcctccagttagaactcggtggaccatgtacggaccctgccaattgggagagaacatccccttggcttcatcttgatgtgggaatattttcttcaacaccagctaccccggtgtaaacttccttggcttaacccttttgttgaaggatctggacattctgttctaatacaactgaccgtggcaaaccgcattcatccttttcccatctataagggctaactgctcgtagcgaccttttacccattctgcatcatccaattctacttcttgtatgatccttaaggagggaatttctacctcggcggggatgatcacctttgtaccataaaccatcatgtagggagttgctccgatcgatgtgcggactgtagtgcggtatcccaataaggtgaatgataacttttcattccattgtttgtgcctttcgaccatcttccttagtatcttcttgatattcttgttggctgcttccacaactccattcatctgagtcctgtaggttgtagagttcttgtgtttgatcttgaaagtttcatgcattgctttcatcaagttgctattgagattggaaccattatcggtgatgattgattctggaactccgaaccgacaaacagtgcggtcgccgcggacgaaacctgccacaaccttcttagtgaccgccttgtatgatgttgtttcaacccatttggtaaaataatcgattgccactaagattaacctgtgcccatttgatgcggcaggctcgataggtccgataacatccattccccaagcggcgaatggccatggtgagcttgttgcagtaagctcgtttggaggtacctttatcatatctgcatgtatctgacagcgatggcatttgcgaacatactggatacagtctgtttccatagtcatccaaaaataccctgctcggagtatcttctttgctaagacaaaaccgttcatgtgcggcccgcaggtccctgcatgcactttatccaatagcctagatgcttcttttgcttcgacataccttggtaaacccaaatcgggagtccttctgtataggattcctccgttgtgaaagaagttgctggataacctacgaagtgtgtgcttctgagtagcgttggcaagttctggatattcccctgttgtcaagtactccttggtgtcatggaaccatggttttccatccgcctcttccttaacgtgggcacaataagctagctgatcatgaatctttactgggatgggatcaatgaaatttgtatctagatgctggatcatggacgataaagtagctaatgcatcagcaaactcgttctggactctagggacttgctgaaattctgtctttgtgaaccttttcctcaactcctgtatatgatgcaagtagggaagtatcttagagttcttggttgcccactctcctcgaacctgatgtatgagcaagtctgaatcccagattactagcaactcctgaacgttcatgtcaatggccattttgagccccaagatgtaggcttcatattcggccatattattggtcaagggaacctgagcttggcagataccgggtagtgctggccgatttctgatagtaggactgcttctatgccaactcctttgaaatttgcagctccgtcgataaacaacctccaaccatcatagtattctgcaatatcttctcctatgaaagatacctcttcatcgagaaaatacgtttttagggctcgtattctccgtccacgggactctcggcgagatggtccgccaagacttgccctttgattgctttctgggtcacgtaaacaatgtcgaattcacttagcaggatctgccacttggcgagcttaccagtgggcatgggcttctggaagatatacttcagagggtccattctggatatgagataagtagtgtaagcacagaagtaatgccttaacttctgcacgacctaagtcagagcatagcaacgcgttctaaaagagaatatcgggcctcgtacggtgtgaacttcttactgagatagtagatggcttgctcctttctccctgtttcatcatgttgtcctagaacacaactgaatgctctatccgataccgcaaggtaaagcaataggggtctttctggctcaggcggaaccaagaccggcggcgttgacaggtattccttaattctgtcaaaagttttctgacaatcattagtccatttggtagcaacgtccttcttcaacattttgaatataggttcacaaatgaccgtggattaagctatgaaccggctaataaagttgagtcttcccaggaaactcatcacttccttcttgttctttggcggtggcaattgttggataactttgacctttgatggatccaattatattcctcgaaaactcacgatgatacccaataattttccagcaggaaccccaaatgcacacttggcagtattcagtttcaaattgtaccttctcagtctattgaagaactttcttaggtcttccatgtgatccctggctttcttggatttgatgatgacgtcatccacatatacctcgatctccttgtgtatcatgttatgaatgatggtagtcatggctctcatataggtggcaccagcgttcttcaaaccgaacgacatcattttataacagtacattcatcatggcgtgatgaaagccgttttctctgcatcttcctcatccatccatatctgatgatacccatcaaaacaatcaataaaagactgcaactcatgcttggcgcagttgtcgataagaatgtgtatgttaggcaaggggaagtcatctttgggactggccctattaagatcccaatagtcaacacaaactctaactttcccatccttttttggcactggcacaatattggctaaccatgtcggatactctactaccctgagaaccttggctttgacttgcttggtaacctcttctttgattttcaaactcatgtcgggtttgaatttcctgagcttctgctttaccggcggacatgttggatttgtttgcagtttgtgagctacaatggatgtactgagaccagtcatatcatcatacgaccaggcgaatatgtcttcatattcctttaggaattccgtgtactctttcttttctgatggtgataggtgaacacggatgcgcgtttctttgacgatctcactttcatccaagttagacttaggcctattctcaaaattctcaacctctctgacgacctcttctggcatatcatcctcttctgaatccatatccgtttgttgcgttgtctcgttgcgagtcacaatcattggttcatcgtcaaggcaaataatagtaatgttgtgtaaaataaagtgaatgatagaaaaaaaataataagagcgagatatataataaattgaaatgcttcgattgaattcgtaattgttttgagtatcagagctcttttcaaaattaaagacaatgcggaaataaaatcagctagtaaaaagtaaaatgtgatgcatggtgcttttgtccagccttgctaccccgaaggtttccgggccctggtggttctgatcgaccaattgctgaggtgctctccttggttcacaaggagtccatatcatccccttcctccccttcctcctcgaaaataacacagcagtccatatcatcattctctaagaacagattcttcatggctgccaatgcttcctcttcctccgacccatatataatatctgccggctggaaagtctgctctaggtgaggtatcagatgctccagtgggtagtagggaccgcgccatggtggcgaccagtgattgaactcctcccaagtgtactcataccccaaaccaaatgtagtgccatgtttcttcagcttgatgggtttggcgattccctggaggtttttgccgagtccctttccaggttcgtatccacaccaattcaggatactttcaatcttgttatcccaccatttatctttgtctacagcattgactctttcaatgtggtggtatgtttctccgcctattctccttctgcctccaatcatcgggatggtctggcgactatatatggggttgctaccatcgctatgaatgatcacctcctggtgattccattcgaacttcactgcctgatgcagggtcgatgctacagctccagcggtatggatccatggtcgtcccaacaacaaattgtaggatgctgggacatctatcacttgaaagtcaacatcgaaccaggttggccccatttgcaagcataggctgatttccccgatagtagacctttgggacccatcgaaggctttgacattgatggccccatctttgatttcacgtaggctctttcccaatgttctgagagttatcaacggacagatattgaggctggagcctctattgatcaagactctagtgacgaagtaatccgggcattgcacggtgatgtgtagggccatgttgtgactcagtccttctggcggcagctcatcttcgtggaaggtgattttgtggctttccagtatttgtcctatcatatttgccatttctcccccagttatgtttctgggcacataagcttcgctcaatatcttcatcaatgcctttttatgtgcgtcagagctctgtagaagagctaggatggatatctgtgctggtgttttgttcaactgctcaacgatcgaatactccatagcttgtattttcctccaaagatcatcgggaccagtttcagtagttcgtcccgaggcttgcttactgcactcagctaggtgctctggagtgtaaaccctgcctgttctggtcatactctgcacaacaattgcttctcccatcttggtctttcctttcctccttgtttcagctgtgtaatcccatagtatggcatttgagtggaattgtgttatgcctgacattgctacagggatgagtaccctcggtggtaacatagcaacttcaaagagtacatgtgcctttggagccccaaattcaacctcaattggcccgtccaccttcgcagaagaaggtgcttcaaattcgagaggcatagacatggttacttcatcgccccaggagggctggttttgcacaataatctggttaagtgtgacttctggtttctttggctcatcattctcagcaatcagtcctatcgatccctcagggtcccagtcatcttcgatctcgatcatgtgaatgtcctcagctctgtgatcaggcagagggttgttgcggatattagaagtaggctactttgctacgataaccttattgtccatcagagtttgaatcttgtccttcaacgagcggcattcgtcaatggtgtgacctttcataccggagtggtacacacatgtcttattagggttgacccactgggaaggattttctggagttatggtagggataggggagatgtaaccagtagctttatgtttctcatacagttggtgaattggctcagcgatggttgtatattgtctgggaggtttgcagtcaaaatttggtctggatcttgggaaattttggcgagtgggaggtgattggtagtgagagggttgggcattataagcttggtaaacaagtgcaggttgagagtatctgggtgaagtgggttgatatgtaggaggtggagatgattggtaaacgggtggtggattttggtaagagggtgtggatgcttggtaattcgggataggttgatatgtaagtggaggggacgggtaagtgtggtattttagtggtgatttgtctccctgtgcgaccatcacggcattgacatccttcttcttagacatgccaccagactgtaaagctttgttggtagcctgcaatgcttcaagatttgtaaccataccattcttaatgccttcctcaattctttctcccagcttgacaatatcggagaatttcaggccctcgatcagcatcaacctctcgtaatattatgggtcctgagcccgaacgaagaatctgttcatttgttcctcttctagggctggcctgaccttagcagcctctgatctccaacgagtagcatactcgcggaatgtctcggtaggcttcttcttcagattctggatgtaaaatacatccggtgcattctctgtattgaatcggaacctatccatgaaatccgatgccatacctacccatcttgtccatttctaggggtcctaactgatgtacaaggataaaacatcccccttcgggcttctcataaagaatttcatacggattttctcattccttccgactccgaccagcttatcacaatatgtccttaaaaggactctgggatctcccgtgccatcgaacattttgaacttgggaggtttgtatcccttcgaaagttcaacatctggctgaatgtagaggtcttcataattcagcccctctatgcctctgtttccttccatgccctggactcggttggtcaacttcttcagttctgctgccaagtttctgataagagagtccttgtcatcagacttaggtgcacttgatattggttgagtgtagtggggtatggtatctacgtagataggagtgttgtggggatggtcgtttatggtgttcggtggttcaggaatgagtagtggagtgtggcatgtattgcaatgttgagcatgagtgggttgcatctgtggttgtggggtgttctatggaggtgcgggattttgagcatttggaaagttgacatcaggagcggtgagagtgaatgataaatttgccaagtttcgaacttgatccagttcttcttggaacttcaacagtttctgctcaagttgggcagcagtttccttagcaaccggggtaccctgaggaatctcaattctttcaatttccaatctggcgcttgaatctcctattctacctttattcttgttccggataggactcggaggaggaggaggtggagggcccttggatctcgtactgtatgatgatggtgccagaatgcacgaactaacctttgggaaggggaataataataaaaaggtaacaagttagcgcgaattatgaggaaaaatattgcagtatttaaacatattgtgcaagaatataaatcatgtcctaatttgggtgccttattgtgcccgaggtaggcctagcgacaagttaatttggagaacttataatgctaaatgcctcattttattgacaaaaaataagacgaatcccaaaatgacactaaaatagcggaaagtaaaaatgtcattaatggccatcagccttattacatcattaaagcaaaatgaaagacttttaactacttggtcccagaaggaccttccccagatttggtatctttatccccctcgaatagcttcaccagctcgcgcagtcctagcagcagataagcttgggccaaatgtccgcctgcattcccttcagcgttccgacaatcttcaattctcttgaggaactttccttctagctccactagaccccgctccaaataccctagtcatttgttgaagctgacagccatatccttccatttctcgatcaatttttgatgggcttcttgtatttcccgatgctcactttcacactctcgaattctcttgcgcagttgattgtacttaacccgtgcttcggctttctcgtctatgattctgtgttcgtgaatgaacccgggttgacccataccattgtgattatcttccaaccaacccgaatagtgcggcacgcaaccagcgtgatacctgtctggctcaatagattctttccccaaaacaagcttgcaatgccacatgtgttgagcttggcatttgtgagggctatcatcgtcctagaaatcagccctaaagtgactcattttgtcaaccattggtatcatttgtttccttccagcctgtctcatggctcggaggggaatgtagggataagttcctcttaaaccaatgagtatgagaaatagtgcatctcgggatcgaacaataaattcttctgtagggaaccattcgaccatccactgtacctggtcttcttttagattctcaaatagctccacccatcttccagcgtcttctggctgagcgaacttgttaggcatataattcatacgccttggctggtggaaggcaatgtgatcatcccagtctctgcgtaagatctcttgtcggtattatcctttctggaggtgctccatgagctagagctgaagtaataaattgcatccctcaaaattactggcttttcgctgacagttttccagagcccggtatatctcagcaacaatcatgggcaatagactgaaaggctgtctgccaattccttccatcagagtcttggttaccatggccagtctggtgtggatcctagccttcttcatagggaacactatcatccccaggaaacaaaacatgaatacgaagacccttctgtgaatattccccagtgaggtgaaggcaaattcatctgagtaggtgcggtatgacttgctatggtcgtacctctcatacagatagtcgaatgggatgtaggagtctttcaaacaggtcaagtctgggttcttcttcagtcccatcatcttaaggaaacccctacccttgcgattctcttgtataagcaaacccggagtctcccaaggaataccagctaagcctcctatttcttcgagcaaaggagtcatttcaacgttcccaaaacggaacacagacctgtcactatcccagaacagagttgcagcctctatgattttgttgtcaggctggatttctagaagagaaggcatattccctaagtatttggggacgagtgtctgatcactggagtggagatcttcccaccaattcagcagccttggatgaatattggttaccatgccaaatctaaggactcattttctgcaaaacagagtgttagacccttacctcgccagactcgactatttaaaccaataattagcataaaaagcatttagttctccaaataaatgcacagaacatgtgggtgtccatttgggtttcagggaaactcgatggactttggacaaggctatcttaatgagtcattatgtggacaacataactgactcggctaggtttgaccatgatgcatgcacagttagacagagtaaggtttctattggggtattaaacaggtacccttgagcggacaactcaagaggaaaaggcacggaaccgtcgactgcaccgctgattgactggttttaccgcaaatacacctttgtcgaatttaaagggtgataatattggaagagcgcaaccactcattataagcgttgctatggtatttgtttggcacgagtggaatatgatgttgaagatgcagtttacaagaatgaaacaaattgacatgtattttcacgttcataagataaatgattataataattgcagtaattacaacagtattgaaataaagcagtaaaggaaagaagataaaggaaagaaaagacatgaagagccaagtcaatttcgtagcgaataaaagacagtaaataaagcaattaatgagatagtaaagaaacaagcaacatgcaatggtaaaagcctaaagaatccccaccagagtctccatgctgtcgacgcccccttttcgctaaccgtggggtcagaaatcgggtatacgacattgggaggacaactctattccctttagagaattgggtttagaagttgaagagtcgccacctaatgattatagtgaattaggacactttaagaagggtttgagatgaaaagaccagagtttagggtaagggctagaaattatcccgaggggaaggtgttaggcacccctcaagatccactagtgtggtcccgaccatgttacaattgtgactttacaagtaaacaatcaaggctcaaataaggattcgcatatcacattgcaatcaggatgaaaactttcgaaggtaagtagagagggcagaaatttatgaaaaggaaaaaaaatatttgaatagttttacaagaagagatgaaagcaaataaagggagggggtcctaagtttataattattatggatcacttcaatgcaatacccagcaatcactcctcagaagaggggtcgcacgtgatattagcgcatcggtcatcatatccatatctacccttcctaccccattaaggtgttaaagcgtgaaatggtatcattacttattgcatgctattgcccgtcccaatcctatcagtctcggaggcatatgggactcctaatcctaaaggggagggagttggggcttttgcggagttttcaaaaggataaaatcttggcgacaagcaataacagatagcaattaaaagggaaacaaatagcagttaaggctcaagtcagcctcctcattcaaagcaccagattatctaacatgacttacaaatactggtttggtctgtattaaacttaacgtaggaagggtggctaatttatcacatatattttcaaataagaagttcgaattaggcctgcccgctggttgtaattatcaaagctgatgcaagtataaaattttaccctaaggcttgcctaggcgttaaacagaacctataggcatgatatctattagtttcagaaataaagaagtaaactgattgcagaaaaaagaattgttaattacagggacataagatctgcggcgttaaacattattgctactgattttaggcttataagcgagttgacgattcaagttcagttaacagctcctatacacatgttttctaggtgttactgatgtgagcactgttattgcttatgcaggaatcccataggcaggttgtctacatgaaattgattaggtatttaaatcttataataggtttgcctaatgaagaatgcagaaagttctatagccatggtgtctagatgaagatgcagaattttagaatcggcttacaggcatggcatttgttatgaaattgcagaaaaccctatagacatagtatctatatgagaatgcagaaaatcctataaacatggtatctatatgagaatgtagagtttcaatgacttataaaatgcagaactttagaaaaaacagtaatccctatgaacatagtatctacatgagtgcaaaatttcagaagtatagtaattccctatgagcatagtatctaccccttacatgcatagtcccctacccttttccacttgccgaccccaaatgtttattacaagattattacagacccgaatgaattagaaaagaagtaaaattacattaaaaagttccagctacatctaaacagcctaattcagattcaaagtccaacaatatgagataaactaactttcaggatcagatttccaaaagactttctcatatttggggtgtgtcaaagttcccaagagtctcaaagggactccaggcagtgcttacaccccaaaacattgcagaattaagaacatggtgcagtgtggaaatgccatccctcgtatgtccaagttcatagggaactcaaggtcccaaagcaaggctcataagaggagggcagaacttaaaattctaagaataagtgtatgtgcacaggggttagagagtgacaaggcaggctagcggttatgcccagccatatgctaggctggcacacccctgaccagcctgtcggccaattaattatgagtaaagacctattgaaggtcagactagggcctggacagtgattagaacactatcagaccaaagtctcaaactcggcatacatgtaaaggggaatgaggatgggaattgaaagagtttaggactcaagcgggtccagttcatgtccatggacaacaatatcaagtattgccatgtttctaaaccataactcaaccacatatgggggcttaaggtttgggattcatataagagcaggaacgatgaaataaacaaacttgcaaaaaatcacagcatgtaaacaataagaaatgaactatagaataaacacataaggggaagagataggacttgaacataagaacataccagttgcagaaaagtaagcacagaaaaagcaggattctttcaagcaaagccacaatcagagaagaacacattatgcttgtgagttcagagaactcaagctcttatgaaaattctaagtgtatttgagagtgagaaatgatcagaattgatcgtgtcaaattgattctctaaagtgcagaagggaagccccctcttatagtgtatagaagcaagcaagaaatgtaagaaaaccttttaaaaatcagtctcaaatattctcccttcagccaaaggatttaatttcagacggtaaaatgtaaacaaggaaaggaaagttgagtaaaatctttcatagtagcctaagaaggggaaatacatgaagtatatttaaggaaaggtctcaatagtacttgatttgtaaagagaaaggaaagggaatcaatcagacagttaacaaaatcaaagtaaacaagtttgattcgaatgaacccagtcaagaatagggagagaagggatcaaacaaaaggaaattaagggcaatcaatcaagaccctatcaaaggggtctaaaatcaatcaagcaatcgtcaaaaatcttgaaagaggggtttctcacatataaagcaaacaattcaaacaaaatagtctagcattgaagggtttaggatcacaaacaaaagaatacgagttcagtcatagattcatggtgagtttgaaagatcagggtcccaaagtggaaccctaatccaatttatcgaagaaacccccaaaatctagggtttcaaattgaatcaaacacagaaatgagaaggcaagtgaacagactcaaggagtctcatgaggaacaaacagaccacgatagcaagtttgaaacaatcagggaaagaaaatcgatttgagatcataaaaggacacgttttggaaacccggagctcagacaagtccagaatagatgaaacatgcttaacaagaacacaaacagagttcaaaaaagtaaaagtcaagaagctcggtagtaaacacacatggtagaagagtgaggaacatttaacacggattaatcatgtgagcacacatataaaagaaagaaaaaaaaagacaatacatgcataatagagaaggaaaaaatacgagcataatacagacgaacatctaaaagaaaagaacatcaagaatcaaaagaccttcagaaaccctaatttgaaatcgaacgatttttgagaaggaaatttggggaaaacaatcaaatcgtcaagaaaagcacagacatagcacagatctaaacaaataacggtgaaagaacctcgaatggcttagggtttcagagaaaccctagaagtgagaaaggcttggaagaacaagattagatcctgagtcgaaacggtcaggaatagagcttccagcgcttgaatatgctggagcatggccggaaaaccatagatctacggatctgagatggatctgagagaggaccatcgaggtcaagcctccagacttcgtgtaattaaggcttgggtgtgagagagggtgagtaaaggccatctatggaaggagatgccatggattccggtggaaacgagatgagataaggtgggaggtgattagggtttcggagaggttcgagaggatttgagggagacgaagagagttggaggcagcgtctctatgaaaatgaagtagtgttaggggtgttaggtgattaaaaaaggaaagcctaaactacagtcgttgatcaaaatgatcaacgactaggatttaaagaaaatcagacgggtttaaaaattgggctaaggggttgggtcgaaatgggaattgggtcatttaatttggggaggaattgggccaattgaggctacaattgaaagggataaaaggctattattgaaatagaaataggctaagtgttaaatagccaattttcccctttttattttataaaaatagtaataatgatttaaaaagtaaattaaaaatactgagcaaacaaatactatataaatatcaatttaaaaatattggaaccagttttataattataaaatgctattaatcataaaataggccataattgcaattacatgcaattagcttaaaaatgccaaataaatttgtaaaaaaatatgcaaaaatcactttaattatattttggtgtaaatacgggaatgaaatcattaaaaatactaaaacccttgggtgtgcttatatatgcacatacatgctattttggaagtattttggatacaaaaatacctaggaaaaaattgggtattaacactgctgaacttgcgcgagttgggagagttgatcgacaagagcatctagtcttgagagggtccttctaggaccaaatagattagatttatttgctttcctttcaaatgtaataaggccaagagccattagtgacatcatcttatttagtttcgtttttgttcatttactttgctttaatgaaataaggcattggcactaaagttctccaaatttatttgtcgctaggcctacctcgggtacaacgagactcccaaattaggacacgaatttacattcctgcaatatatgtttaaatattgcaaacatttcagaatccttaatgacttatttaccttttcatttttttatttcttattcccatcccctaaggttgattctctcatactggcatcatcagcatatcacaccagatctagatgccatccacctcctcctcctccaagtaatacaaaaggcaaaggaaaagtaaaaatggacgatttaagtggtattcgaaaggagaatgctgagaaaatagaagcttcagatgatgggagtacccccacaccaaatgacctagtcttgaggttggcacaaaagatattagaactatagggagaacttgagcaggtccgcaacttggcaaacttgtcactcaccttgaatgtccccgacatcaaccaacaaaacacaaaaacccagcacctccccaaaacacaccaagacaacatccacaaaaccctcttgcaccacattaacacgcaatcccaccccaaaatctcaatcccctaccaatactaactccgccgcaacaccaccatcaaccaattcatttcccaccaaccgtcacttatcatactccctagaatacaccacaacccactcttgaccctcaaaaccctactaatgaccaccactacaccccgacactcaccaaaacaacaccatatatgtggtaaccgtgcctcactctatccaaccagtctccaataccctagaatcctccgagaaggacctgctcattaaaaatatggctaaagaactcaagaagttgacgagtcgagttcagggtgtcgaaggcgacaagagaatagaaagtttgaactataaagacctatgcatacagccaaatgtagaattactggagggatacaaacatcccaagttcgagatatttgacggcacaggtgatcccagggtctatctgaagtcctattgcgacaagcttgttggggtcgtgaaagatgaaaatatccagatgaaactctttatgagaagtcttactagagatgctttgtcctggtacatcatccaggatcccaagaaatggtccaattgggtgagtatggcatcggatttcatggaccggttcaagttcaatacagagaatgcaccagatgttttctacatacagaatcttaagaagaaacccaccaaaacctttcgcgggtatgctactcgttggaggtcagaagcggccaaggtcaaaatgaacaagttcttcgtcagagcacaggatccgcagtattatgagagattgatggttattgaaaaccataagttcctctgatatgatcaagcttggggaaagaattgaggaaggcatcaaaagcaggatggtaacgaattttgaggcattaaaggccacaaataaagtattgcaatcaggcggcatatcaaagaaaagagacgttggggcagtaatggtagctcaaggcccgaaatctccacttatatatcaaacacctccacccacatatcagacacctccacccacataccaagcaccactgcccacatatcaacccttatctcccagatattcccaaccagccactgcctatcatacctataattcccaaccatcccatttccaatcacctccaactcgccaaaattttccaagatcacgaccaaactttgaccgtaagctacccaaatagtacactactattgctgaacccatcgaccagctgtatgaaaggtcgaaaaccattgattatgtcacccttattcctattgtggcattagagaacccatcccaatgggttaacccacacaaaacctgtgcataccactccggtatgaaagggtaaaccattgatgaatgtcaaacattgaaagataagattcagacgctgattgacaacaaggtcatacaggaaaaagaagccacacccaatgtctgcaacaaccccctccctgatcataagggtggtggtatacatgtgatagaaatgaactaagactgggatcctgaggggtcaatcaggcttattcgggaaggcgatgactttaaacttgcagtcacactcactcccatagtagtacagacttaggcaccaattgaagttgaaataactgcatcagttctgtttgaggtagaggtaactccgcctgcggccacccctgttccatttgaagtagaagtggccacaccttttacgatgacagtatcaaccacacctcctttcgactcaaaagcaataccttgggattatgttgccgaggttaggcgaaaagggaaggcgaaaatggaggaatccgatgttgcgcaaggaatgaccaggaccgggagaatctatacacctgaacatttgggaggaccaagtaaggatgctgctaccaagcagcctgtcattgaaacatgaccagatgacctttggaggaaagtgtaagcaagggaatattcccttatcgatcattagaacaaaaccctagcttagaagaatgctttgatgaaggtgttgagtgaaacctacgtgcccaacaatatcatctgcggagaaatggccaatatggtagggcaggtactggaaagtcacaagataatcttccacgaatatgagttaccacttgaagtgttgaatcacaacagagcattgcatatcacagtgcaatttgaagacaaatccatttccagggtcttggttgatggaggttccagcctcaatatttgtctgttggatactctgaaaagactgggcaaaggtttccatgaaatacaggtagggagcatgaatgtgaaagctttcgacgggtcccaaagggccacgattagagaaattaatctttgtctacaaatggggccaacttggttcgacgtcgagtttcaggtgttcgacataccggactcatacaatcttctgttgggccaaccatggatccatgccgctggggctgtggaatccatactacatcaagctgtaaatttgaatggaaccatcaggaggtgatcattcacggagataggagtaaccttatttacaccagtcaaaccatcccgattattggaaatagaagaagggtgggaggggaaacataccatcatatcgaacgtgtcaatgcctatcacgacccggaattcccaccttctggagtcgtgatggaacctacccatagaagctaggcaagccacaaacttagaaatctttaacccttctattttagtcctttttacaacttatattaacaagtgataagcatctaaatgatagcggaatatgagatgtaagcggaagtcttaaatgaatataaaaccaaaatgtttcgaaagtcaacacatgcctctacccagaaactggtgtcacaatatccacggactactaagagtactacatacaatagtttgaaggaaaaataacactatttgtctcggatacatgagataacaaaacataataaaagatagaggagacgccgggcctgcaggactgcctcggaatctctgtggactgaaggatggctcctaagctactaatttaatgctaccgaccctatgtgctggtaagtgcctgacctaaccccagcgaggtattgacgaggctaggaccagactccagataaacctgtgcagttatataatgtatggcggaaaataaacatgaattaatagtttaaaatgggagggggtacatgcttcgggaaagcatatcaagaccaacggaaacttaataaaatatgaaaggacaactcaatatctacaacaatacaataacaatattgttgtggcacgcaacccgatgccttatcatttaacattgttgcggcgtgcaacccgatccacatatatatagttgttacggcgtgcaacctgatccaatataatatatgttgtgatgtgcaacctgatccaatataatatatattgtggcgtgcaacctgatccaatataatatttgttatggcgtgcaacccaatccaatataatatctattgcggtgtgcaatccgatccaatataatatctgttgtggcgttcaacccgatccaatataatatctgttgcagcgtgcaacccgttccaactatacagtcaacaataaccataattaaccgtcccaacaaggaatcaacaataaactacactatctcggcaagggaactcaacagtacaagtatatacgtcccggaaagggagaatcaattataaccaatcttaactcaactcctactcgtctcaattaccaccgtttctcaatcgcaagtagattccacgacaaacaaactaagtctttgctcaatatcaaggatttagtcactatttcaaccatattaacattcaaaaatacaacaagtatcaatttaagattcatggtcatgcttgacaccaacgtatagatactcgtcaccaaacctatatgtcatactcaacaagaagaaaatagaaaataggactcaactcctaatacctcaagctagggttataccgaacacttacctcgatgccacgaacacaactcaaggtttaattgtaggtttaccccttgattccaccgccaatttgctcgtatctagtcacaaattacttaattacatcaataaacgctaaatgaatcaatttgaatgcatgaaaatgagttttctaaagttttaccctaaaagtcaaaaatcgccccctgacccacatggtcaaaattcgaggtagaaccaaaacctgattacccattcccccacgaacccaaatatatgatatttttgaaaaacctaggttctacccaaaacactcaatttccccccatgaaaatcattgatttgaagttgaaatcatgttaaaatatgttaatgattgaagaaaactagttataatgacttacaattgatttggagtagaaaggttgtttgaaaaatcgcctcttatgtttttggggttttgaaaaatgaaaaatgactgaaaatcccgtctatttatacccctctcagaccctatgtgcggaccgcacaaagtcgactgcggccgcacactagcgccccgtgcggaccccacaaagttgaccgcggccgcatagccttcaccccgcactgcacaaggtcgaccgcggaccgcactggagggttcagagacctgcaacttctggttttaagcctaaaacatcctgaaactcacccaagccctcggaactcaaaaccaagtatgcatactacttaaaaacttcatatggacctattcgtgcgatcacatcattaaaataacatgtaaaatcatgaattaaacctcaaaacttaacattttcatcaagaacaatcaaagtccataactcttcaatcggaagtccaattcacgtcaattaaactccgtttttcaccaaatttcatggaaacgtcttaagtcatatataagacctataccgggcaccagaaccaaaatacgagccccccgaaaccatcatgttccaagcaaatttcatttcaattttccttaaacagttttagaaaacaatttcttttaaaaattcatttctcgggcttgggacctcggaattcgatttcgggcttacgcccatgtcccatattttcctacgaaccctccggaccgtcaaattatgggtccgggtctgtttacccaaaacgttgaccgaagtcaaattaactgattttataaccaatttttttatcatttttcaccgaatttcatatttaagcttttcggctacgcgcctggactgcacacacaaatcgaggtagctctaaatgaggttttcaaggccttagaacatagaatttaatttaaagcaagtaaaaggtcatcacattctccacctctaaaacaaccgttcgtcctcgaacgaacagaagaaggaagtacctaagtcagggaaaagatggggataaaggcttcgcatatcaaactcggactcccaggtcgatgcctcaggaggatgacctctccactgaacatgaacagaagaaaaaaattttgacctcaactgacgaagttgtcggtttagaatgactaccggctcttcctcataaaacaagtccttgtccaactagacagtgctgaaatataacacgtgggatggatcgccatgatacttccgaagcatggacacatgaaacactggatgcacggctgataagctcagcggcaatgcaagtctataagccacctctcccactcgatcaagaatctcaaatggaccaatgaacctagggctaagcttgcccttcttcccaaatctcatcatgcccttcataggcgacactcggagcaatacctgctcaccgaccataaaagccacatctcgaaccttgcggtctgcataacttttttgcctggactgagctgtacaaagcctatcttgaataatcttgaccgtatccaaggcctcctgaaccagatctgcacccaacaaccgagcctcccccggctcaaaccatccaaccggagatctatatcgcctaccatataaagcctcataaggagccatctggatactcgactagtagttgttgttgtaggcaaactctgctaaatgcaagaactgatcccacaaacctccaaaatcattgacgcaggcttggagcatatcctccaaaatctgaatagtccgctcggactgcccgttcatctgaggatgaaatgatgtactcaactcaacctgagtgcccaactcttattgaactgctcttcagaaacgtgaggtaaactgcgtaccttgatccaaaatgatagacacagtcacaccatgaagatgaacaatctcttagatgtagatctcagataacctctcggatgaataggagactgccacaagaatgaaatgcgctaacatggtcagcctatcaacaatgacccatactgcgtcgaacttcttctgagtctgcgggagtccaacaacaaaatccatagtaacccgctcccacttccactcgggaagctcaatcctctgaaataaaccaccaggcctctgatgctcatacttaacctgctgacaattcaaacaccgagccacatatgcaatgatgtccttcttcattctacgccaccaataatgctgtcgcaaatcctaatacatctctgcggcgcccgtatgaatagagtaccgtgagttgtggtcctcctctaaaatcaactcttggagcccatctacattaggcacacaaactcgaccctgcaatctcaaaactccatcatcacctaaggtaacctgcttggcacctcagtgttgcaccgtgtctctaaggacacacaaatggggatcatcatactgccaatcacggatacgctccaataatgaagaacgagcaaccgtgcacgctaacaccagactaggctcagaaacatccaacctcacgaactgattggccaaagcctgaacatccaatgtaagcagtctctcaccgaccagaatataagcaagactgcccatactgactgatttcctactcaaggcaatggccaccacattggcctttcccgggtgatataaaatagtgatatcataatccttcaacaactccaaccacctcctctaccgcaaattcaactccttttgatttaacaaatactgaagactcttgtgatccatgaacacctcacatgccacgccatatagataatgcctccaaatcttcaatgcgtgaacaatggctgccaactccaaatcatgaaccggatagttcttctcatgaatcttcaactgccacgaagcataggcaatgaccttgccatcctacattaacactgcaccaagaccaatacgagaagcatcacaataaactgtactaggcctaaacttatgggcaaaaccaacaccggtgtcgtagttagagctgtcttgagcttctggaagctcgcctcacactcgtgtgaccatttgaactgggcacccttctgggtcaacctggtcatcggggctgcgatagatgaaaaccccttcacgaaccggcgatagtagcctaccaatcccaagaaactccgaatctctgtagttgatgttggtctaggccagttcttgactgcctcagtcttcttcggatctacctgaatactctttgctaatacaacatgacccaggaatgcaactaaacgcagctagaactcacacttcgagaacttagcatatagcttactatccttcagagtctgaagaaccactctaagatgttgctcgtgctcctcccagctgcgggaatatatcaaaatatcatcaaagaagactatcacgaatgaatccaaataaggtctaaacactcggttcatcaaatccataaaatttgttggggcatttgtaaacccgaacgacataaccaagaactaataatgcccgtaccgagtgcgaagagctgtcttagggacatcggtgccctaatcctcaactgatggtagccagatctcaagtcaatctttgaaaataacttggcaccccaaagctgatcaaacaaatcatcaatccccgacaatggatacttattcttgatcgtaaccttgttcaactttcggtaatcaatacacatcctcatcgatccgtctattttcttgacaaacaacaccggcgcacgccacggcgaaatgctaggtctaatgaaacccttctcaagcaagtcttgcaattattccttcaactctttcaactcaggtgaggccatacgatacgacgggatagaaataggttgagtgcccaaatccaaattaatacgaaaatcaatatccttgtcgggtggcatacctggcatgtctaaagggaatacctcaggaaactaacgaacaatgggcacagaatcaatagagggaacctccacgctagaatcacgaacatatgccaaataagccaaacaccccttctcgaccatgcgttgagccttcacataagagataacactacgagtagaatgactaggattccctctccactctaaacgagggatatccggtaaggctaaggtcacagtcttggcatgacagtccaagatagcgtggtaaggcgataaccagtccatccccaatataacatcgaaatcgaccatgtctaaaagcaacaaatctacacgagtctcaagacccccaatcaccacaatacaagaacgatggactcgattaactacaatagagttacccaccggtgtagacacataaatgggaacactcaatgaatcactaggcataaccagatacgatgcaaaataagatggcatgcacgagtaggtggaccctggatcaaataacactgaagcatctttatcacaaactagaattgtacctgtgataattgcatctgaagcctcagcctagggcctggctggaatagcataacatcggggttgggccccaccatcctaggctccatccctgggatagcctacagctggctggactccacctctagcggcttgagctccacctctaaatcctctacctccacctctagaacctctacccccacctctagctggctaggtggtctgtggaacacctggtgcctggaccatagaacggggaccctgctgctacaacttagtacccaccaaccttggacaagtcctcctaatatgaccatactcaccaaaacatccacctgagtgttgtggatgaggaaactgtgattgtaggcgacccgaatgaccaccccaaaaactctggagcggtggtgcactgataggagccaatggtgcactataggactgctgatcggaatactgcatctacggaccacagctacatgaagcatcgtgagagacctgaagagctgactgaaagggcctgggaggatggcctatatcatatgaatctctgcctccagacgaggcaccactgaatctacctgaatgacggcgcctcttatccaacccatgaccacctccctatgacaggaccatctccactctacgggccacattggccgcctccttaaaagtgatctcactcccagcctccctaaccatctgaaggcgaatcggctgaataagaccatcaataaacctccttaccctctctctcggtaggaagtatgacaagagcatggcgagctaagtcgatgaacctggtctcatactgggtaactatgacgaaaccctactggaaaatctcaaactgccacgggtaggcctctctcttaatcattgggagaaacttctccagaaacaacactgtaaaccgctcccaagtcaaatatggcgatccggctggcttggccaagcaataatatctccaccaagtcttggcggatccagacaagcgaaatgtagcaaaatcgaccccattggtctcaacaataccaatgttcctaagaacctcgtgacagctatctaaataatcctagggatcctcagaagatgcaccgctgaaagtagaagtgaagagcttggtgaaccgatctagcctccacaaagcatcagtagacatagttgttccatcgcagatctgagctaccacacccggctgtacttctccaactggatgaatcactggagtctgaatctgaggagctacctgctctagagtatgagtagcaggagtccgggcccctcctccagcctgagagacggccggtgctacaggaagcaatcctgcccgggtgacactctccatgaggcccactaatcggacaagagcatcctgaaggactgggatagcaataaacccctctgggacctgagctgagcccacaggagctgttggggctggaacctcatcatcaaagtcaacctgaggctctgctactggggctactgctcggggctaagctctacccctacctcggcctctagcacggccttggcctcgccctctgatcctcgtgggagacgatgttgggggctcgggctgatgagcggtagatgaggaagcgtgtgttctcgccatttgcgaaaaaatagagtagaaattcaattagcatagagaaactgaaccgcacgacatgaaagaacaaatgtgaagtttttcctaactctgcagcctctaggggataaatacagacgtccctgtacctatccctcagactctacagagcttgtccgtgaatattgagacctatgtaacctaggtctctaataccaacttgtcacgacccagaattcccaccctcgggagtcgtgatggcgcctactcatagaagctaggcaagccacgaacttagaaatctttaacccttctgttttaatcatttttacaacatatattaacaagtgataagcatctaaatgacagcggaatatgatatgtaagcggaagttttaaatgaatataaaaccaaaatgtttcgaaagtcaacacattcctctacccagaaactggtgtcacaatatccacagactactaagagtactacatacaacagtttgaaggaaaaataacattgtttgtctcggatacatgagataatagaacataataaaagatagaggagacgccgagcctgcggacacctgcaggactacctcggaatctctgtggactgaaggctggctcccaagctactgatccaatgctgctccggtatctgcacagagtgtagagtgtagtatcagcacaactgaccccatgtgttggtaagtgcctggcctaaccccggcgaggtagtgacgaggctaggaccagactccagataaacctgtgcagctatataatgtataccgaaaaataaataggaataaatagtttaaaatgggaggggtacatgcttcgggaaagcatatcaagaccaacggaaactcaataaaatatgaaaggacaactcaatatctacaacaatacaataacaatactgtttcggtgcgcaacccgatcccttatcatttaacattgttgcggcgtgcaacccgatccacatatatatagctgttgcggcgtgcaacccgatccaatataatatatgttgcgacgtgcaacccgatccaatataatatctgttgcggcgtgcaacccaatatctgttgccgcgtacaacccgatccaatataatatctgttgtggcgtgcaacccgttccaactatacagtcaacaaaaaccataattaactgtcccgacaagggatcaacaatagatacactctcccggcaaaggaacatagcagtacaagtatatacgtcccagaaagggagaatcagctataaccaatcttaacgcaactcttacttgtctcaattgccaccgtttctcaatcgcaagtagattccacgacaaacaaactaagtctttgctcaatatcaaggatttagtcactatttcaaccatattaacattcaagaatacaacaagtatcaatttaagactcacgatcatgcttgacaccaacgtatagataatcgtcaccgtgcctaaacgtcgtactcaacaagaagcaaattacaaataggactcaactcctaattcctcaagctagggctagaccaaacacttacgtcgatgccacgaacacaacgcaaggttcaattatagttttaccccttgatttcaccgccaattcgctcgtatctagtcacaaattatttaattacatcaataaacgctaaatgaatcaatttgaatacatgaaaatgagttttctaaagttttacccaaaaagtcaaaaatcgcccccgggccaacttggtcaaaactcaaggatcgaaccaaaatccgattacccattcctccacgaacccaaatatatgatttgttttaaaatcggacctcaaatctaggtccaaatccctaatttttgaaaaacctaggttctacccaaaacacccaattttcccccatgaaaatcattgatttgaagttgaagtcatgttaaaagatattaatgattgaagaaaactagttaaaaatgacttacatttgatttggagaagaaaggttgtttgaaaaattgcctcttatgtttttggggttttgaaaaatgactgaaaatcccgtctatttatacccctctcagaccccatgtgtggaccgcacgaagtcgactgcggccgcagagtagcgccctgtccagaccgcacaaggttgactacggtcgcacagcagcgccctgtgcggaacgcacaaagtcgaccgcggccgcacagtcttcaccgcgcaccgcaaaaggtcgaccgcgaaccgcattggagggttcagagacctgcaacttctcgttttaagcctaaaacatccagaaacctacccgaaacacacccaaaccctcgaaactccaaaccaagtgtacatactactcaaaaacttcatatggacctattcgtgcgatcacatcatcaaaataacatgtaaaatcatgaattaaacctcaaaacttaacgttttcatcaagaactctcaaagtccataactcctcaaccggaagtccaattcacgtcaattaaactccatttttcaccaaatttcacgaaaacaacttaattcatatataagacctgtaccgggcaccagaaccgaaataagggcccgataccatcatgttccaagcaaatttcatttcaattttccttaaatagtttcagaaaacaatttcttttaaaaatttatttctcgggcttgggaccttggaattcgattccgagcatacgcccaagtctcatatttttctacgaaccctccgggaccgtcaaatcatgggtccgggtccatttatccaaaatattgaccgaagtcaaattaactcattttataaccaattattatcatttttcacggaatttcatatttaagctttccggctatgtgcccggattgtgcacgcaaatcgatgtggctctaaatgaggttttcaaggccttagaacacagaatttaatttaaatcaagtgatgacctcatcacaatgtcattaaaaaggacaaatggtggagcagcaaaatacaaagcatattggcatggactgggtataaatccggtaaggggcttgggaagaatctccagggtattactaagccaatacagctgaagcgtcatggtactaccttcgggctcggatatcagtatacatggtaagaatataatgattggtcgcctccatggtgtggaccttattaccctcttgagcaaccagcgccacatctagatcaagcttttcaccaagccgacacaatatggggaactgcagaagaggaagcattagctgggttgaggaatatgttcttggaggatgaggacatcgactgcagtgcaataattgaggaggaggaggaggaagaaggtctcactattcagactgtggagaagggagctgttctcaggaattggatcgtcacaccatcccgggcccgccgagtccctgggtagcttggaagatttcattcctatagctattctaggcatttaatatttttccataatttgtttttaagatacacttgtttcaaaataaatgctcgattcatcgagccgtacccgtttagatgttttaagtattaataaaatgcattactctttattatttattgttatctttcatatttttctttctacagcgttattgttacttttcctgatgaaccggtgactgtgacatgtaacgaggcaacgcaacatgagaatagtggttcagatgaagaagatgagatccttgaggaagttgtaagggaagttgaaaattttgagaataaacctaagtccaacctggacgagaccgaagcagtaaatttgggggacgccgagatcgttaaggaaactcgcatcagtattcatttatcgccgatagagaaagaggagtacatctgctttctaaaggaatatgaggacattttcgcatggtcatatgataacatgactggtttgagcacgtccatagtggctcacaagttgcctactaaccctatgtgtgtgtcggtaaagcagaaacttagaaaatttgaaccagatatgatcctgaaaatcaaggaggaagttactaagcaaatcaaagccaaagttctcagggttgttaagtacccaacctagttagctaatattgtgcagtacaaagaaagatggaaagtcaaagtatgtgttgactatcaggatttaaacagagcaagtcccatagaaaatttcccactgccaaacatacacatcatgatcaataattgcgccaaacataaactctaatcttttgtagattgcttcacgggttatcaccagatctggatggatgaagaagacgcagataaaacaacatttattacaccatggagggtatactgctataagatgatgccatttggtttaaagagtgctggagctacctacatgagggtcatgacaaccatcttctatgatatgatacacaaagaaatagaggtgtctatggacgacgttattatcaaatccaagagtgtcgcggatcacatagcaaatttgagaaagttctttgataggttaaggaggtaaatttgaagctgaatcctccaaagtgtgcatttggggttcccgcaggaaagttattaggattcatcgtcagccgtcgagggatcgagttagatccatctaaagtcaaggttattcaggagttaccaccacctaggagcaaaaaggacgtgatgagcttcctaggatatctcaactatatcagtcgcttcatagcacagtccacagccatatgtgaacccatcttcaagatgctgaggaaagatgctgatacaagctggaccgagtattgtcagaaagcttttgacaaagtcaaggagtacatgtccacaccaccagttctactcccatcggaaccaggacggccttttatactttatctatctatattagagggagccttcggatgtgttctaggacaacatgatgagacaggaagaaaagagcaagccatatattacttgagttagaagttcactccttacgaagcacggtactctttgctagagcgcacttgatgtgctttgacctggatagcccagaagttgagacattacttctatgcctataccacatacctcatatccaagatggaccctttgaattacatatttcagaaactcatgccaacttgaaagttagccaaatggaagatactgttaagtgagtttgatatcgtctacgtaactcaaaaggaggtcaaaggacaagcattggcagatcatcttgctaaaaattcggtgggaggagaatatgagcccttgaaaatgtattttcctgataaagaggtgtcattcgtaggagaggactttaccgaagaatacggcggttggaggatgttctttgacggagctacaaatttcaaaggagtggtctttggagcagttttggaatcagaaacaggtcaacattatccggtatctgctaaaatcagattcccctgcaccaacaacatggcataatatgaagcctgcatactaggactcaacatggcaatattcaggagctattggtaatcggtgattcagattttcttgtgcaccaggtacaaggagaatgggccaccaaaaattcaaagatattgccatatctgcaccatgtgcaagaattgagaaagaggttcacgaagatagagttctgacatgtgcccagaattcagaatgagtttgtcgatgcattggccactttatcatccatgatacagcacccgaacaagaattacattaatcctatcccagtgagaattcataatcagcatgtatattgtgctcatgtcgaagaagaaacagctggaaaaccttggttccatgacatcaaggaatatttggcgaaaggagaatatccagagcatgcaaaccccactcagaaacgcacactccggaggttgtccaatcacttcttccacagcggaggaaatttgtatagaagaactcctaatttggtactgctaagatgtgtcgacacaaaagaggcttctaagctacttgaggagatacgtgctgggacctgcagccgacatatgaatggttttgtcttaaccaagaagatactcagggccggttacttttggatgaccatggagacagattgcgtccaatatgtccgcaaatgataccagtgccaagtgcatgacgatatgataaaagtaccgccaaatgagctcaacgcaacaagctaaccttggccatttgtcacctagggaatggatgtcatcggtctgatcgagcccactatttcaaacgaacacaggtttattctagtagccattgattacttcaagaaatgggtagaggctgcatcttacaaagttgtaaccaagaaagtcatcacagactttgtcaaagatcgtattgtttgccaattcggagttcccgagtctattgtcactgataatgacgccaatctcaatagttatctgatgaaagccatgtgtgaaactttcaaaatcaaggacaagaattccatagactataaaccttagaggaatggatccatagaagctgccaacaaaaacatcaagaaaataataaggaagatggtagaaaaccacaaacaatggcacgaaaagcttcctttttctctgttgagataccgcactatagtgcgcccatcaaccagagcaactccttacatgttggtttatggtatcgaggcggtcatcccaaccgaggtagagattaattctttaagaataatacacgaagctgaactcagcgatgcagaatggataaggagccgctatgaacaattggctctcatagatggaaaaacgataaacgcagtatgtcacggtcaactttatcagaacagaatgtctagaactttcaataaaagggtcaaaccaagacaatctgcaccaggatagctagtgttgaagaagattttcccacaccaagctgaggccaaagagaaattctctcccaactggcaaggtccgtacatggttcacagggtgctaaggggaggagcactcatactcgcagagatggatagagaaatctggccaaaaccaatcaatttagaagcagtcaagagatactatgcttagactatttacatttcctcatttgatgtaattgaactacgcttgacttgattcccatttaagaggggatacgtaggcagccttatgggttcagtcatatcataataaaatttccattttttccaaagttagaaactggggcagaattttgaggaggaccctcaaaatttcggagcaagtccagccaacgccaacatatgttagacggtcagaaataggttaaaaattggggcagaattttgagaaggattctcaaaattccgaagaatgttcgttaaggctcattacccgcaaacagccaaaggatcatctaccaaactgggacagaattttgaggaggaccctcaaaattctaatatgagaaagatgcaatgtctctgaaatgtgttatagtcactagttcatctaaaaatcatttcatatatcaatatgtttctaaaatgacactatttttatcaataattgcatattttcgaaaactctatttccgtgatagccaggtgttacccagggaaattcgaaaaggcctctagaacggataaagcaaggcccgtagacagaagcatgaaccaagctcccccttacaaaactcataatttttctttgaacacaagcacacttgatgtaacgatagcatccgcaaacatgtatacacaaagcaaaatcactatcaaacaggccatcagacactgaatatatctccagctaagaaacctactactcttatttgttactcgctctttgcatgggactaagccttgtcccgcatatttgcatgaggctaattcatgcctccatattcgcataaggctaatccctgcttccatatctgcatgaggctaatccatgcctccatatttgcatgaggctaatctctgcttccctgtctgcatgaggctaatccttgcctctatatctgcatgaggctaatccctgcctccctgtctgcatgaggctaatccctgcctccctgtctgcatgaggctaatccctgcctccctgtctgcatgaggctaatccttgcctctatatctgcatgagactaatccttgcctccatatttgcataaggttaatccttgcctccatatctgcatgaggctaatcattgcctccatacttgcatgaggctaattcttgcctccttatttgcatgaggctaatccctgcctccatatttgcatgaggctaatccctacctccctacctgcatgaggctaatccttgcctccatatctgcatgaggctaatccctgcctccatattttcatgaggctaatccctgcctccctacctgcgtgaggctaatccatgccgccatatttgcatgaggctaatccttgcctctatacctgcatgaggctaatccctgcctccgcccctacatgaggctaatctctgcctccacatttgcatgggactaagcattgtccctccgtaaataagcattgctttattctagtactatctatttgcaatgggccaagctctgcccttcatttcacaagactaagccttgtcttggtaacaccatattaccgcatatcatgggctgaaatattgccaatctatccaaggacgtcatagtctaaaaggcatcatcctcatagccggaagacactatgccatggcttgaggatccctcaaacttgaatattattattcaaaggcgtcatggttcgaagacaccatatgcatgacccgagaacactatttcatgacatgcgaattcctcactaaacaattcatggcccaggacatcatagtccgaggacgtcatccttaaccgtccaaagacaactttcatggtccaaagggaatctgcatcatgtttaaatttctgcacaaatacatgcttgtagcatctctttatcagcaggtaacctgcaagcaaccgctatcctagcaagatcgacctcgctccagttccttcaactatctcaaaccttagccattcgtcataactgccttgcatctcgtgtccgttcttgtagtgacttcatcggcatattccaccaatgaatccagaactacatgtggcctgatttctataaaactagggatatgtaggcatctcaaagaccagagtacgacctctatccttcaaaacatcccatccggtcaaaattgaccatcatttctttacccgaaaactctttcatccttcccgggtaaagaggggcaactgttgatacccaatttttcctcacatattttgaacatatatatactttaaaaatatcacatatacaactataagactacataagtattttttttatataatttttccataattgtaaaagctccaaatcgatttatttcttctctttttattacataaatatccaataattatccttcgtactacttttgtaataatttagccatttaaattcattatttatgccaacatagtgtttaaatatttttagtgcattttttataattgcatttatattgtttaggccaaattgcacatctttgcaataatagcccatactaatgtattattatattatttatgcataaaatggccttatatatttttaaaatgttaaataactattttaaatcattttattacacaatatattttttatattcatttattatttttataaattatttagttattaaaattagttatttaaaatttggccctattttctatttcaattctgatccaaatttgacctaatacccagtgcccaatttcaacctaaacctacccaggcccaatactcatctgccccaacccaatacccggccaaatcctggttgttgatcgttttgatcaacagtccaggtttcccccttcctatattaaacctaatgaaccttccccaaaaccctctcatttccctcaccttccccgccattacctaatcctctcatctctcaaattctctcaaacctaaccctagtcggacctcgccgtcgctcatttatgggtaactagggtggtttctcaccacccccaggcctctaatggcctctctctcgtactggtctcaccatctccagggtcctcaagggaccaaggttagtctccttgcatctatggtcctttctcgcctgtttcaggctgttctgatgtgatttcgagtaagagcttcctatattgccttagatctatgggtttctgagtttacttcttcacctctaagttgttctcctcgaaaccctaatttcttctaaacttcttagatctgtacagatctgagatgtttggacctatttcatatgatttatttacaaaaaaccttttgatttttacaaggatcttctgattttcaaatggttttccattttcctaaactagggtttcccgaaaaatttcttttccaaaaatgtttgatagttttgagtgtttgaacttctgtttcctatatgttttaactaatttcataaggttgctctaaccttaactcgtttatactaaaagccctaactttttagacattctttgtttggtttctgagtacttgtgtactgactttgctcttgccttggttcttttgatttttctttagccatttagatgtctcttggttttcttatcctaatatgcctctaccgagtttcttaattcaacttccctattgattctatatgtttatgttcattctgactattcatgttaagactatatttttctccttaaatcagtatcgttttcttgatttaccaatttgtttcattaaagttatgtgtcgaatcctgactattcatttcttgtcttattttatctgcgagacttgctgactctttacgtgattttctctttaattgaacccttgactattctgaagttcttatttcctggtttgatttgaactcttttctttaacaaaacttttttattctgatttctctacttggtttgattgaactccttgccttaattattttttcccttgccttatttgttatttgctgattcttattgtttgtttccttaattgaaacttctgttcatttacccctaattacctactctatacccaaaccttacttgatttttcttccttaaatacctatcatgcttttatcgttgatttgattatcccatgattaagcagaagacttactgattttacgtatgactgattctgtgaatttccctaattgctacataattgatccctttgccttattttgtttaactcttgattactatataaactccttcttattttaactactggacacaaacaattgttcagaaactatcactttacactttaaaaagctctctctcagctatctttgctctctttgctacttgtaatccctgttattctagttggatgcaagccaaggctgggaattgtacaataccttactcacatcttgtattttctttctttaactaggtatgcttctgattaatttttaagaatctaaacctatgtgtttatttactattttagttcatatggcctgagtccattcttgtttctgtttactgcttacccagcacgcccaatattgcatattcaaacctgtgattagtatgtttccattttacctacttgtttgctatcttgtttaacatgtatacatatgtaactaagttgtttgatgaaatactatttatcttgcatgcctaaactctacttctatgtaactagcatgccttcacttgttaatacctatccagcatgctcatttaaaaccttacatgttatgtccccctcctgctaagttagttaatctccttagagtgattctagctgtgttgatatcctcaacatgtttctgctgtgatccttgatgcttgacttgtattctatctaacctactagttctatagaacccttcaaaagctctatgtatcctgttgattgtgtgctccattaaggtgtcctctctatgttcctaacccctcttcccttgtgtgaaagtcgtttgccaaagtacttcctaaaaactattggttttatgacttgtgtcttgatttcaaattgtttctttacacttcctcaaactgttttatcactaaatcagcactagttttcagaaattcttttaaatcctaagatctttctttaaactatctattaaactctttcaaaccattatgcacttccacttactcttagaaaactaggttttgcccctctgatatgtgtgctggcttgagactcttgagatctctctaaacttgggcatgttagggctggcacttccatactgcacctaaatcagttattatttgagaaaagtctaggtgtgagcactgcccaggatccttgaggttcttagggaactctgacacacctagacatgaaattggctataaaactttgggtatttgagactactggaggcttggaaatcactttggtcctacttcaggctccctatagattaatttctgttagaaatatgtaatttttcttttattcaattcattggtctataataattattgtaaacaaacagttgtgtgattagtgaaaaagggagggtagttgtacattgagggtaaaattgggtagataccatgcctatagggtccatgttgattccaatgtgtttaattagaaatcatgcctataggatttaaaccagtttagttagaaaatcagcttagttcatgtttattctgaatcggtttagttaactaatttgtctgctcctttaacaagttttcaatgctatcttaattaatattactagagaacatgcctataggatctaaactgtcgttttaaaagaaaaattgtttgctgtttcattgcattcttagtcaataatagataccatgcttctaagatatctccattatgcgtctaggcaatcctgtagggtgactaaaaccctgtaaactataaaactgcgtctttttatttgagacttctcacattcaagaggtttaaaagaatcagtaggcaagtagaattcagttctttgacactttggtcctaattcaatattgtatgctctctgctcacctagatatcatgttctaagattttctttgaaatacctgaaactgttgtttgagacgtgcacttacttgttatgtttgtggaggtaaatatgagcctttaattgttccctctttaagtgcagtcctaattgttttgattgacgcttagacttttcttctttaaataccttagtatggtctagaaccacctaaattagaggtcctaaatacctccagggccacaagaaagggacgggtagtgcacgtataggatatctttcaaggttgctagaacgctttagggtatgactaaagggagggaattggttagtaagaatatgatgactacgcactaatgtcacgtgtagccccttattgaggagtgattaccgggcattgtgtgggtatgatcctataggctaaccaacctaggacccctctttcccaactcctgttgtttaaataaatttacttttctttataaatgtgcaacttgttcaagccttttcctttgtttcattacttgaatcatacatgtgcttagaatgtcaaaacatgtctttacttgcaagtacgtgttaaaactgtttatttattaaaatgactaattcacatagtttaagttcggtcgggacccaccgttgtggaccgtgaggggtgcctagcaccttcccttcaaggttattttgagcccttaccctaaatctttggtaatacaaactagtccatgagttaattgctcaaggtgccctaatgcaccataatccgttaggtggcgactcttcgaatacccaattcccaaaagaaaacgagttatttcccccatgaatgtcgaaacctagacttccccgtcaaaaagaagaaaaaaaagggcgcgacagtgatcacatcatcgcagaagattatgaactatgggacattgttactgatggtctattggctaccatgaagaaaaatgttgaaggagtggatgtatcaaagactagagctgactgcaatgctaaggacttgaagaggtgggaaaagagttctaaggccaagaaatggcttgtgtgtggacttggtccagacgagtacagcagaattcaaagatgtactactgctaaggaaatttgggacactttgcaagtggctcacgaaggaactcctcaagtgaagagatcatgaggaacactgttgtattctcaatatgagaatttcaccatgaaggaaggagaaaccatccaagagatgtatacaaggttcacaacactaacaaatgaacttaagtctcttggaaggattatccttaacgaatacaaggttgagaaaattctaacaagggttttgccagttacttgggaaagcaaaatcgctgttattcaggaatcaaagaacattgccactctcaagttggacgagttaattggaaatctcactgcctatgaacttataaggcaaaccatgaagatggatgcacccaagaaggaaagaagcttagctctcagagttgctgaaggtgcagatctagaggaggatgaaatgtctatgatcacgagggatttcaagaagtatttaatgagagaaaagggttcttcaagaggtgcaacttacaataaaccaagggtccctgagaaatagaccaacgagggttgttacaaatgtggtaagactgaccacatgatcaaaaactatcctcaatgggaaattgaatggaagaaagaaagggctgaacgaagaaacaggaagaaggaacaggttcatcccatgaagaacaaaggatcaacaaaggctatggttgttgctcgaggagaaagctcggatgaggattcagaagatgaagatagaaatgaacaagtaattatggccattagagaatcagatgatgaactagaggtaaatgtgattcatctcaaagacaagatttaaatttttgtctaaagaaaggctatcggagttactgctagatttcattgatgaatctgaggtcataaacaataaaaaggaacagctgtctaaggaatgtgtaatcttgaaatctaagtgcaaaaatctagaacttagggctagtgaaagtgatagtaaaaatgccgagttgaagaacctggttcttgaacttgacaccactattttagaacttatatctaaaaatttaaaatcgaaattaggaactggtaaaaagaaagctgaccacatacatctcaccttagaataaaatctagaaaaaataaaggatgagttgtacaaaaaggatgagcggataaaagtcctaaaagaatatctaagcaaggttaagcatgaactagatagaacttgcaaatggaataagtcctctgatgcactatcatggctacaaaaacatcacagtagcaataagagaggacttggctatgagacccatgcacctaagtgggatcccaaaagcaagaacatcactaagaacaaaatctgcacacactgtagtaagaccggtcactacaaaagtgaatgtaatacaaaagaaaaggccagtcaaaagaacaaaacctttgttctagggaaaaataggctgccaggatgggctaaaaagaatttaattcacccttttgcatatagaaagggacccaaactagtttgtattcctaagactaacccctgatttccttttgcaggtccaagtgaaggggagaagccaaatacggtacatggatagtggttgctcaaagcatatgactggaagaaagaaccagttccattgagaatgtctgttgatagatggcttgaaatatagcctaatcagtgtatcacaaatgtgttacagaggtaacttagtagcattcacctctaccaaatattttgtgataaatattaccacggacaagattattttgcaggaaaaaagagtaaataatatatacattatagatctgcccactctttcagaaaatgaactcacttacttaagtgtgttggacaatgatcccctgctttggcacaaaagacttggacatgcaagtctaagtcaactcaacaaattagtctccaaggacctggtgatagggcttcctaacatcaagttcaaggaagacagtttgtgaggcttgtgcaagggggaagaaggtaagatcctcttttaaaagcaagaaaatggtaagcacaaccaggtcgatggaactagttcatatggatctctgtggtccaatgagaacattaagcagaggtgttaaaaaatatgtgatggtacttgttgatgattactctaagtttacttgaacattatttttaacatctaagtatgaagcatttgacatgtttactgcctttgttagaaaaacttagaaacaactaggtaatcaacttgcatcaattaggtctaatcatgaaactgaatttgaaaatgctaagtttgctgaattttgtgatgagcattctgcctctaggactccacaacaaaatggagtagttgaaagaaaggataggacacttgaagatatggctaggactatgcttttttctagtaaactgccacatagcttctaggcagaagctgtaaacacttcatgttacatcattaataggtgcttgaccagacctcttgtagagaagactctctatgagttacttaaagggagaaaaccaaatatatcctatcttagggcatttggatgcaagtgctttgtgcacaacaatggaaaggacttcctatgtaagtttgatcccataagtgatggagtattcttgggatatttttcacatagaaaagcttataaagtatacaacaaaagaactatgtatgtagaagaaagtttacatgtagtctttgatgaaactaacactctttctgagagacaggaacataaagatgaagctattgggctggtaaaaggtttaaatggagtcacagtccaagctgaagctgcaccagaagaaggaacaggtgatggaataggttcttccgtctagggcaacctgacagggggaaccgaataaataagaactgaatctaatgcccaaatggaacctatccatgaggttgttcctcagcaacagaacataggagaaatgtcaaacagaaaccagttggttgtgaaaccttacaagtattaaagttctcatcccattgagaacataattactaaaccaacttcgggaattaaaactagatctgaattaaagaatatgtgtgcttttgatgctttcctatctcttattgaacctaaaaatgttgttgaggctttgcaggatgcagactggataaatgcaatgcaagatgaactcaatcagtctgaaaggagtcaagtttggcatctggttccaacccaaggacagatcagtaattggtacaaaatgggtcttcagaaacaaacttgatgaagatggaactattacaaggaacaagtcaaggttatccaggaggaaggcatagactatgatgagacctttgctccagttgcaaggttggaagcaataagactcctcatagcatttgctgtatatatggaatttactcttcaccagatggacgtcaagagtgcctttataaatggctacttaaaggaagaagtgtttgtcaaacaacctgtagggtttgaaagcaaggagtgcccggatcatgtatacaaactagacaaggcactctatggactcaagcaggctcctagagcatagtatgaacgactatccaaattcctgcttgaacatggctacaagagaggtaaaattgatagcactttattcttgaggaaaaaggtaaggatcttcttgtagtataaatatatgttgatgacataattttttgggcaaccattgaaaaactaagtaaggaatttgctaaacttatggggagtgaatttgaaatgagtatgatgggtgagcttaatttcttcttaggcttacaaattaaacaaaactcaaatagaaccatgatccatcagtagaaatatgcaaaagagttgattaagaaatttaaaatggaagaatcaaaggaaatagacacttatattgcaacagccacaaaattggacatagatgaacctgattcatctgttgatcagaagttgtataggggtatgattggttcatttttgtatcttactgctagaatacctgacattatattcagtgtagggctttgtgctcgatttcgagcaaatccaaaggaatcccacttgactgctgtcaagagaatattgagatacttgaaaggcattactgacctttgtctttgttatccaaaaggtagtaactttaacctagtgggatatgttgatgttgactatacaagttttcttgtggataggaagagcacctcaggtatggcacacttcctcggttcatgtcttgtgtcatgggctactaaaaagcaaaattcagtggccttatccactgctgaagctgagtaagttgttgctgcttcctgttgtgctcaattgttgtggatcaaacagcagttgatggattttggtattgaagttggttgcatccctattttctgtgataacactagtgttcatcataagagaattaagcacatagatgttaggcaccatttcttgagggacaactatgagaaaggcttgatcactatggaattttatgctactgacaagcaaattgctgacagttccaagtacctgtcttttatttctagttcaattatagtaggtgtttttatattgtacctttcaacttatctagaagcaattgtattaggtactcaaagttttcaagttagagttaacgtgaagttgtcgcaacagttcaggtagtgtgctacaacgggattagagttaatcctaggtttacaaaagagtttttgtaaatgtagtttttggctcagtgattttagtggagagtttgggaaaattctactggaaagtaggtcgtattttttctccttttgagccaggtatttttcacgtaaaatctctgtgttctttaatttctgtactcattattctgcaactgtagtagttggaacgcgtagaagaaccaggtccttccataatcagtttaagcgaaaaattggtcaccacataaatcacccctccccctcttgtgtggtattgaaatataaaacatcacttccctttaacctcgattttttattttacttgagctcgatttttcccgcgttcggtcatgcccgattcttggcgtgtccttcatccctccgagttctgatctgtaggaggccttggcttttacccgacctagtatcgaaccatgttatctctcgtatcttcatcaaaatcgggagtaattttatgtccgattttatcggtacacaactttcttcaactaaaactgaggaaacaaaaaagacagaagtagccaccactctgtgggtactatcttcacgtttctgagaatgtattggacctttatttcttaaaatagaaatatagtacactcttttcttgcatttgacagatcatgttattactagatacaaaagtacacatatgctaggcgtgtcctttatatagattaaatataattccgttaacaaaggatctcaaatgactgaaattttcagaaatgaacgtgactgcagttcattgatctacattttaacggataaactgttaacccgttaaaatattttatatttgtatttttttacacctattgtatattaaatatccttttcactatttgacaaagtagcagttatgattcgcgttcagaaggtatagtaagacactaactgttatgttttatcttagatgctaacttagtggtattagactattgaaaattcactttcaaattccaatgacctctgtcggttagtgaaaatgtacttgcatatggctatatgacttgatgcaatagcagaaagaaaagagccatacacaacattaatttagtatatggctattacataaatttagtcagtgacttctggaaatagtttgaatattcgggcatgacagtgtcatataaacgggttgaattcaacatttaaatttagtgatttaatgtcaagagatatatgtactcattatctatttgatttagccgataaatcacccgataaccgtccgataattgttaaaccgatacaaattcgatgttgcggaagccaaatatatatagtgtgaataagtcacaactactataccaaaaattgtgacagccaccaaataataaataagacaataaagcaacaataaagggaacaccagaatttacgaggttcggctaattttgcctactcctcggacacaaccaatattttattccactccaaaaatacaagtgaaataatattaaagagagaagatacaaatgtcttaaacagatgagaaggcaaatgagaggtgtgtttaaatcctaaacattagaccttcttttataggggaaaatcccctccaaactcaagagcccaccgatgtgggacaaagaatttgccaaacttcaacaaatctccaccttgaaaaaatttcacatcttcaattttctctcaataacaaatttcaaatttttgattgtgtctaaatcttcaatcttcagtgttcaacaatgttgatcaaatccaaacaatgttgaaacttgatcgcagtcaccaccttagtcagcatatcagcaggattctccgtggtatgaattttcttcaccgcgactcctccgtcttctatgatttctagtacgaaatgataccgaacatcaatatgcttcgtccttgcatgataaacttggttcttcgctaattgaatagcactttgactatcacaaaaaattgtgatacctttttgttcaacaccaagctcctttagcaatccttgaagccaaattgcctctttcacaacctctgtaatagccatgtactctgcctctgttgtagacaaagcaactgttgactgcaaagtagacttccaactaactggtgcctttgcaaaagtaaacacataaccagtagttgatcttcgtttgtccagatcacccgcaaaatctgagtcacaatatccaactacagactgattgtcttcctgctcaaaaactaacccaacgtctacaatattatgaatataccgtagaatccacttcacagcttgccaatgctccttccttggattgtgcatatatctgctaataactccaacagcttgtgaaatgtcaggccttgtgcaaaccattgcatacatcaagctaccaacagcatttgcgtatggtacctttgacatatactctcgttcagcttcatccattggcgacatagtagtacttagcttaaaatgggaagcaagtggagtactaactggcttagtcttgtcatctatgccaaaacgtttaagtactctcttcaaatattccttttgagataaacagagtttctttgaatgtctatctctaattatctccatgccaagaattttctttgcctcacccaaatccttcatctcgaactccttcttcagttgaatcttcaacttatcaatttcttccgaattcttggaagctatcaacatatcatcaacatataggagaagatataaaaaggaaccatctttaagcttgtgcaaatacacacaatgatcgtatttgcttctcttgtacccttgccgcaacataaactcgtcaaatcatttgtaccattgtctagaagattgtttcaatccgtacaacaatttttcaagttttcacaccatattttcttttccagaaactttgaatccttctggttgagtcatgtagatttcctcctccaagtttccatgtaaaaacgcaatttttacatccatctgaactagttccaaatccaattgtgctaccaaagccaacataattctaatggaggaatgttttagaactggagaaaacacttcattgtactcaattccctccttttgagcatatcctttgaccaccaatcttgctttgtagcgaacatctacttgcttaggaaatccttctttctttgcaaatactcatttgcacccaattgctttctttcccttcgagagattggccaatctccatgaatgattctgatgaagggactgtatttcatcattcatggtaatcctccacttatcttcttctgaactttggacagcgtctttataagtggtaggaacatcatcagctacaattgaggttgcacaagcaaccgtctctatgagacgaacaagtttcgttattgttctttttggcctgctggttgctattgattcaagttgttgttgaggttcctgagttggaatctcctctactggctctccttccagagggtaatcttaatttgtttcctcctctgcttcttgtataggaaaaataaatttttccctcaaactctacctgcttagaagcaccttcattttgtttggtatcttctgttaccttttttaccatagcagattcatcaaaggtaacatctctgctgaatattactttctttgtcataggacaccataagcgatatcctttgactccagaagcaattcccataaaaatagccttctttgcccttggatccaattttgactctgtcacataataatatgtagttgagccaaacacgtgcaaagagtcataatctacagcaggctttccataccatttttcaaatagtgtcttgccataaatagcagcagatggtagatgattaatgaggtggcatgcatatgtaattgcctcagcccaaaattcttttcccaagccagcattggacaacatataccgtaccttctccagcaaggtccggttcatacgttctgccactcaattctgttggggtatatgtctaacaataaagtgtcggacgatgccatcattttcatagaccttattgaaatgatcatttttgtattcacctccattgtctgtgcgaatacgcttgatcctcctgcctgtttgattctccaccatcgccttccatttgagaaaaattctcagcacttcatctttgcttttcattgtatacacccacactcttcgggaaaaatcgtcaacaaaggttacaaaatagtgcttcccacccaatgaaggtgttttggaaggaccccaaacatcagagtgtacataatccaaaatgcctttagtattatggatcgttgtaccaaatttaatccttgtctgtttccctttgacacaatgctcacaaaactccaagttgcaagcctttactccttttaacaatccttgatctgatagagttttcaaggattttcctccagcatgtcccaagcgcatgtgtcatagcttggttgcgtctgcctctttgtcgtcactggatgtcactgtcactgtcccaataactgtactgccacgatagcggtacatattattattcttccgattagccttcattaccactagtgcactggagcatactctcatcactccattttctgcaatgattttgaacccttttgattctagggctcctatagagatgagattcttcttcaaatccggtacaaatcgaacatctgttaatgttctgatcattccatcatggttccttaatcgtattgaaccaatgccatatgaggtaagagggctgttatccgctgtgtggatgactccatattctccttcttgaaattccacaaaccagtccttgttgggacacatatgatagctacaagccgagtccatcaaccatatgtctgatgatgtttatgactctgttgtaactaatgagaagtctgaatcatcacaatcagctacatttgaatccataatggcctttccattgttatgtttggccttattcttcaacttcggacagcctttcttcagtgccctttttctcgacaaaaggcacattcatctttgttgggtctggatcttgacttggatcttcccttctttgtcctcgtttgattttgaggacgaaccctcacaaatagtgcttctccttctccgtacttctatttttctcactttctttgttcatagctgtacaaagccgaacaaacttctctgagagaaacttcgtcatttccatggagtagagtagtttcaaggtgctcgtactcatcaggaagtgacgccaacaacatcaaggccaagtcaccatcatcataagttgtatccatattttgcaaatctgtgaccaacttattgaaactggtgatatgttcattcatcgtggtaccgggaacataggtgaagtgaaacagtctcttcttcatgtacaatttattttgactatttttcttcaaaaatttatcctccagtactttccataatttacttgcagaagtttcctttgtgtatggagatttctgctctctaacaaggaaggatcgaatggtaccgcaagcaacacggttgataatttttcaatcttcttctccaataacatctggtctcttttcttcaatggcaagatctagcccttgttgaaaaaggacatctagaacctcgccttgccacatcccaaaatgcccggacccgtcaaaaatttctaccgcaaatttcgcatttgacataattcttgtcataagcgaagatgtcaatgatgacgtatttttgacacttgatatagattcttcttgtttattgtctcccatatttgacacaaatattatttaatagctgacgacaaaaatcgagattatttcctttctgatgtagaagatcagactaagctgcaaccacagagcatactcagacagaaccttgactcagttaccaagataaatcttttctgatgtggaagatcagactatgctgcaaccacagagcatacttagacagtatcttggctctgataccaattgttgcggaagccaaatgtatatagtgtgaataagtcacaactactataccaaaaattatgacagccaccaaataataaataagacaataaagcaacaataaagggaacaccataatttacgaggttcggctaattttgcctactcctcggacacaaccaatattttattccactccaaaaatacaagtgaaataatactaaagagagaagatataaatgtcttaaacagatgagaaggcaaatgagaggtgtgtttaaatcctaaacattaggccttcttttataggggaaaatccccccaaactcaagagcccaccgatgtgggacaaagaatttgccaaacttcaacattcgcccgatatcttattggtttggctagcggattagtacatttacgagccgataaccgataagtcgaaccgttaaatgtaacaatgcgcctgatccgcccgataagcagtcgtaccaaaatctaatgaacccatagattatacattggataccaggcaatattctcatgaaagaaaaagaagaagaagaaaaaaaagctgctggacgacgacttgtaaatgctttctcttacgtgacctttcttttaacgagattaattagttgacagataaatcacttccaaaaatgtcgtttgttcttctgcttcccttgttcatataaagccttaacacttggaggggaaagatgaatgttttgtattagaaaagcattgatcattgtgctagtgtttagtttggtaaaaaaaaaaaaaaaaacatgtaacaaatgataatcgtacaaggagtagtatatggtataaggatcgtgcttcaataatattttgaatactaaagatcgagaagaatgtatagatgttgattgagctaagtgaaatgagttttttttattttaaaaatgaaaatagagggaaaatttccacacccatcaatgatgatccctttaggtgaaacgattaaaaaagatttcatcaacaagaacattttataaaatatttactcttatcaaacacaaataagtccctccatcttattttgtaggcatatttccttactagtttgttcctaaaaaattaatatattatcttaatgataaattttatagttaatcacacaaatattgttgtgtcatgtttaagccaaaaagttttagtcttatatccacaaataatactatgacatgtttataattgcaagtttcaaaaatattttttgtttttaaatttcgtgtgaagtctaacaatgcaaagcaaattgaaatagagggaatatattatttctcatttactatattttttttttttgcctccctcttcttatcaatcgagagcttcccacatgccaggcaccaaaaatctataagatcttccacattgtcataaagaaaatcattaattttatttggtgatatttcatttcccaaaaaacatatataaagagaagaatccaaagtaaaaaaagtagttaagcaatatttacctgtgtttatccttaaaataagtaacacaatcaaatttgtactcgatttaaagaaaaaataatttaatttaacacgaataatttaagaacaacaaataattaaattaaaagaaaacaaggcgaccaaaccaaatgtgataaaacaattaagctttgctttaagtttagatgctgaaaccagtctcgatcgagtcatcgaagtgggttcacttgatactaaataaataaatagctgaagaacactttaaacaataactagaaggcacagataaacttttattgctttgatatatgtgttcacagtgcctttaaaagcaaaaggttctctcatttatatagcaagatagtttcaattctagtacaagtctaaataaggtaaaaattcttttttcctagtaaaacataatttgtcgttgatatctggcgtgatccgcgccgtaatattcgattgatggcagatatttcggcccctggttcgtcctttccaacccccttccttttaacctcaattttttattttgcttgagctcgatttttcccgtgttcggtcatgcccgattcttggggtatccttcatccctccgggttctgatctgtaggaacccttggcttctgcccgagcaagtaccgaatcatgttgtctcgttttttcatcgggaaattggggataactttattcccaattttaccatacacaactttcttcaactaaaattgagcaaaaaaaaaaaaaaaagaagagagagacagacgtagctactactctatgggtactatcttcacgtttctgagaatgtattggacctttatttcttaaaatagaaatacagtacattcttttcttgcatttgacagatcatgttattactagatacaaaagtacacatatgctaggcgtgtcctttatatagattaaatatatttccgttaagaaaggatctcaaatgactgaaattttcagaaatgaacgtgactgcggttctcgagatatatcatttctttaattgaagatcagtacattatttaatttatcatcaaacattattagaatactacttcctctacgtgaacctgtttgactgggcacgaagtttaaaaaaaaatgaagatttttagaatatgtggtcctaaacaagtccaaatgggccccaaagtatttgtgtggttataaaagcttctcattaagggtagagttcattctttttggaacggaccaaaaagaaaataggttcacgtaacctagaacacagggaagtaataaaaataaaaggcataacgtacacgtggttaaaattgcaccttcgcggaaattccaaaaggaaaatgaaggtactgcagagtctagagctacaatttgaagggcaagcgtataaatagacgcacgcaataagccctagtaagaacaagttcagaaactattcatcaaaaacctaattagggcaaaaaagaaaaaatgaatccccttgataatgcaaccttctttttctctgaccttgattttcttgactctattgagcaccatcttctgaatgattccgatttttccaacagtttttcgccgattagctcgagcagtgtcgcaactcctaatagtcctagctcatgtttttgcagctgccttttggatgaaaacattgaagaaacaacaactctcgaatctcaatccgagcccgaggagccaacgcaaggcttaaaggcggcgcgtgcggaaaacacgaagcaaaattggaggcggtacataggagtgagacggcgggcttggggaaagtttgcggcggagataagggacccggagagaagaggcgcgagattgtggctaggaacttatgagactcctgaagatgcagcattggcgtatgatcaagccgctttcaaaatccgcggttcgagagctcggctcaattttcctcacttaattggctcaaacatgcctgagccggctagagtaaaagggagacgtcataattcacgctcactggagccatcgtcttcttcatccaccacatcatcggaaaatggaagaaggaaaagaaatatagaggtcataaattctatagccaaagccaaattggttggtcatatacgcgatctagagatgtcactataactaatggaaaagaagagttttcagttcttttttcaaatgtcgtaacattactgcataaataacttactgttcaatcatgttattttcgctagtatatatgttcattatttatgttttgtacgtagtaattaatggggtgtttcaactttgtttgagcttcatagctggccaaggtactttgcggagaaagcagatgcaaagcagacaaaggagatgacaaaagtaaagttaggctcagaaaagcgtaaataaggaagaggaaagccgaaaaagaaagcgggataaaatcccggagacacccaagtcaagcagcaaaaaatctgaatttggaccttccacgagtaaatggacggaaagtgcaaaaaccaatacctcagttccagttccacagaaaactgaaaaaggatctggcaaagcccaaagtgatggtctcaagggaaagaacaggtcccacggatgaagacactcaggtgaccactttagctgaaaaatctgcaccaagcatacgccgagtgaaaattatgcgtgagcttggtttgatggctccttctggccggtatccatttcataattaaggggaacatgtttcttcatttattcccaagggacatgtttctgctccttccaggtcttcatctcatcctaaggaacgtcttcctccaattcagagaatagttgtttgtggtctatctgctgctagatccgttatgaagtagcttttgtttctccgttggtaagtcagagtcagacatgatatagactgctgaaactcccaaggtagtgctgaagttgtcatattagagggggatttagactgctgaaactcccactactttttctgacgcagagtttaaagttagtattaagaatgtatctttacaacatttttactacatgtataactcgaacaaaagacagcgggtgaataaacctgctgtctttgccaggttgttgcgaagttgtaataccaattgtagaaatacacttcttttcgcgttccccttcatagtggatgcagctaagatgcctattgagtagagcacgagatctgccactacaacacgtctacagagaggctaaccatgcggctgattcgatggcgaagaatggaagcagcttaccaactcttggaagcttaagaacttatctaattcctcctacttttgttatttcccatttgtaataaactatgtaatgactcttagtatgtgtttttaataaatgtctttattaccaaaaaaaaaaaaaggatgcagctaaagaaacctgagagtaattgaggggtaaatttcacaaatggtcatataactatgactttttttcatcattgtcaaataacttcgttttctcacacaaaaatcatagtggcagaaaaataatttttttggtacgattttgttattttactttttttattttttattttcaatctaataaataattatccaattaaaataggaaaaatactaatatatttttagttgttcccaaaaataatagccgataaaaaatattatatatatatatatatatatatatatatatatatatatatatgtgtgtgtgtgtgtgtgtgtgtgtgttttatacatataatatacacattctatatatattttggctagcaaatacaattagtttcgggcggtcgataaattttatatttttctctttaaatatgaatgacccaatccagcttgacccaatacccatatacgtaagttaaaataatactaaaagtgaattcttccctcataagaaactcagttcggaatgcataagattctgataaaaaaaaagaaaataaaaggtataattagagagcacttgaaataaaattgttatcgatttgaataaaatcttgaaaataaaaataaaagatagaagtatcatgttttgaagaatttaatattcattcctattttaattgagttattatttattatactgaaaataagaaaataaataacaacaaaacaagaaaatactaccaaaaaatttatttttcggccactatgatttttgtgtgaactagtgaaagttttatgattgtgtgagaaaacgaaattatatgacattgatgaaaaaaagtcatagttatacgatttttgtgtgagaaaataaagttatatgattttgataaaaaaaaaagttctagttatatgaccatttgtgaaattacccagtaaatgagggttaccctcttaaaagaaaagaaaaaaatggagtagtaattaatgttagatgtttgttctattttcttatgagttttttttcttttagaagcaaattataaatcaccatatttggttcgtcatttttcttgaaggaaaaggttttagacttctataagttgaggatcattccttctcatccagtagcatccacaatataatcataaggagttggagagtcttgtttgggggagaactttttaggacaagtgttagcgtgccacttgtgtttgcctctttgtgttgttgttctctcgatattttgtactatcttttatatagtggattgctcatctccgctcgtagacataggtcaattgatcgaatcacataaaatatttgtgtttcatttgatgttttgtttttgtgtgtgatttattgtcgttcaaggtttgctttactagcttccgcatgacatctgattattttgatcctagcaattaatgctcattaaatttgcataattttttcaaggacgaaaaaatgtcttttagaaacttgtttaaaaaaattatatttggatatccgcggtttaaaaaacgtctttttaattagaaaacatatgctgtttaattaggtatatgttctctaagaagttgaaaatattaactctaattctttactttataaaactatcaataatttcaactcattaaaatttacaagtaaatcaccattctttaaccatgtcaataaaatactacttctataaggtatatattcaatgtttaatgatttagaaactgatattcggcaatcaattccggtttgtaatgatccaccttagtttctcatttcaataacatccggtcttctttaggaaagggcaaaaaaaaaaaaaaaaaaaaaaaaatatagtagttaaagtagacttgacccgtactgtaggcttcctcttcacttctgcaatttggacacaaaaacaaaaaaaatcataatcatatgtaatcttctctaatattgcacatgcgtatttgataaatttaaattatcaaagactttttaattccctacactgtatcgtcgctgtacttgaatgaatatactaatcatcaaggttctttttgtactcatttttttatttattagatgtgtactttctctaacaatcatagagccatggtggtactaattattgttaaagaagtggctgaacaaatttcagaatattcacaaaaagtgtcaaatttagagctcccccatataaaattaaagtcgatgcagctcgtctttaattaacagatatatttaagtgaattatcaacccagctgatgctacactttgatattatgatgctccaccaactggaaacgaaaatgagaaatcaaataggtcttgaaatataatcatgaatttgctgatattctaaaggtcgtcccaataaacaaattataattaaagagaagaatccatagtaaaaatgtatttaagcattaaggggttgtttggttgaatgaagtagataaaataatgtatgtattagataaaatagtgtatgcattagctttgtatactaataatatcttgtttcgtacattttttaaacatatacattagtcacgcaagcatttgttatacaccttatttggtattatcctatgcataactaatgcataggaaatcatagtattaacaatgcaatgattttaatgcatgcattagcttagttaaagacaaaattgtccttcaaaatttatgcttgattaaaatatgctattatattaatgaaagtttgaaataatccaagaaagggaaaaataaaattatatccctagtaaataaataaatacttagcatatttcctctttataaataaatattcaattctatactaaaatataggtagacaaatcaaatagtttttgtaaaacctttttcatataaaaacactcctcaatatatgtttttttataaaaagataaagtgatggactggtcatcaggatatttttgtaaacaaataattcttttagaaattgtacaatattttaatacatcaaatcgaaaaatgaataaaaaaatatgtcaacattaatgccaacataactaatatcatcattattaataaaatatattaagcattattcttctgcatcctaccaaacgatccctaaatacatcttaatcttcaacgaaagctgggccgtgaaatatcgtgtgctagtattatatcctcgcgaggtcacatttcgaaaatatactggacctttctttcttgaaatggaaaataaaatgcttctaaaatttatcagctcatgttatcagaaaaccagtaagttttttgagaaaaagttatacatatactaggtttgttctacgaataaatatctctgttttaaagtactgatctcaaatgataatgaaattttcagaaatgaatgtgaccttatcgtgatgcgcaaacatcttccatatctcaagagaaatgtatactcgttacttacgtttcaatttagatgatatatttcgacttgacacaaagtttaagaaaggaaagaaaaattttgaaataagtggtcctaataatttaaggggtaaatctttgtgagattataatatttttgtggctataaaatcttataattaaaggtaaaatgagtaaaataaaaaaatttaaagtcaaattattttttaatataaaaatgtgtcattctttttagaacggattaattaataagaaaaatatatcatttaaattaaaacacaacgagtagagtatatcatttcttgaaattgaagatcagtacattattttattcctcgtcaaatgttaagataataaaaactaaaaagcataacatgtgcttaaaatggtaccttcatagaaattccaggaaaaaaaaaaataaaggtagggactagagctaaaattataggccaagcgtataaatagacgtacagtatcaatccttccattcgtccagaattaataaaccctagttattagtgaaagtgcaagaaacatttgttccaaaactcttagagaaaagaaaatgaattcagcagatgtaaccttctctttctctgattttaatctccttgaatccattaagcaacatcttttaaatgattcagatttttctgaaactctgtcgcctatgagttcaagtaacggattgcctaacagtcctagctcaggttttggcagctccctttcagcagaaaatagcttcgaaatctccctttcggaccaaaactttgaggaaacaataccaaatctcgaagaaaagtctgagtccgaggaggaaatgaaggggaatgtggtggcgcgtgagaataacgcgccggaagattggaggcggtacataggagtgaaacggcggccatgggggacgttttcagcggagatgagagaccccgataggaggggggcaagactgtggttaggaacttacgagaccgcagaggatgcagcgttggcgtacgatcaagccgctttcaaaatccgcggctcgagagctcggctcaattttcctcacttaatcggttcaaacatgcctaagccggctagagttacagcgaggcgtagtcgtacgcgctcacccgagccattgtcttcttcgtccacctcatcatcagtaaatgtaccaagaaaaaggaaaatagatgtgatcaattccatagccaaggtttgtcatggttggaacctccacatgttactataactatatttggaagggttttttagtgttttagtattagaataacaatttttatttttttagaactaaaacattttagctcactccctgttagcccgctaacttcaagctgggcctcaaagcattggttaattgttaattacccttccgtcttatattatgtgtcatgtttttcgtttatacacctcttaagaaatactaattgagaaaggaattgtgtttgcaacaaattatttgtgatacaaatataaatcgtaaccacaatataaatatgaagaaacacaattttattgataaacaatgtgggtacaattctgtttatcccttgattcttccctccgctttattctaaatgattcgacggtcttagcggtgtatttctcgaacatagaactttaagcaaaacatatttgacatgtctttgatctcttaatgaatattccaagagtttcatggaatttcggagatctcatatttgatctctttgtgcatattacgagagtttattgaagtgttgagattgtctttgaagaacatatatagccttatttataggcatgaattagggtttgggtgaagtagccaccaagtaaccctaatagactcctaatatttcaagagttgtcatgaatttaggatttatcttgatatgttaaaatttcagtgtctacagattggactattctacccttatctatgtctcaagatataacctctcttcattgaatatttaatctatttatatgttatctccatctttaacaacaattattactatgggtaaaaaagaaaaaaataattaattttgtcttgaacttctaaaatgacaaataatttgagacaactatttttagtaaaccacgactattaatatgagacgggggagtagaaacaattcctttattgcaaaagtcaaaaggtttaatcaaaatatatttgctccaatttgcatttaagaaaattacggattttctaattcaatgatgtacctctcgatcgagagtatttacactgctgtaattttgtttaattagttctaataaattgttaggagtactctgtctaacactttatagtttggggtggtgttacttcaacatgttcccatgaaaggtggaggcttccaattcacttctgcaattttaaaacttatcataaattaatcatggaatcttttctctttattgcacatgctgtgttctgacaaatttgtactattaatttactttacaatttccaacattggatcatcacgtataaacaattaaaagaaactatataatcaccaaggttcataaaactaacagccaattctttaacattccaaaacatagctttatatgctggttgactatgcagaaaaagctacccacaaaggacagactggcgcatagaggtatcaatacagacggcatgtgtgttctatgtggtgatgcaatagagactgctggacatatattttgtgaatgtcaattctcaagaagatgcataactacaattacagtggctaaaagtcaatattacaaacactgaagaatatggagaagagtagcaagaaaaatgggaggtaagctaagtagagaatttgcatttgcagctttggcagcgactacctatcatgtgtggaaagggaggaatgaagccttatgacagaattcagtccctagaccataaaaagtatctgaacaaatcaaagaagaatgtaaaggcaaaatgcctcatattccaaaaaagttcaaaacgcctgatatttcaaaatatgatggaacaacagacctacgagatcacgtgactgcattcacaatgggcgtaaaaggcaatgatttgactaagcaggagattgaatcagtattagtcaaaaaatttggtgaaacgctcaccaaaggagcgctaacatggtattctcttttacccaaaaattctataaatttttttgctgagcttgcagattctttcatcaaagcacactcgggagctcaaaaagtagagaaaagaatagaggatattttcaaaattaagcaaggggactcagaactgcttagaaaattcatggacagatttcaacgtgaaagaatgacattgccacatgtacctgacaactgggcagctatagctttcacaaataatttgaatgaaaaaagctcggaaactacgaggagactcaaggaaagccttcgagaattcccagctacaacgtggaatgatgtttataacaggtatatcacgaagctgaggattgaggaagatactgttccacgatttcaaaaagaagaaaaggtaagttcaagacgtgcggagaccgaaaaaagatccggtaaaaacaggtacgagccttacatgggacctgcgggaaaggactcatggtcaaagcaggataatcaaaggtacgatcacagatcaagaaacagagaatcaggttcttcatcaagattcaggaacgagcgaaacaactatgagtcacgagatgataatagaaatttaaaagcgagattcggtggttacaacttcaacatcagcacctccgagctcgtagttgttttgagaagcatgggagataaagttcgatggccaaagaaaatgagatcgaatccaaacaggcgcaaccctgaccattggtgcgagtttcataatgaccacggacataaaacaacagattgtagatttttacaaagtgaagttgattatttattaaaacaaggatatcttattgagttgttcagtgagaaaggcaagcaagcttacatgaagaacaggcaggagcctccaaaaccaccttctcccaaaagagctgtcaaagttataagtgggggtgaagatgttaatagtatatcatatactgcagctaacaaaatttccaaagtaacaattacccaagggaaatgggtgcggcatgttttagaggaagacaacattacattcaatgacacagatgcatatggcatattaacccctcataacgatgcactggtaatatctttaattgtacatgatactaatgtgaaacgagttttgattgatccaggtagttccgtgaacattattttgctaagagtattacgtgagatgcaagctaaagataaagtgataccaaaggcgcatactctatgaagatttgataattctagtgtcctcacgaaaggagaggtaacactcaccacattcgctgaaggattcgtcaaagatacaaagttctaggtggtagatatggagatggcttacaacatgattcttgggagaccatggatccacgaaatggatgttgttccttcaaccttacatcaagttattaaatttccatcgccatggggaatctgtcaaattcgtggagatcaacatacatccagggctatcaactctgttgcagatacaagcacgagaaataaaggtaaatagcaatcacagaaggcagttgaggatatcacaacacaaacctcaactgaacaagggcaaacagatgtagactcaaggcttgatactattcaagaactagaagagaatgaaaatatcaaaacaacaatagaggaattagagcatgtcgtgctatttgctcaatggcctgataaaaaagtctatgttggagccaatcttagccaaggtatgagaggtaagttaattagatttttgaaaattaacatggactgttttgcttggtcccactctgacatgacagaaataccatcggaggtgatgactcataaactaaatgaagatccatcataccctcatgtcaagcaaaagaaaagaaagcaaggaactttcaagaatcaggtgattcaagaagaagtccaaatattgctaaaatttggttccattcgtgaggtaaagtatcttaactggttagctaacactgttgtagttccaaagaagaacggtaagtggcgggtttgtgtagattacacagatcttaataaagcctaccctaaagattcttttccactaccacacatagatcaattgattgatgcaactgcatgtcacgaactattaagttttctagatacatattcaggttataatcagattaaaatggatccgggagatgaataaaaaacttcattcataacagacagggggacttattgttataaagtaatgccctttggtctaaagaatgcaggtgcaacgtatcagaggttagttaccaaaatatttcaagagcatttaggaaagactatggaggtatatatagatgatatgcttgttaaaactcagtattcaaaaggtcacatatcacacttatctgatacatttttaattttcaaatttaatatgaagttaaatcccgaaaaatgtgcatttagcattgcatcaggtaagtttttgggttttcttgtttctaaccgtggtattgaagtgaatcgtgcatagattaaggccattgaaaaaatccctgatatactttcaaacaagaaagaagttcaaagattaacagggagaattgcagccttgggaagattcatttctaaatcatcagagaagtgttttaaattcttctcaacccttaagaagcaggatcattttgaatggaatgaggaatgtcaacaggcactcaggaatttgaaaatgtacttatcaaatccacctttgctggcaaaaccaaaggctggggaaagactactcatttaccttgctgtttcggaagttgcagtaaacgttgttttggtaaatctttgttagatgcggaaatgcggtatcttcagttagaaaaacttgcacttgcattaatcatggcatctagaagttaagaccttactttcagtgttatcctatcgctgtagtaactgcctaccttttacgtaatatattacataagcatgagttatcaggtaggttagttaagtgggcaatagagttaagtgaatacgaaatcacataccaacctagaactgctataaaatcacaagtgttagctgatttcgtggctgattttagctaggggatgcaattaaaagcagaaaaagaattacaggtattcaatggagctaacccgggaacttggactttattcactgatggctcatctaatgtaaaaggtgcaggtttagggattgtcttggtaccacctacgggtgaaaacattcgacaagctattaaatgtcattccataactaacaatgaagtggagtatgaggctgtgattgtaggtctagaattggcacgagagcttggcataaatcagattataatcaagaatgattcgcaactcgtggttaatcaaatgctggggacttatacaacttgggaaacaaggatacaacaatacttagaaaaggtacgggaattgataaagcaatttcaaaccaggaaagttatacaaataccaagggatgaaaatattaaagtggacaccctagctaatctcgcatctgcagctgatgtggcaagtgatgcaaacacctcagttatacatttatttcattcagttctcgatcctgataagaatgaggtaaattttaataatttaacttgggattggaggaatgagattgttgcttttttgcagtatggtatcgtccctgatgataagaaaaatgctcatgcgcttcgaaagaaggatgctcggtactgcttaaagcaaggcaatttatatcgtaaaatgttcggtggtcccttagcaagatgcctcggacctttgcaaacggagtacgtaatgaaagaaatacacgagggacattgcgggaatcacgtaggaggaaggtcattggtaagaaccttaattagggcaggttattactggcctaaaatggaagaagaagcataaagtttcatggccaaatgtgataaatgtcaaaggtacggtaacaatatgcatagacctgcggagttattacattcggtcattgcgccatggccaatggatatcgtgggtccgctaacacaagcaaaaggacaggtaaagtttatgctcgtactcactgattattttgctaaatgggtagaggcaggagcatttaaacaggtgcgagaaaaggaagtcaaagattttatttggcggaatatcatatgccggttcggtgtaccaaatgagatcgtgtgtgataatggcccttaatttattggagctcaaatcacggaattctttcaaagttggaaaattaaaaggatatgtctacaccttatcaccccgtgggtattggacaagtagaatcaataaacaaggttattatcaataatttaaagaaacgattagaggaatcaataggtaactggcctgaagtgttacctggagttttatgggcatatcgcacaactgcaaaaacaagtacagaagaaccaccattttcattggtttatggagctgagaaaccaatgtctattattcttcttttgtagggttataagaaaaaaaacccgtgtctattattcttcttttgtaaaactctgttaccagaaaaacagttatgagaaagttatagatgtaattcaaatacatgtaaagtattattcaaaacttgtcaaggttatttcaaagaaacatgtctgttcctatttcttttattgtatgataacaccattatgaagttgagacgtcttcttcattaagtgtcgaaatataaaagagccctcttttataaaactcatgtttaaattagttagtcatgagattaacagaagcattttcgaagaacaaaaatgcaaattattctataagtccttaaaaataaaggcaagaataaagcagacagaagtttaagataataacatgaaaaacttcttaatatttaaaaactgaagactaagtacgagcttagtcataaaactatgaaattgtttatacaaattgccccataaaaaacttggggacttgcattttcaaaaccatccctcaaatgaagctaagggtttgattacaattttccaaaataaaaacaaaaacaaaatcattcaaatgattaaaactggtcactgagaagtttgtggaactgaagaaggagcatcaatagcagtgggctcaatttgggcaggtgcatcaatagatgcggtttcaacttggcttgcagcaacaggctcgattgggcttgaaagagttgggatacccgtatcagcttcaacattcacgggagcttcaaccacgggataagggaagtcctgagtttgctgagctttttcaatggtttcattgatcttagctaactccgactccaggttgaagttttcttggtcagcttcaattagggtatcacgacgtgaattcaaaaatgcccaacttacctcaacatcagatttttctttaaggatctcataatcattttcccaatcagcaatctcattctttatctcttcattttcagccaaggcggagttataagaagcttgaagagaggcatgggagctctctaaggaatgcaccttatcagcagagactcgaaggtcttcttgtgcttgagttaagctttgcacgagctccccagcgtaaacttcttttgactcaaaagagccttcaactctctgttctctttactggccttagatagttgctctgagaaggaggattcgagacgttctttttctttttctgcttggcttgaggaagcttttacaaccgctagctctgaagttaaagtccacacctgctgctctaaggtattcttgctctcttgtaaatcttccatatcaatttgtgcactctcaaattgttccttccaattgatcgcctccaactgagaatcacgtgctatcttctctgaatcacatgctaccttctctaagagggggattttgtttatcatttttgtgccgataaaattggcctaaaaaaaggaagggaaataagaatcccaaagataaaaaaaatttacaaagtaaagaagggagagaaggaaaataccttcaaagtggcatgcacgatctcattcattagagtcagggaactatggctctccagctttgctttttcaattgggtcaattaaaggctccagccatacatctgccagacctgacttcctcaaaaggctgctatcagcaggaacttcaatagttaccctcctcatagcgacacttctacttgaagagcccactttcgtatgatgaacgataggaaggggaatagtcaaaggaggagcggtagaagaagtgaaaacagtagaagaaggaacagaaatagctggggctggtaaggaaggaatcacaggcacgggagttgaaaaagaagataagggtatttcatctaaaataggccctaaacttccactaccaaaaccaatgatgaaaagttgatcaatagactcacgggtatcataatgagtgatgtcatcgtcaagaattattactggggtttcaaaggttcggtaagagaaacagaaagacggggggaaacttcagcttcgtcatcagagacgatgcgtctcctagctcgtggcctcatcaccagggagcccccatcttcctcttcttcagaattttcctctttcaacagctttccttttcgcagaagaacccaagactatttcccgggctctttctgaagatatacgggtccccgaaggagtacgggttcccgaagagacacgagaggtcgcaactgcttcaacagtaactcctcgaatagcaaatcctgataaaaagaaggatgggagttagagaaataaagaaaaatatatatatgcatgaaagatgaaataaaaactcttaccatgagtctttactttccaaccgtaatggttagaaagtgttctccaagacctaccatctattggtgcggtcttcagcaatttatctacccaatcacggaaatttggaatatcctccacaactcccatggttgctaaaaaagggcaaaattagagaagttgataaaattgaagaaaaaaaggcacgagaaggataaaagacttacgtgcaaaattccacttcttatagaagggaacgttatccttacccactaagccaacactgggggcagcaacaaaccgggcataccatccacgatccttgtcatcttcagggctcaccaaaaccctcttactcctggccactagagtaaaaacgctattacggaaaagcctaggggagtaaagatgaatcaggtgagggaaagtaaaggaaacgtcagccatattggttaaatgcctcaaacatccaacagtcctccatatgattgggccaatttgacccaaacagacattaaagaaacggaaaaattcaagaatgactgggtcaataactggtttgaaccctaaagtaaaagggtatgtataacaaaagagaacccagtcaagtaagaagtaattctctgatttggattagggataataatgggaaaatcattactccaatggcaatctttgcgaactacaagagtcaaaacttttgtaatttgagtggggtaagtatcaccacgatctaaagcagaaacatgatttttaagagattccctatcatggtaaaaagatagttctgtagggactatctcctctactaaaggctcacgtaatggtttagaaggttctttaccactagaagaagatttgtgagaaagggaacctctagttctagaagaaggaccagaactaggagaatgtatatacgaactaccaccacgagtagaccctaagctacgaagcctacctcctcttttatgtctaatgggggaattggggaaggtatcaacaatgggaactctcctagggttagggtttggtgaagacatggcgaagaagaataatgtgagaaagaagtgaactgagatttgaggaattaagtgttcaataagctttatgtggtaaaagacaaggaaagaagttatatttatattaataagcaatcgtcaaagttaaaagtgcagtaatggaaggaccataataatgataactggcacttcgtgaatagtagagtcgtaaaaaagccttgaaaagggatgcaaaactgtagaaccaatggaaaaatgacacgtgtacggagcattaaatggaagcgacaattgaagcgtcaattttgtcatagcattaatagtgacaaaaattttcttttaatgaaatccactttccaaatattcaattgatgaataaatggaaagtggggggactatctgtattggaaaaaattgtatttaaatataaaggtgacgtgtcgagacacgtagactggtcaaatggtcaaagaattacaactagccaagaggcacgagttgcaaagatacgatcaaatggcagaggaagaggcacgggcagttattcaaataactcagcgcccgtacctatctaagtcatttatgtccgagaatcaaaggaatgaatctgacaatagaaaagagtgcagatacgacatttaataggcattaaatgtggaatacgttagagaatttgtattgaatgtaatgattatgtaacgtagcattcaatgtctttaattactcataatagcctcattatgatttgggcaaaacgtatatctccaaaatatctataaaagggagatatctgatcaattgtaaaaaaaagcactattgaaataaactttggtttacttttttctcttgattactctcttgctacctaaattacttccttttatacattcttttgattatcagtaactcgtgttcttctaaattctagctttgactaaaatttcattttttggttaaacagaaatattcaacaagcggaaaaaggcaaggatagaagatggatagaggatatatataaatagaagtatacatgtacaggtctttatataggtagaagctagaaggagctacttcactgtttttccttcattgtattccctttgttgttcccttcgttgtatttgttttggagatgaataaaaaaaattcgttccaccaaaaaaaaaactaatcgttaacaagtggaaaaacaaataactttataatacactaaaaaactaaaggactcctataattaatgtcgatacagcttctctttaagtaacatacatgcaggtgaattatcaaccctactgcaaattatgatgctaattatcatcttctatctatttatactatattaaaagtgagaagcccttagtcaaagttaaattgcagaaatgccccttaaaaaatctaaccctatttaataataagagcatcaaatttatgtgaaggggatgcgaccttcagaatagttacattacaaacaaatgtttcctatttataatttggtttcctactgttactactcttagttgattagacaagttttgggtgttatcattatttaactaatggtctacgtcacttgcatgatgaatgtggattataggatatgaattatagggatgcatttatagagaagatcaagtatttcaaccagaaaattgtaagcgcaaacttcacaaattatactgtgaaaaaaattcagaaatgtagaagacgaagaatagaataccctaatgtgctggacactttctatggattgggcaaaatattttagtagaaaagtcgtggaggtttatctaaatttgtcacaacacaagcagcgaaacaacaattgactgtgagaagcaacaaaaaataagattttgatctctttgtccccaaatcaacgtgacaaatggtgcagccaagaaaaaattaaaattcaaggtgaacaaaaaaaatggtacaaaaatcaagttctatttcttctctacttatttatcttcctttaccttttttaatgttgagaaacttattttcataaatgtttggataatgacaactcttgtaataaacgttaaatgcatatttgttgtgtttaggaatggcattagttaatgctatagttaactttgttattttattgctacaatgagatccactaataacgtaacatattatggttacatgcataaaaattatatatgtggaagtttactttaacttgtgggatgatatgaagcaattttatttggaaaatcatatatgtaaatcacgagaatgaataaaactttcatttggatattatttgggatcatgagaagaaacaactaaactttgattgtttatttttgtaggattagatgatatccaatcattttaacctcgacaaaatatcattatacgatgattcacattaatcgttatcagaaacttatacttattctttcacgtataattatttactcaaaacttttaataatatttatattgtattattttacaaaagcatggactacataacttgccatacacgataatgattcacattaattattatcagaaacttgtatttattctcacatataactatttactcaaagctttatttcaaaatatttatattaaattattttacaaaaacgtatattatataacttgacatacacatgcaacgcatgcggcgagaaactaatattatattataagtgggaagccttttagggtgaaagttaatttacaaatttacccaacaatagttgagtgacgattttatccttacaatcaaattaactattccacatttatgtacaaaaaaaatgtaatttcaaatgttatcctacatgctttgaacgagcatgataaagggtgctagatttaataaatactcgaattgaaacgtcaagttcaagaacttgaacgacaacgtcgggttagcttcatgttatctttcaattccaaagggtctggaatcataatttgtcaccctacctcttcttaaagatcaagttgatcggcttttcatcatacgtttgaaaattaaaaactgttgttaactaattaagcttttcagtcaattgataatttgccaagaaggagatgcatattctaatagtaggttactggtaagagtgtaagactatcatacagtacaaaatcaagctaggagagattgtcataacaatttctaccactgggtttatggtgtagacagtggaatacaagaacatacgattcaatatatggtgtagatagtgggtttttagagacattcttccaaaacacggaagagattatgagaagttcactggcttagtaacatcttcacaggtagagtttagaagccataaccaaaaaaaaaaaaaatcgatataatttgtttgacgtggacatgaacaatgttttgatcatttttgtgccttacttacaacatgtttttccatttactaaagtcaattgatcattctctgtttagaactttgttatttcgttagactcttaattttagatatattttgtagattaagtagagtatataatctttgggttttttagggaactctgtctaattgtttgcttttactttgttcaatagtatagatatttttcgatgtcggatccaaattttaagatcttactaactctttcatactgtatttttgctttgttttctaatgcactcttagtaagaagatgtatttctttgtaaatttgtgtatcatcttcaaatatttttatgatatttaatttgactaggaacatgaaagttccacgttaaacaaattatgtcgaagaaattttttggttatgccttctaaattttacctgtgaagatgttgctaagccagtcaactcctcataattttttccgtgttttggaagaatgtctctaaaaaattaaattttgtcctgaccaataatatcaacatatgtcatcactcttattttcgaggacttcaattttctctttaatttttattttataagtcacatatatttttagtgatatttactttatttaaaaatagtttatattcatggctaataagcagacgcgcagaaactagttaaaataaaaaggagaaatcaattgcaattcatctacattcggaactaaaataagtccgataatagaaaatagtgcaaaaacatcgttttccttgtgcattttgtcgggtgaaaaacattttcctcaaaaaatgtattctgcggattgctttgcatcgtaaaagcattttctggatcatttacaagcgtttgattggttataaaaataggtaaacatattgtaccaaacacacatgggatacagttcaattctttatctgttgataagactggagtttggagatcttctcgcaagccatgtgcaacaaagatctataagattatgtccaccttgtcaacaaagtaatattatatttaagcattaattacatcttaaacaaaacttgagcagtaaaagagagcagtagccaggagcccaggctgtagccatacctccatttctttttttcttttttttgcatgatattatattaagctagttagatgtttgttacaagtatctgttggtacactatccacaaactaagaatagtcgattactacgttagaaatagtacaatctttatctttctttcaaaaatagttcttggggtgtattctaccggtaatatttccttgacaaacactggaggaactatcaaaaagttgattcttgttcctgcctgcttcgttactttctttgctagcttgtccaccaccctatttgcctctctgtagacatggtgcatgcccagagctactaggagtgacctatattcacggaccatagcatcataaatcagatgacctttgttattgcaatgaattacttctgctgaatctaagttaacttccctggggaggagattgtactgccatctttatcccctgcataaaagttgttcgctccgaatggattgtattaatgcagttaattttccccaagaaccccattactcagtccccattgatgttcctaattagtcctcctatacctcccattctttctttttggtaagttgcaccatttgtgttgagtttataataaggcctccttggtggatgccatttgactcctattccaagatctggtgcttttgccgggcatccacctgccacatgtatgaactctactactttagctatagcattcttctagggaataggctctctcttgttattaaaatagttactatttctggcgagccaaatttgctagaggcgaagggattttcaattatatttacacctttctgaaaatctaatggacctttctttcttaaaatagaatatagaatctttcttatatttgagagcaaatgcaatcaattaaaccaaaagtaaaaaagaaagaagtactatacatatgctaggcttgcccttcaagaaaattatttccgttataaattaactgatctcaagtaattctgaaattttaagaaatgaacgtgactttgtcgtggcaaacatttttcaaagaggaatatatcatttcttaaaattgaagataagtacattattttattcctcgtcaaatgttaagataataaaaactaaaatgcataacataaatgtgcttaaaatggcaccttcacagaaattcctggaaaaaataaataaaggtagggactagagctacaatcataggccaagcatataaatagacgtaggatatcaacaattctattcatccagaattaataaaaccctagtaagtgaaagtgaaagaaaccactcatccaaatatctatagaaaagaaaatgaacccagctaatgcaaccttctctttctctgagtttgatttccttgaatcaatagaaaaccatcttctcaactatgattccgatttttctggatttttttcgacgatgagttcaagtaacgcattgcctaatagtcctagctcaagttttggcagctccccttctgcagaaagtagcttggatacctctctttgggatgaaaactttgaggaaataataccacatctcgaagagaagtccgagtccgaggaggaaacaaaggggcatgtagtggcgcgtgagaaaaacgcgacgcaagattggagacggtacataggagttaaacggcggccatgggggacgttttcggcggagataagggacccggagagaagaggcgcgagattatggctaggaacttatgagaccccagaggatgcagcattggcgtatgatcaagccgctttcaaaatccgcggctcgagagctcggctcaattttcctcacttaattggatctaacatgcctaagccggctagagtaacagcgcggcgtagccgtaggcgctcacccgagccatcgtcttcttcatgcacctcatcatcagaaaatgggacaagaaaaaggaaaatagatgtgataaattccatagccaaagccaaattggtttgtcatggatggaacctccagatgttactataactatatttggaagggtattcgatgtttagtattagaatcccctaaagctcctgaaggtcttcgtatcatgttctaatttaacatgaaattacatgagcgcatcatatatataactaagtagtagtactgttcgatcatgataataactttttgttagtatattttttcaacgacaatatgcttagtgtagaggaatatatacatgaatcagcaacgctggacagctgcttgagaactttctaagataattatgtggaaacgtctttttaaaactttttgaaacaatttttatttggatatctgctaccccatttagcaaaaagtaattttgagtacattttttgttttaaaaaaaacattatcaaataattggagaatacaaaaatacaaggaactaatttaatgtacatgatagatggcgaactaatgagggcaagtcaaaaagaagtactagaaattttttgaaaaggtgtgtatatgacactttagacaaatttcacattgttcataagtacatattgaccattcttgggagaaacagagatatgaaacgtgcattccacctaattatttgatcttgatgcaggcaatttaagccatatagaggtaaatatatattcatactcttatgatacctttgactttataatcagcgcacgagatccaaatatgatataatctattaaattaaaccaattatgtaaacggtatttatagtgccaatgcttaaaatttaaattctgtgtacatatattggcttgtgaattgccgccaaaatcgggaactatgccttccaagcaaaataattagcagcaaaaaaaaaaaaaaaaaaaaaaaaaaaaaaaaattagcagctccatccaaatgggtagagatattccttaccacggaataaactgataaaaaaaattgaagcaaaaaaaaagtttaaaaaaaattaagcccactggaaaattaagcataaaataaaacaaaaataagcccgttggtaaatttgatctaaggagcatcaaggttaaaaatattcttcaacggtgcatccaatcaagatatttcaaaaatctagagatcttattaatggttcttatattagattgaatccaaaatataatgtttaaattccttcttttcactgtaaaagcatatttgatgaatcacttttaggtgttccaaaatatttttgcagtatttctatgaaggttctgctttaattaaggagcatggctgatttcgttataaactattctacaaacaatttgtcgctattttcacccaagtgatgagattctcttttaattaagcaggaataaccccgctaaatacctgcttaattaaaaaaagaacctcatttcacttagacttctttattcttggaacagtcagcaataaattgtactcatactccatgtacacatggggatatctttttcatagtaataattaatgacgtgttcccacattcaatatgttcaatgcacgcgtggaaaagtaaattcaattcgaagtcatagatgtcaatccaattctattggagcaagaaaaatgcaacagatgctgtaacatttttttaagcgaccattttcaaaaaaatttaaaatgtacatagtctataactccgtttgttatgacttttttggcttcttattttgattcaaaataagtaacattttatatactccctccggtttaaaataagtgattttttttacctttttgtggtctaaaataagtaattttttcagatttcaagaatgaattaattatttttttccctacattacccttggagtaaatagtgttggagtacgtgttatgagtgtatatgtaaagagataataaaggttaatatggtcaatttcattgctaattaatgttaaaaggtgaatttcttaatctgtgtgaaaacaactaaaaaatcacttattgtggacaggagggagtaatgaagaataaattaactttgttttttcagaagttgcccttatttatttatttatcataatgtgtcaagttaacaatctgcaaattttaattatgggtaagttaatcaaaatatttttttaaaaaattattattttctttagaagtgtgctaaaggccaaaaagccacttattatggatggaaagagtataatattttagttatgtgttactcttttacgctataatcgagaagctatgtcctaatttccacatgggaaattcttgtaatggctaggaggaccatcctgaccacggtgtccctccatgggtcatgagaaaacttaaagagcgagaaaaaaaatatactgctttggatatataaacaaaatataatcatctattcacccaaattagaggtccgtaactgtaacgacctaactggtcgttttgctttctagaatctcgttcccttaaataaaaattttcgcgcttgctttaactaatttacgacctgaagggatggttggttcaggatttggaagatgttagggttgaaatatgttcatttgactccttaggattttcttaaaagggctaagtttaactttagtcaacatttttagcaaacagatccggattcatattttgacggtcccgaagggtccgtagaaaaatatgggacctggacgtatgaccggaatcgaattccgaggtccctagcccgagtaatgaatttttattaggaattgtcaaactgaaattctaaggatttaaagaaactaattaatgattgatcacattggtattgggctcgtatgttggttccgaagctcagtacaggtccaatataacatttaagacttgctcgcaaaacttagtgtcaatccgagtagtttaagggcgtttcggctcgttagaggaaaattaagaacttgaagttcataagttggatccaattggttttagggggtgattcttagatttagtgttgtttcaggcgttccgaaggtttgaatatgtccgtttcatgattttagacttgtcggtatgttcgggcggggcccgagatcctcgagcgtcaatcggacgaggctcgagtgaagttggactttttgagaagtgctgaagcatctgcttctgtcataactgcacctgcggttggtcgaccgcaggtgcgagatcgcagaagcggtccgcctatcacagatgcggctaaggcaggccaggcctaaaccgcagatgcggcctcgataccgcagaagtggtcgcagcccacttggccggttccgcagatgcgtccgatttctggcagaagcgggaccacaaatgcggtcccgtgaccgcagatgcggaaatcgctgaagctgtgagctttatttaatacgggttctaagtccctttttaccacttttcactcatctattggcgatttttggagcttttgagaagagacttccacctatcatcttgaggtaagtttatcccacctattcttagtttaatacttgtgtcttgggtagattaaactctaggattaaggtaaaacttatggggttagagaaaaacctagagttttggcaaaagttaaatttaaccacgaaatttgttataaaatgaattagaaatcatatattattgatccttaggttatggagaacaacttctttcgaaaaatttcggaatccgagcacgtgggacaggggtcggattttaggaaacttgtgttaatggttggaaaatttcttaaatagctagaattcgatattgtgagcttatattgactagttcttacctcatttaactagtttgggatcgttcggcttcgaattaagggtttggactcgttcttggtattggcagtgcactttggagcgaggtgagtctcctttctagccttgtaagagggaattgtccccgtaggtgtaataattgagtaatttgctactaaatgtgggggttatgtacgcactaggtgacaagagtctgtgcgtagctactattatgttaattgtccgggtagtctaggacccgtatcatgctatatttgtgaatgtctctatattttcttgctaatgtgatcacttaggatatgctagagacttggaaatgagtataagcgaatgtatacacttggacacttgtatgaatttacttggaaataaatgcgcatttatttgttttcttgatattaattgatatttgtggatcgggccgatcgcctcggtagaaatagatgcatctatggttcgcgtcattcgaccctctggcagtgcacagtttattttttgttggatcaggccgtagacctcgacataatgtgcgcatgataatgtgaaatcttatccatgacttctcttgctaaatacctgaaatgtaattggttaactacaaaattgttcagaacatcacttattatctcttgctacaaactattgattatttgtgactcacatgcttagcataacaccttattatattatttaaccctagtaagtatcaagtcgacctctcgtctctacttcttcgagattagacgggatacttactgggtacatattatttatgtactcatactacacttctgtacttaattttacaggatctgaggcaggtacatctggctatcagtctggtgtgcgcccctgactcatagttcgagatttccacggtgagctgctcccctcctgtgccgttcagcagcttgatggagtctttctttacttttgctatcttttctacctcggatagtaggatagttttattcttttgtaccttctactagttacccattacttgtgataccaggtcttggcacacacattagtagactattatttgggggttgtataactattttggcacattactgttcattcctggtttaactttaacttaatgaattgctgcacttattttggtaaaagtaaaaaaatgagaacttatttatatttccgcgttggcttgtctgacaataatgttgggcgtcatcacgatctattatggaaatgggtcgtgacaacatggtatcagagcactaagttcacgtaggtctcacaagtcatgggcaaacctaatagagacttgcggatcagtacgtagacgtctgtatttatcttcgagaggctatagggtgttaggaaaactactctttattcatttcttgtcgtgcagtagttagtatactaaatttccctattctattccctcacagatggtgaggacatgcacggatgatgttccagactcgggaggagctgctcccctcattgctagaggccgaggcagaggccgggggagggcaccggcccgaggtagggacgagggcatcctagagatgttccagtagccccatcagtagatcctgcgggatatcctatcatcgagaagaagggcgaggtgcccgcaactgagcctaccccgacggacttcatgacaacaccgggttttcaggagatcatgggtcatatgctgcgattcatggattccatgactcaagctggtttatttccagcagatccagctacatcacaggcaggggggagcacagacccctactgctcaggcccctagacatgcagttatagtatatctgactctgggtgcactacccacagatggggcccagccaatggctgtagtggcgccctagcctagaccagctgcggatggagacctgcagaagttgttggatagatggactagacttcaccctcctatcttcgggggtgagcgtcatgaggatgcccaagactttatagataggtgcagggacagactgcgcaacatgaggatattggagtcgcatagggttgaattcactactttttagctagagggcagtgcccatagatggtggcagtcttatgttcttggcaggccggtaggttcccctctcctcacttaggatcagttcgcacaattatttttggataggtatattccaccctcagagatgaaagagctgcggtatcagtttgagcatctggagcagggtcagatgtctgtgaccaattatgaggcgaggttttctgagttgtctcgtcatgcactcatgatactttccactgatgcaaagagagtgtgcgaagatttgttgcggggttgcaccccggtatttgagctagcatggaccgagaggtggagatgggtatcgagtattagctagtggtagagattgctcgcaagattgagggatatcgccagaggggtagagagcagattcagcaggataagagggaccgattttcggtagagttcagaggtaccccagctaggggtagaggtcacttcgggaggggttagcccaacagacccccatattcagcaccaccaccaccttcccgaggtgctccagtgagaccatattttagtgtgatgccggagagttcttaccgcccaccagcaattcagtgttcctccggtggttattcaggtccacaaggttcttctgattcttatttcagtggtatgccggagagttcataccgtccaccagctattcaggcttcttccaataggtctacaggccatcagggtcagccatcaagggagtagttcgccgcaccacgggtttgtttcgagtgcagagaccttagtcatatgaggagatactgcctcaggctttggggcaaggtagtacagcagggttagcagcctatgatttcagcaccggctgccccaccacctagaggtggagggcagattggtaggggttgtcctagaggtggaggccaagcagggagaggtcaaccaactactgcttagtcagatggaggccatccagccggcgctccggccagattttattcccttccggctaggccagatgcattggccttggatgctatcatcacaggtattatttcagtctgcggtagagatgctttggtattatttgatccagggtctacctattcgtatgtgtcatctctgtttgctcgttttctggttattgttcctgagcccttgggcactcctattcatgtgtccactcctgtgggcgattctgtggttgtggatcggatctaccagtcctgtgtggtcacattctatggtttcaagactagagcagatctctggttgcttgatatgatcgattttgagatcatcctaggcatggattggttatctctgtatcacaccgtcctagatagccatgtcaagactattactttagtgatgccagggttaccagggttggagtggaagggttccacagttgatacgtctagccaggttatctctttcctaaaggctcggcatatggtcgagaaggggtgtttggcttacttggcttatgttcgggataccaaaggtctccaacgattgatttagttccagttgttcgagagttcgtcgatgtgtctccttctaattttcctggcatgccaccgaatcgtgatattgatttttgtattgatttggctctaggcacctagcctgtatctatccaaccgtactgtatagatccgaaggagttgaaggaacttaaggagcagcttaaggagttgttagtaaaggggtttgttaagcccagtgtatcgccttaggatgcaccagtgttatttgtgaagaagaacgctgggactatgcggatgtgcattgattaccgccagttgaacaaagtcaccattaagaacaagtatctgttgcctcgtattgatgatttgtttgaccagttgcagggtgctaagatgttctccaagattgacttgaggtcagggtatcatcagctgaagattcgggactcggatgttccgaagactgcattccggactagatatggccattatgagttgctggtgatgtccttcagcttgactaatgccccagcggcattcatggacttgatgaatagggtattcaggccttatattgattcatttgtcatcgtcttcattaacgacatcttgatatactcccatagcctgggggagcatgagcaacatttgagggtagtgttttataccttgcgagagcagaagctatatgcaaagttctccaagtgtgagttctggctagagtcagtggcattcttggggcatttttgtgttaggagagggtattaaggtggaccccaagaagattgaggtagttcagagttggccacgtcctacttcggtgaccgagatcaggagtttcctagggttagcaggttattacagacgatttgtgtagggcttttcatctattgcattacctctaactagattgacccggaagggtgctcccttccgttggtccgatgattgtgaggcgagcttttaaaagctcgagacagccttgactacagcaccagtccttgtgttgccttccagttcagggtgtatacggtatattgcgatgcttcacacattggattagggtgtgtattgatgtaggaggggcgagttattgcatatgtttcgcgtcagttgaagatccatgagaagaattatcctgtgcacaatttggagttagccgcgattgttcatgcttttaagatatggaggcattatctgtacgaggtatcatgtgaggcttatactaatcatcgcagcttacagcacttgttcaagcagagggatttcaatttgaggcagcgtagatggcttgagttgctgaaggattatgacatcaccattctttatcacccgggcaaggcaaatgtggtcgcagatgccttaagcaggaaagcagagagtatgggtagcttggaattcattccagcagaggagaggccactagctttggacatccggtccttggcaaacagacttgtaaggttggatatttcagagcccagccgaattcttgcgtgcattgttgcctagtcttcattattagggcagatcaaggcccaacagttcgtgatccacatttggcagttctcagagagacagtgtttcagggtagtaccaaggagatttctattggcgaggatggtattttacgactccagggtcgcctatgtgttcctaatgttgatggtctgagggagaggatactagaagaggcacacagttcgcaatattccattcatctgggtgctatgaagatgtatcgtgaattgaggcagtattattggtggcagaagatgaagaaagacatagtggagtatgtggctaggtgtttgaattgccagtaggtcaagtatgaacaccagaggccgggtgacctacttcagcagatgcctataccagagtagaagtgggagtgcattactatggatttcgtagttggcttgccccggaccttgcggaagtttgatgcagtgtgggtcatcgtggataggttgaccaagtcggcacactttataccggttgtgtctacttacacttcaaagagactggctcagatttacatccgggagatagttcggttgcacggtgttcctgtttccatcatatcagatagaggccctcagttcacttcgcatttctggagagttgtttagggtaagttggggacctgcgtggagcttagcatagcattttatccacagaccaacgtgcagtcggagtggacagtccagatcctagaggacatgcttaaaggatgtgtgattgactttggagggcagtgggatcagttctttcctttggtagagtttgcttacaacaacaactatcattccaccattgagatggctccatttgaggctttatacggtcggcggtgtcgttctcctatcgggtggtttgagcctggtgaggctaaagttatactgtacagatttggtgcaagatgacttggacaaggtaaagttgattcaggagaggcttcgcacggctcaatccagacagaatagttatgcggatcagagggcgcgtgatgtatcattcatggttggcgagaaggttctcttgaaagtctcgccaatgaaaggtattatgaggttcgggaagaagggcaaattgagcccaaggtttattggaccctttgaggtgttgagacgagttggggaggttgcttatgagcttgctttaccccccagcttatcgggagttcatccggttttttcatgtatcgatgcttccaaagtatcatgccgacttgtcccatgtgttagactttagtactattcagctggatgagagtttgggttatgaggaggagccagttgccattattgatagacaggatcaccagttgaggtccaagaggatttctgcggtgagggtccagtggaggggccaaccagtcgaggaggcgacctgggagttcgaggaagacatgcggagtagatatccatatttattcagcagctcaggtacttttctatgttcattcgaggacgaacgtttgtttaagaggtggagaatgtaacgacccgactggtcattttgctttctagaacctcgttcccttaaataaaacttctcgcgtttgctttaactaatttacgacttgcggggatggttggtttgggatttgaaagatgtttgggttgaaatatgttcatttgactccttaggattttcttaaaatggctaagtttgactttggtcaatatttttagcaaacggacccggattcgtatttttacggtctcgaagggttcgtaggaaaatatgggacctgggcgtatgcccggaatcgaattccgaggtccctagctcgagtaataaatttttattagaaattgttaaactgaaattctaaggatttaaagaaactaattaatgattgatcatgttggtattgggctcgtatgttggtttcgaactcattacaggtccaatataatatttaagacttgcccgcaaaatttagtgtcaatccgagtagtttaagggcgtttcggctcgttagaggaaaattaagagcttgaagttcataagttggatccaattgggtttagggagtgattcttagatttagcgttgtttcgggcgttccgaaggttcgagtaggtccgtttcatgatttcagatgggatacttactggttacatattgtttatgtactcatactacacttctgtacttaattatacagtgaggcaggtacatcttgctaccagtctggtgcgcgcccctaacttatagttcgagacttccacggtgagctgctccactcctgtgtcgttcagcagcttgatggagtctttctttgtttttgctgtatattctacctcagacagtatgatagttttattcttttgtaccttctactagttgcccattatttgtgacaccaggtcttggcacacacgttagtagactattatttgggggctgtataactattttggcacattactgttcattcctggtttagctttaacttaatgaattgctgcacttattttggtaaaagtaaaaaaatgagaacttatttatatttctgtgttggcttgcctgacaatggtatcaggcgtcatcacgatctattatggaaatgggccgtaacagtaagttacaagtttgtctagataatccagttaaatcgttcacgagagtgtcaaatggacgaatttgcctgaatttaaccgggttaaaacggattaaattaataaaggaatagattgtttacccgctcggttagacgtttgtcctattttcttattatatttaggtttcttatcttttgaaagaaggtcaatatatttaccacaattgattttacttttatgaaaaagaaaatatatttcttttatatttggctagttctttttcttggaagaaaaggtttttgagcatttataaattgaggattattccttctcatttaatagatgcacaatgtagtccctaaggggaagaatttttagacaagtgttagcccaccacttgtgtgtgcatcttattgaggttattctctcgatattttgtactctcttttatatagtggattgtttatcttctcctgtgaatgcaggtcaattgaccgaaccatgttaaatatttgtctctcttttgatacatttttcttttgttgtttgatttatcgtcgttcaaggtctgctttgttagcttccacgtgatatttgattatatttattttaacacgctcaaagattaattgaacagaggtatgatgaatcaaaacatactaaacaatagatcgtaagtcatagctcaacccgttcagattcgaatggatcatattttttatgcgcaaactttttgtgtcggtgacattaatttgccagagatcttgcttttcactcatatcccaagttatggaagctcgtgtttatcaaaatgcatcgaagtatggccatattggcatatgtaaactgactcatataaaaaattaattaagcaattaaacatgaaatattaatgttatttattttaaattggcaacatgaaacatgagtgagctatttttaactgactcatactgctaaattaaacattatgtttttttctctcaaataattagccaatcattcgatcaatttgttgaccgttgaacgacaagagtagaagggaatattttcttttatttaaaccatacaagataatgtatacttcctcaattcacttttacttattcactacaataaaaatatattttcacttttatttatccattttaataaattaagagaaattaagataattttttttcttgttgtacacttatcattaattactcattttcaaaattatttttcatgactctttgaaatgctatcattatgaggggttataaggtaaaatctgtactacaattattattttttaaggggcgtaaaaaatccaaaatgaacaattaaaaatgaacagagggagtacaaggcatcctatagctttttaaatttatttattactcctaatcctatcgttgtaaccaaaagaaaagaacaatacggaaagaacattaaagaagttatttttacataatatggagaagaaaaactgaagcagcttcagctgaatattttgcttatactcattcttctatacacaatggacaagatagaaaagaaatcccgagcatataatgcgggcatgttgatccatctcttcataatagtgcacctatcctttcaaaattctcaatccgcgtccgagtccacagcctttagtgatcacttcgttaattaattagtcccatgtgtggcggaataaggataataaaattgattgatgacgatagagattggagaagtcaaattcaacgtgagtcattgccaagaaataaaagggtaatcaagtcattgtcaatggatgttttactagtacttaagaaaactagttcacggggcaactaaacgatattccctcgtgcatggactttgccattctgtttattaatattttttctttttcacattctatttgttaatagtgttattgatttttttcgaaaattatgtttcactcacaaacaagacgctgtacaacacaaaacacatttcttttgttgatatttttttcatgatgaaaaatgatttcactagaccaaatgtatatatatgttgcccgcaatttaactgacacaaataattactactcccatcgtttcaatttatgtggctaataagtttgaattgtcacagaatttaagaagaattgaaaacttctaaattttatgacttaaaataaatcatagatatttatgtgattataagaccttctcattaagtgtaacatgaataatttgagttaagttcctttcagatttaaaaagttatcattctttttagaatgcattaagaaagaatgtgatcacacaaagtagttataacttgtaccaacagctctaatattttatgttgaacaagttagagttttaattttttttttctcatttatcctttgtaataattattttgaaaatggagatagcacataaatagaataaatatttaatgaagatagattatattttaagacattaataagggtaaaatagtattaaaaaaatttcttctagttaatgtttcttaagagttatgtaaaagagaaatacgatagataatttgagacggacggagtatatattgccccgcagtttaacagacacaaacaattactccctctgttgcagttcatgtggccaagtttgaattgccacggagtttaataaagaactgaacacttttgaaatttgtgacctaaaataaattatagatacttctatagttataaaagcttctcattgaacgtaaaatgaatttgagtaaaaaaaaaaatccaaatgtaagaagttaacattcttttggaatggatttagaaaaaaacctgatcacacaaattgaaatagagggaatagttataaattggaccaacagctctaatattttatgttgaacaagttggaattttaattaattcaggaaattcatgattggcacacctcattgggaagacataacggccatgtgcggagatctttcatgttggactcggattttatgtccctttctacttgtattcacattttgactctcgctatatgatgaaaaattgtcctctaacctcacaaagtcacaccagaaacaatagttctttggaaaagaagcaaactttaatattatcaagcagttaactacacttaacctaaaataattaggatgcttatttgatcattcaacgtaattatatctgatttactgtttttaaaaaaatctgatttactgttcatctaatataatagtacattcatttgaacatgaatttctgtgaagattccaactgacaatgcaagtgtaaattaatgttctgaacacgcttttgatatgctttcatatttttatttttaaggaaataaaaaatatttttctacataagaattattgccggtctcgagagagagtacgtcgttatgagaattaataatttatggcttgataattggcgacagagtcatgttcactttcattagtttataagtattagttgtacaatcgaaaataaaaaaattaagtattagagcatgaatatcacattttaaaagtaatcttttattatttttagaattaaacttaaaagcgtctattaatcattttgaactcataccccacgtggctcgtgatatgctatcaggtataatggcaaggtttcaatatatataaaggattcccccgttaggttacttcacaggggaaaaaaattgctaaattgtggcgatttatttatgaggtttaaaacatattatacattcgtgttacgatctggaattctcaccgtcggaaccgtgatggcgtctaatatttcacttgctaggcaagtcaacgttagaataatttattcatttttaacagtttaaatcaaataatgagaaagaacttaaatatctgaaataatccaaagtaaaaatgcggaagctaaaacaaccaaacttctaatacaaccctggacccggtgttacaagtgcacgagctactagaatagtacaaacaaaggtctaaaataacataaagttgttgaaaagaaagtacacatccaaataaaaagggaaggagactctaggagctgcgggcgctgagcagctgtacctcaagtctccacaagctgtccaatccgagtacgctaataaccgtcgttgggtctgactccaaaatctgcacaagaagtgcagattatagtatgagtacaaccgactccatgtactctgtaagtgtcgagcctagcctcgacgaagtaagtgacgaggctaaggcaggtcactcatactacaacctgtacgcagtatataataaatacataaaaggatatacggaatgaaataagacaatcaactgaaaataatggctatagccccaagaaataagccagtgatgttcagaattactaatccttatagtttcaaatgaaaataccgaaaaccaacacaaatcaaggaaatagaaacatatagcttgttgcggcacgcaatccgatctcaccatacaactcagaatcttcccttatttcactataacatcaacaataataaataatatatatgctgcggtgcgcgacccgatcccaccatatcacaatatcagtatcataattcacccttatattaccatatcagttcacctttattcaacatgttgcggcgtgcaattcggtcccaccgtatcagtacaagtttacccttattccaccatatcaatccatccttatttcacctgttgcgacgtgcaacatgatcccaccatatcagtaccaaatcctcaatgtgcataatcaaatcaataattcaaatcacaaggaccattatgatcaataaataccaagctgaaccaataagggaaccttgtacaacatgagaatttacacagataatattatataatgtaaatgacaataagaaggtgcaagtaagtcaattagggcaagtagcagtgaatcatgaaaatatgaaagggtctaacattattaatagaaaaaaacattaattaacaagtagcaaataagcagggaaagcatttagggtatataacaattaagacagggaaggagactatcatggaaaatcggaaaatcagggaaaacaattaattcgacggcgtataagcactcgtcaccgcgcatatacaccgcagcacatgaaatacacatagcacatagtctgaggattcctaattccctcaaatcaaggttaaacttaacacttatctcactctgcagtcaatttagagctctaccggggcctttaccctagaatccacctccaaaccacttgtatctaagcacaattgactcaatagtatcaaatattgctaaaggaatcaattacaatgcataaatttagaattcccacactttttccaaaaaaatcaaaaatcaacctcgggtccgtttggtacaaatctaaaattcggcccaaaactcgattacccattcacccccgaggcctttagataatttgtttcgaaatccgacctcaatttgaggtctaaattccaattttgcaaatatccctaattctacccaaacccccaattttcaccatgaaaatcctagattttaggttgaaaacttatgaatggaagattgaaagaaaataagttggaatcacttaccaatgaattggggaataagagttcttgggaaaattgcctctagggttttctagttttgaaaatttgaagaatgaacaaaaatcccgtctaactcaacttttacacagttgcagatgtcgcaattacgaactcctctcagaatcccagttatcacatttgagataaaatagtcgcaaatgcgaatcctgatgccttcacaaatgtggacctttcttcgcaaatgcgaagatcattacaaaatgtgctgagtcgcaaatacaaatctgccttcgcaaaagcggaaatggaatgttcgcaaatgcgaactttcacctcacaaatgcgagtacccccctcccctcgctgccgccgccatgaccaggctcgtaaatgcgatggtttcttcacaaatacaaggctcgcaaatacgagccaaatctcgcatggtttcttcacaatgcgagatctgcagtagacaccagaaactaactgcatcagctatgtttctaagcccaaactcacctcgtcgcctattcgaaactcatccgagccctcgggtctccaaactaaacatgcacacaagtccaaaaatattatacggacttgctctcgcgatcaattcgccaaaataatacctagaactatgaatcggacaccaaaatcaaatgaatttttaagaaaactttagaattgctattttaacaaccggatgtccgagtcacgtcaaaccaattccgtttctcaccaaatttgatagagaagtcataaatatagtaatgaacctatactgggttatagaactaaaatacggatccgacatcaacaaaatcaaacatcggttaattcttaaaaatcattaaacctttgaactttcaattttcgacaaaaatcaataactcgagctagggacctccgaatttgattccggacatacgcccatgtcccaaatcacgatacggacccaccgggatcgtcaaaatatggataccagtccatttgctcaaaacattgacgaagtcaactcaaataaattttaaggtaaattttcgtgttttatcagtttttaacataaaagcctttcagaaaaatactcgaactgcgagcgcaaatcgaggaaggcttaaagaagctattggaggcttcgaaacacagaattacgttctaagactctagatgagctaccggatcatcacattctcaacctctaaaacaaccattcgtccttgaacggacatagaaaagtacctgagttggtgaaaaggcgtggatatctactttgcatgtccgactcagacttcaaagtagctacctccaccggccggcctctccactgcactcgagctgaaggataactcttagaactcaaccatcgaacctgccaggctagaatagccaccaactcttcctcgtaaatcaaatccttgtccaactggactgagttgaaatctagcacatggtaggatcaccgtgatacttccgaagcatggacacatggaacaccagatggaatgctgataaactaggtggcaatgcaagcatgtaagccacatctcccactgtctcaagaatctcaaaaggtccgatatacctagggctcaacttgcccttctttccgaactccatcacaccctttatgggtgaaacccggagcaataccctctctccaaccatgaatgcaacatcaagaaccttacggtcggcttaactcttctgcctatattgagctgtgcgaagacgatccttaataatcttgaccttatccaaggcatcctgtacccaacaaccgagcccccccccccccccccccccggtctcgaaccacccaaatggcgaacggtaccacctcccgtataatgcctctgtaacgatccaagttctccctccgtgaactgtcgtgatggcacctagtctctacgactaggtaagcctaatattgtggaaatgaaatgaaaacacaaagataataactaacaaatatagttaataagcagaaacgatgcttctcggcatataaaataatcactttttcacaaacccagaatgtcacaatgtcacaagcttctaagagtttctaactgcgctatacatttatgtctgaagaaaacaaatgggaaaatcaacacaaggggatagaaggtgactccgagatctgtgcatgcagcagatgtaccttgaagtctcttgaagcagctaccatgcaactagactcgaggccgatagctagtacctggaattgcacacggaaaacatgtgcaggaaacgacatgagtataccacaacggtacccagtatgtgccaagcctaacctcggtcgagtagtgacgagatcaggtcagagccctactagtataaatataataaaataagacagaaagaagtattacaatgaaataagtatgaaaatctaacagaaacggaaatcaatgaaaaccgatagctcagaatacaataataacaataggggatctcccgggataccatcccgtagtcccaaacgtaaatgtgcaaggggatctcccagaataccattctgtagttccaaagtaaagatgcagtataggagatcacccgcaataccgtttcgtagtcccaaattaaatatgcatctcaatcaatataaacaacagttacagtaaagaaacctatagatttgactggttcacatcaaataagacaggtattttcactaaacatgctacacagagttcaaataggtagttaaaacacgtaagcatgcttttctaatctaaaaaggtagttacatatgctagtgtagttcaaaacaaggagaaacaggttatgacttagtgaaaaacaaagttttacaacaaagagcccgtgtacatactcgttacctcacgtacacgacgctcatatatcaaacagtaccgaatcctaaggggagttcccccacacaaggttaggtaagctacttaactcgaatcaagctcaaatcaatctgaaacaatgctctttccacgaatatccggctccggatggcccaaatctagccaaatcaattacataatataaatatagctacaagtaactaatttagctaatgaaatcaaagctaaggcaagaaaacaaaaaaatgcgcaaaaaacctcctctggcccacatcttggaatcgggtaaaagtcacaaattataaacactcattcactcatgagtctaaccatacaaaattcacacaaatccaataccaaaatctcaatcaaaaccccaaaattcggcctaataacttttctcaaatttttccaattttccaccccaaatccgaaattaaatgatgaaatcaagcatagattagtgggatataatcataaatgagttaggaataattacccataaatttccttcgaaaatctctccaaatttcgccttctaccgaactctcaataaaattttgtgttatgaactcagaccctcattttttgaactataaatctgcccaggtacgcccttctttgcgaacacgaccaccacctcgcgttcgtgtagaacaaaagtctactgctcaatttttcctcttttgcgaacgtaagtttcctcttgtgaacttgtagcttcagctgccaggaccttcgggaatgcgaccccttgttcgcgaacgcaaagatcaaattcctaaggtcccagctgttccattttctctacgcgaacgtgatgccattcacgcatttgcgatgcattgtagtccaaaccttcacgaacgcgtccccttattcgcaaacacgaagggcattttcttcttcttccccaactcctcttcgcgaatgcgggcttcttttcacgaacgcgaagaacaaatctctgcaacaaaaaccagcaaaaatctgctatccttctaagtccaaaaatgacccgttgagtatccaaaacacacccgagaccccgggacctcaaccaaacttaccaaccaatcctaaaataccatacgaacttcgtagagccctcaaatcatatcaaacaacgctaaaatcatgaatcactctccaatccaaactttaagaacttgaaacttcaaaattctacaacttatgccgaaaccaaccaaaccatgttagattgaccccaaattttgtacacaagtaatattcaacactacggacatactacaacttccggaatctgattccgtccctgatatcaaaaattccactaccgacccaaaactccaaaaattcgactttcgtcatttcaagcctaaataagctagtgacctccgaaatacagtccggacatgcccctaatccaaaaatcacccaacagagctaacagaatcagcggaactacttttcggagtcatctttacatagttccaactacggtccaaatcctaaagcttaaaccttcatttagggactaaacgtcccaaaacacttcaaaaatcaaaacgaatcttcccggcaagtcacaatagtagaaataggtacgggggaagcaattaataggggattggagcattaactctcaaaacgaccagccggatcgttacattctcccctcttaaaataattgttcgttctcaaacgagtatagagacatacctgaagtggtgaaaaaatgaggataacggctgcgcatgtcctgctcggtctcccaagtcgcctcctcgaccggctgaccccgccactgaaccttcactgatgcaatgttctttgacctcaactttcgaacctgcctatccacaatagccactggctcctcaacataggatagatccttgtctaactggactgaactgaaatcaaatacgtgagacggatcgccgtgatacttccgaagcatcgaaacatgtaatccaaatggactcctgctaggctgggaggtaaggcaagctcataattaacctctcttacacgttgcaacacctcaaaaggaccaataaacgttgggctcaacttgcctttctttctgaacctcataacacctttcataggcaaaacctagagtaagacccgctctccgaccatgaatgccacattgtgaatcttccgatccgtataactcttatgactggactgggctgtacgaagtctatcctgaatcaccttaaccttctccaaggcatcctgaaccaagtttgtacccaataatctagcctctcccggctcgaaccaacctactggggaccgacaccgcctagcatacaaagcctcattaggtgccatctaaatgttggactaataactattgttgtaggcgaacccctcaaagggaaagaacttatccctagaacctccaaactccatcacacacgcacggagcatatcccaagaatttgaatagtgcgtttggactgcccatccgtttgagggtgaaatattatgctaaactccaccggagtacccaattcttattgtacgtctctccataaccgtgatgtaaactacatgccccggtcagagatgatagataccagcatgccatgaagtctgacaatctcacggataaactagagccaactgcttggaagaatatgtagtcatcataagaaggaaatgagctgtcttggtcagtctatccacaatcacccaagctgcatcaaacttccgctgagtccatgggagtccaaaaacaaaatctatagtgatcctctcccactttcactccggaatctctaacttttgaagcaatccacctggtcactttagaagttaccaacgaaataaattgccggtaagtgaagtatgagcatcagcgaccaggtgggtttctttagaaattagagattccagagtgaaagtgggagcggatcattgtagatttcatttttggactctcatggacgtagcggagattgatgcagtttgggtgattgtggatagactgaccaagttagctcattttcttcctatgatgactacctattcttctgatcagttggctcgagtttatatccatgagattatcagacttcatggcgtgccgatatctatcatctctgaccgaggcacacagtttacatcaatattctggagagccgtacagaaagaattaggtactcgggtggagttgagcacaaaattttaccctcagacgaatgggcagtctaagcgcactattccgatttttaaggatatgctttgtgcgtgtgtgatggagtttaaaggttattgagataagttcttgccccttgcggagttcgcctacaacaactgttattagtccaacattcagatggcactgtatgaagctttgtatggtaggcggtgtcggtccccagtgggttggttcgagccggacgaggccagattattgggtacagacttggttcaggatgccttggagaaggttaaggtgatcaggatagacttcgtacaacctagtcatgacagaagagttatgcggaccggaagcttcgcaatgtggcattcatggtcggagagcaggtcttgctctgggttttgcctataaaaggcgttataaggttcgaaaagaagggtaagctaagcccaaggtttattggtcattttgaggtgttgcggtgtgtcggggaggttactaatgagcttgccttacttcccagcctagcagaagtccatccagtatttcatatttcgatgctccaaaagtatcacggcgatccatctcacgtgttggatttcagttcagtccagttggacaaggatctatcctatgttaaggagccagtggctattgtggataggcaggttcgaaaactgaggtcaaagaatattgcatcagtgaaggttcaatagcggggttagccggtcgaggagagctacttgggagaccgaacaggatatgcacaaccgttatccttatcttttcaccacttcaggtatgtctctatactcgttcgaggatgaacgattcttttgagagggggaggatgtaacgatccctacggtcgttttaaaagttagagacccaaaccccgattaattgcttcctccgtacctatttctgctattgtcgggaagattggttttggtttttgaagtgttttgggacacttagtccctaaatggaggtttaagctttaggatttggattgtagttggaactatgttaatacgactccgaaatgtagttatgtcaatttctttagctccgttgggcgattttgggcttagaggcatgtccggactatgtattggaggttcatagcttatctaggcttgaaatggcgaaagtcaaatttttggagttttaggtcggtagtggaatttttgttatcgatgtcggaatctaatttcggagttttgagtaggtctgtagtgtttactatgacttgtgtgcaaaatttggggtcaatcggacgtagtttggttggtttcggcatcggttgcagaattttgaagtttcaagttcttaaagtttggattggagggttattcatgatttagcgttgtttgatgtaatttaagggctcttgtaagtttgtatggtgttttaggattggttggtaagttcgattgaggtcccggtagcctcgggagtgtttcggatgttcaacatgtcatttttggacttagaaggatagcagattttttttggtttttgttgcagatatttgtctttcgcgttcacgaagagaagcccacgttcacgaagaagagttggggaagaagaagaaaatgcccttcgcgttcacaaataataggacgcgtttgcgaaggtttggaattcaatgtatcgcaaaggcaagaatggcatcgcattcgcgtagagaaaatggaacagctgggacctcgggaatttgttcttcgcgttcgctaacaaggggtcgcgttcgtgaaggtcctggcagctgaagctacgccttcataagagggaactcgcattcgcgaaagaggaaaaattaagcagtggacttttgttctacgcaaacacaaggtggtggtcgcttttaggaagaatggcgtacctgggcagatttaaagttcaaaaaatgagggtttgagttcataacacaaaatttgattgagagctcggtagaaggcaaaatttggggagattttcggaggaagtttgtaggtaatgattcctaaatactttatgattatatcccactaatttatgcttgatttcatcatttaatttcggatttggggtggaaaattgggaaaatttgagaaaagttcttagggcgaattttggtgttttgattgagattttggtatcggatttgagtggatttggtatggttagactcgtgagtgaatgggtgttcataatttgtgacttttacccaattcttcgacgtggggccgggaggctttttgggcatttttctattttcttgccttagctttgatttcattagttaaattagttatttttagctatatttacattatttaatttatttggctagatttgggccatccggagccagatattcatggaaagagcattgtttcggactgatttgagcttggttcgaggtaagtagactgcctaaccttgtgtggggaactccccttaggacttggtactgtttgatatatgagtgtcgtgtacgtgatgtaacgagtacgtacattggctatttgttttaaaactccgtttttcactaagtcataacatgtttttccttgtttttaactacactagcatatgtaactaccttgtttagattagaaaaacttgcctacgtattttaactgcctatttgaacttattgtagcatgtttagtggagttacctatctttttttatgtgcacttagtcaaatctgtaggtttctttgttgtaactgttgtttatattgattgagctgcatatttactttaggactacggaacggtgttttgagagatcccctgtactgcatatttactttgggactacagaatggtcttccgagagatccccctacacatttacgtttaggactacggaatagtatcccgggagatcccctgttgttattactgtgttctgagctatcggttttcattgaattccattcctattagatttttgtacttatttcactgtaatacttctttctatcttattttattatatttatactagtagggctctgacctgatctcgtcactactcgatcgaggttaggtttggcacttacttggtacagttgtggtgtactcatgccctttcatgcacatatttttcgtgtgcagatccatgtactagctatcagcctcgagtctagttgtgtggttgttgcttcaggagacttcaaggtacatctgttgcgtctacagttctcggagtccccttctatccccttgtgttgattttccccttgttttcttcagacataaatgtatagagcagttagaaactcttagatgcttgtgacattgcgatatttcgggttttgggaaaagtgattattgtatatgccgagcgacatcatttctgcttattaactatattctttggttattatctttgtgtttccatttcatttccgcaatattaggcttacctagttgtagaaactaggtgccttcatgacagttcacggagggagaacttgggttgtgacagcctcataacaagccatctgaatgctcgacttgtagctattgtggtaggcaaactctgcaagtggcaagaacttatcccaagaacctctgaagtctataacacaagcgcagagcatatcctccaatatcttaataatgcgctcgaactctccgtccgtctgaggatgatatgttgtgctcaacttaacctgcatgcccaactcacgttgtactgctgataagtagggattttgactacttatttgcatctttttacttgcgttttagctcaaaaatgcttaaaggtattcccgagaactgataaaatgtgcttacttgtaggattattggaaaatgagccaaagagataaaaattaactcaagaaggagtaattttggacaaggactaaaacaaagcaaaaaagagcaaagtacagaccacacaatattgtgtgcggccccagagcatgaagagacctctgatggattttctttgcaaagtgcggaccgcacaataagacctctgatggattttctttgcaaagtgcggaccgcacaattattgtgcggccgcagaagatgaggttcagagagatgtgattttggaccatgaagaagtgctgaccgcactattattatgtggcagcactaattatgcggccacagaaatccatcctgtcaagccagtttcaaagtgcgaacagtacacagaattttgcgtccgcagaaccttcacaagggaatttcgtccgataatttcaggtgtatataaatagtcttttttgtcaaaattagcttatgttttgaacatctgaaaatagatagccgttttccctttactgttttgggtaactatgtagtagtttatcattttaacatttgattttgttccctttatcatttattatgagtttaatcttattttcttctttagtttcttcaattttctctaagagtagctaaatttctagctagggttgtgacccaatcctagtgtgggtacctaatgggtgtttgaattagggcttgtttgtcattggattagtgatatttagcatagttctcccttgaatttaagaattaatggttgcaaacattgattcatgcataattgacttagtctctacttgagaaagagagactaaggctaggaaaacttggctaacaaggaattagggtgaactcagaaaattgattgcccaattaaagggttgaatctagagatagtaagacccgacttgagcatttatcacttgttttgtgcaacacctatttgaacttgagaaagccaaattgggcaaaaccactctaactaccgagaggtaatgagtgggtaactgcgtgtgattgctatattacgactctgaccaatcaaacttgtcatagagcctacaatctgttaggtaaccatataggtggaagtcacgaccctagatcttttataaacttgaaaaacaacaacatcaaaaatatcgatctctagattttcatttgcagatattagcataatcattagaagtataaagaaacaaccaaacatgtggaagtgcattttgggcacatcatacacttagtcttgatatatatctaatccaatataaactctctatggaatcgacctcgacacacgttgggtaattataatttcatcaaccgcttcacaatcccaattagtggtgtgaatttgggcgacatcaatttttggcgtcgttatcggggagctaaaaacggatttagctatatatctgattttgtgtgtgatttgtcttcttttacttccaagttactaatcatttcgtgaaataattgtaggtgatacaatggctttcaacaacaatgatccttttggaaatgtgccattggggggataacagggatgatgaccaagttgatgaggttctttttgaacctcaagtaaatagacgaggccgcccgcctcaagacaatgttcccgttccacctccacctcctccaagagcggcggtacaccgggtgttgtcgaatgaaggatatgcaagtgccatagtcctgccccgcattagggcggaaaacttttaaataaaaaatggcatgcttacactattggaacaacggggattctccaccggggctccgagtaaaaatacgtacaagcacttgaaagggtttgttgacacttgctggaggagtaaacaaaccaacgtctctaaggatgctttgcgattgaggctattctctttctctctgcgggggaaggctttgaattagttggagaagttgccaactcattctatccatacatgggatgaattagctgagaaattcatttccaagttattttctcccgggcatatggcaactcttagggatgagattctagatttcaaacaagaacccaatgagcctttgcatgagatatggggaaggtaccgtactatggtgaaagagtgcccaatgacatgatggaggctatgatttaacaaaatttttatagggggatcaatactactaatcaatgtgtggtcaactaaattgctggtggaaatttcctgacaacgtcgtatgcggaagcttgtgagattcttgatgaaatggcggatacttcatcggcatggcaaagtagagctaacgttcctcaaggtgatgcaaatgtgattcatttgcataaagaattacatgatcatggaaagcaactgccgagttgaccaccacaataaatcaactagccaaagctcaacttcaacaagtgcaaggtcccaagaaattaaatgcaatggaaggagtaagtatgatggtaaacaagagaaggcaaaagagtcctcaagtacaaaatcgggttgagaagatgatagtggatttgatcaatatggacaatacaatgattaagaagaggaagtacaatatgtgaaaaacttccaatggcaaataaacaataatcaaggcccaagttaacagcaatggcgaccacgagaaaatcaaggaaattagaattcaagcaatcaaggtggttggaacaatcaaaacaaccaaggaaattggaacaatcaaggaaattggaatggtcaaaataatcaaggcaattagagtggcaataatcaaggcgattagggaggtaacaaccaagaagggtggaactacaacaacaatcgggggtcgggttttcaaaggcctccgatgtttcaacaaccgatcaatccacctccatatccttctaaaggtcctatttcttctaacaataagatgggccgaatagagaacatgttcaaacaaatgctggagaaaaatgccgactccgatgctcaattagcctttcacaacacttcaattttcaatttggaagttcaattgggccaaatctcacaagctttgaacactcatcctaagggtgcactaccaagtgatacggtggtgaacccgaagggtgggaacaacacgggacatgccatggccgtgactacaaggagcgaaaaaggtggggaaacaaccacctcaagtcaaaagaaaattgtggatgaggaacaattggtacaagaagatgagatgccaagcaatgaagtgaaagcaaatgatgaggtgagaattgatattgatgacaatgtggaggagactcaagaagaagtgaacccgtctagggagcatatgttgacataccaaaatcggtattgccaaaggctaaggaaccaataccaaggccttcgcctccatatcctcaaaggcttgccaagcaaaatggttagaactaataaaaagttcattcacatgatgaagaacttgtctattaatgtaccgttggttgaggccttggagcaaatggtgggttatgcaaagttcataaaggactcgatgacaaagaaaagatcgatgaattatgagactataaagatgacacatcaagtgagtgtaattgtgcactcaatggctccaaaattggaagatccgggcgttttcacaatcccatgtacaattggaagtgccgactttgccaaagctttatatgatcttggggtgagtatcgacttgatgccctattcggtgttttctttggggattgggaaactaagatccatatccatgagattgcaaatggtggatcgtataatgaagagacctttgggtattattgatgatgtgttggttcgtgatgacaagttcatcctcccggcggactttgtgattcttgattgtgaagtggactataaggtgcctattattttgggttgaccttttctttctacaaggaatatttgttgatgtggaagctggtgagctcactttccgggtgggtgatgaaaaggtggtcttccatgtatgcaaatctatgaggcaaccaaagagcaatgaagtttgttcgttcgtggatttggttactgatgtgattattgatgatgctagtaccacaatgaatgttgaggataatttggaagtcatttttctcaaccttgataatgatgaggagaaagaaagctatgtggaatgtgtgaatgcattgcaaggaattgggtcgtacacttatgaaccccgcaagttatccttagatctttaaaattggaagactcctccaacaaagccctcaatcgaggagcctcccactttggagttaaagccattgcctctgcatctcaggtatgaattccttggcctttcttctactttattggttattttttcctcttgtttgactaacatacaggtagactccacattggaggtgatacaaaggaggaagagagcaattggatagacattggcggatattcggggcatacacctcttcttttgcatgcacaagattattttggaggggggtgccaaacccttcgttgaacatcaaaggaggctaaatgaagcaatgcaagaggtggtaaaaaagtagatcataaagtggttggatgccggggttgtttgccccattttcgatagttcatgtacttctccggtgcaatgtgcccgaaacaaaaggggcattactgtggttaacaatgataagaacgagttgattcctacaagaacggtgaccagatggacagtatatatggactatcgcaacctcaacaaagtcacaagaaaagatcattttccacttcccttcctcgatcaaatacttgataagttggcaggccgtgctttctattgtttcctcaatgggtattctgagtacaatcaaattcttattgctccggaggatcaagaaaagactactttcacatgtctatatggtacttttgcattgtcacggatgccatttgggttatgcaatgcaccgacaacttttcaacagtatatgatggctaacttcaccaacatggtggaggatattcttgaggtcttcatggatgacttttccgtggttgggaattcttttaatgattgcttgaacaatttggataaggtcttggcaaaatgtgaggagacgaacttggtactgaattgggagaaatgtcacttcatggtcgaggaaggcattttcctcggccataaaatttcaaataacggtattgaggttgacaaagccaaaataaaggtgatttctaaacttctgcccctatatccgtgaagggagtgagaagtttcttgggtcatgcgaggttctatcgccgattcatcaagaatttttccaaagtggtaaaccctttatgtaagcttttggagaaggatgccaaatttcatttatgaggattgcatgaaggcatttgaattgctcaatttgaaattgacaactactcatattatcactgcacctgattggagcttgccttttgagctcatgtgtaacgcaattgatgtggcggttggagcagtcttggggaagagaatcaataaaatcttccttccagtctactatgctagtaagaccatgaatgattcccaagtcaattacacagtgaccgaaaaagagctgcttgttattgtttttgctatggagaagttccgcccatacttgatgggtacaaaggtgatcgtccacatcgatcatacagcgctttgatacttaataagcaagaaagattcaaaagagaggttaatgtggtgggtgcttctattgcaagagtttgatctagagatacaagaccgcaaaggtagtgaaaatcaagtggcggaccacttgtctcgattagaggaggaggggaggccacacgatggcctagagatcaatgattccttccccaatgagcagcttctagctatttcaatgactaggatgccatggttcgccgactttgaaaattatcttgtgagtggcattgtatcgaatgagttctcttcaaaccaaaggaagaagctcaaacgggattgccttgactattattggtgtcacacctcctttttccgcccccgcgaggggtgaaggagtttttccaattaaaggacaatcgaaacgggatttgttcgtttatttcagagtcgccacttgggagatttagggtgtcccaagtcaccaatttaatcccgaatcgaggaaaagaatgactctgtattacagtccgcgaaccagaaatccggataaggaattttgttaacctgggagaaggtgttaattcccgagttccgtggttctagcacggtcgctcaactgtcatattcggcttgattatctgattgtatataaatatgaacttatgtgcagattttaactctttaccgctttcattattattattattatcttacagggaattgcaacgttgtgaaaatgttcctcgaaccgcgtcacaatcaatgtacccgtggtcgtcgacacactttgactccgttgagatttggatttgggtcacataaatgtgcacccgagtttaagaagataacattattaaatacgtgcctaaagcgattagagtattattattttaggaaaggccgcggagttcgctaagcggcctatcccgagttctaagtaattaacacatacattttttgtgagggccccgcaatctgtgcattttatttggcgaggctcgtctcatttttatttaaaaggtcgtcctatagtggctatgttttctattttgtttgcatctaaaataaatgaaaacgtcctactttatttacatacctatgagttattatagttaagtttcgaacgtgatttgttgaaagagggacgtgatacgagcagtccatttggcagttatggacccaggcccagcacacactgtatggactggacctgggccattccttttccgataagggcctgttaattcatttgactcaggcccaacatttataaggctgaaatgggaaccggtgttattttattctaacggtattgttgcaatttataacgaggcaacctactaaatgaagtgagattaactaacaatggatagttcagcacttaacatgcgttagaagatatgctaaccataaacatagctaaaattcaagatattgcttactacactatcagcttttttgtctaccagcatacatacacagtatgatattaagttgccatacatgacgtttagttatacatgatggctaccttcattatcctaatagaagatgtgaactattatacacaacttaatgttcaatatacagactatgtatgattcaaaaatacaacttcaactcttccttttttgtattcatgtttcaactttcagcttacattgacagtgtatcagtggtgtacctggtattgagaaaagcaaaagaagaaaggaatgatcagtggaagcagtagcatatacagcaacagcagcaacaagagaagcagcactcagcagcaaacaacccagccggcagatgtttaaaaccaatacaaatccagcaagaaaatccaataataaccagtaggaggaaacaacaacagatttaaaccaagcagaagaccagtgaactatcagaccaacagaaaacccaaaacaactcagctgaaatagtgttcaatcaagtatttgcagcccagcagcatcaaaacaaatacaggctaacagagaaggaaacagatgcagaaaagcagtagtttctgattgttatggtcaaaaaactagcacactcttaactctttattactttgaaacagactatcctctaaaggttggaagaccaaccttgtttttgcttttcttttctctctcacttaaaactgtccagcctctaaacttaactgtccagccttaaaaccaattttttcctttccttccagaattaatcctttctccaaaaaaaatcctctttcaaacacctcaatgagcctgtttaaaggccagcaatggcaagcccacaggctgccttcccactctgcccatacccccttaaactaatcaattatgcccatgatattcctgacagactccccataccgcatgcttttctcttttttaatcaaagttatgggtgtttaacttattttaatcaacctcccccatgccatttaatcttgttccccactattgcattagtttaatcctatttcagtaccctattgtcagcccaacttaaactaaacatgtttggtcttttcaaacccccaaactaccccttttaaaccttgattattactgtattaccctactgcaacagtaggacattttgaacttctgaaagttcaaattcaaagcttccctaaactgagttctagttattgcgttgtagttacaaaccattcacaaataatgtcaaacaagccgatagacgacaatgatatccatcatatgaagctataagaatcagaatatttgaacattcagtcctgtaaaactaatcgacgacatttatctaatcgactatactaattataacatagaacaaacagtcgaccaaacaatcaacataaataaggcatcaactgtctttgacaattttgcacgacacagggaaactacaggcattatcgatttgacgatattaatcaaatttaaatatgtatatcactatacgtattcaaccataaacagaataacaatcgacagaataaaaggtcttatgaagatgggggacaaattggaaaaaaaaatatcagaaataccaaataaaccaaacaaacatgctgacaaacccaaacaacatttaaacaaaaacagaagagagaaaaggaactcactctggaaactcaaacacagacgacccaagcccggactggatttgcccatttgaggtcgaacaaaccttaatcgaggtgttctcaaccgagaacacttcgattaaattctatgagaccccaaccctttgttatactggccggattccaaggttcttgtgttctagagttcgaaccagtccgatttagggcttgaggatttgtgggtagatttggaccaaaccaagcttggtttggtcacgagtgagggcagtgtaatggttggtatgaatccggggtgggttggtgtagatcgggattttgctcgaacctgctaatgaagattcgagacgatagggactgattcgaacccaacggtttgcagatccgtgttctgggtggttgggtgcatcaagggtgttactttgggtggccaccggcatcgtttcctccgggctcatggtgagagtgtacgggggcggctagggtttggaacaagggtttggtttgtgtttgggacgatagaagggggggtgttcggataggggcgtggggtaaaggtttaggcttatatacgtagtaggtggttagatcctggcctttggatgaagtgagatcgatggccaggatctttcacttaatggggaacgacaccgtttggcattggtttggggggtcggtttgaatcggttactgggtcgggtttggaaacgggttgttgaaaggggttttggactgttggattggactggatggaaggctcagatcaaattccctatgcggcgtcgtttgggtaagtgaatggcctgatctggaccgttcatttgaatcaatcaatggctcaggatggggatgctgatacagcgtcgtttggggcgtgcctgggaagcctgggtttggactgggttgtggtaattggtttgggcctgattttttcatttaaattttggcccaaatccggtattttccttctttacaattagacaaaaattcctaaaaaccaaaattaaacacacaagtattaattaatacctaacaacaattatcacatgaattaaaacatctaataaagttaccctgacaacaaaatagaagaacaatgcatattttgtgattttcgcttttaaaaccaaatcatggttaattaattcgtaaatgtaccattttccctaaatgcatgcaacatttcttttttgtatttaactatagcaaagcgagcatttacggacaaaacaattatcaaaaaatattacacaaatccccaaaattgtacccgaaagtaacctgttttatttcttttccgatttcttttggagtagttttctgtgaagcaaaaatcacgtgctcacagctgcccctctttggccgaaaacacaaagagttttcgtgcaaagataaagtgagcggatacgagcgattttttcccgttggaatactccgtgtgaagcattttttggaaaaagatttaaccgaacctttgcttcaaaggtttcctacatatccctggctataggggaatcaggttaatgtagttcgggaagttttggtagctgggactaccatgggactgcaatgttgctgatgttgcatgctgttatcactgcttaccgatctccttgttaccccgtgcttaaaagaaaacaagaagctaggctagactacggatcataagatctcatctatcttcaacttgttcttgttgccttgctttcttgttggcttgtatttcttctggtgcttttcttccgtgaatttggggatgacactggccttttgcttttctgaataccaattttcatcattttgttcggtccgctggggatatggcttccttcattaagctttgttatgctgggcataatttaatgttcacaggccgcttccttcgagacgcatcctttcttccttttgactcatgggcttgaatttgcgctgggacatcttgttgcaaccttctactttccggtgctggggaattttattgtttcctgctggggattcctgttgcaaccttctgccttccggcgggttactgatttcaagatctgcggtataagactgaaaagtattcctctcattatacaggtgggcgcctacttaactaagacgtgaaaatattcctctcattatacaggtgggtgcctatttaactaaaacatgaaaatattcctctcattatacaggtgggcacctatttaactaagacatgaaaatattcctctcattatacaggtgggcgcctatttaactaagacatgaaagtattcctctcattatacaggtgggcgcttatttaactaagacatgaaaatattcctctcattatacaggtgggcgcctatttaactaaggcatgaaagtattcctctcattttacaggtgggcgcctatttaactaagacatgaaagtattcctctcattatacaggtgggcgcctatttaactaagacatgaaaatattcctctcattatacaggtgggcgcctatttaactaagacatgaaaatattcctctcattatacaggtgggcgcctatttaactaagacatgaaaatattcctctcactatacaggtgggcgcctatttaactaagacatgaaaatattcctctcactatacaggtgggcgcctatttaactaagacatgaaaatattcctctcactatacaggtgggcgcctatttaactaagacatgaaaatattcctctcattatacaggtgggcgcctatttaactaagacatgaaaatattgaatttgtttcctcgttcctccgagaaagtttttgataatggcaagaattttctgccggtcttggtgaccttccttgtggtgtgtctttctgtcatcctcatctttttttttcctgtagaatcaaagaaaatcttgttagttttaacatggtgagtgattcgtgtcactcctgctgggggatgactttccatttatccctttccctttcccttgctctgcgctcccaaaactggttgggatgaagttgcttgctggggatggtatgtctgctggggatggttttccgtttatcccttcctcgctcttttgttttgaaacaagttgtgggagtccctttcaactccaaaactactcccttaaaagtttattttatcccggccggcggattaattctctcttcctccttccccctttatgtggtgtattaccatctcggaccttggtccgtgatctgtcgcagttcttgctggggatcttttggaacttggtccacaaatccttcaactgtcgttttcttcatgttccccttatctttctaagctaatttgtcgccttccgtcctattgccttggttttggcctgtgcccttcgcattttgctttgtaccattttggcccctggtagtaaactctgaaaagtccttctcaaaacaaatttctggaaaagtcttttagacaaagagacgaaaaagatagaaaagagaaaaaatctttctgaacaaatgctggggggaagaagaaaaggaaagaacttatctgggtggtatgactggtccctacgatcatgtcgtgcattacggattacccgacctagtctatttgtatcaatcaatttttctgatggccttatttgccggggatgaataggttcccacctcttcgcaaatgtggatccttttgccaatctgccttgccgccttatagttcccttcgagaggttttcactaataagactctctctttttctctcacctcccgtcgccttacggtgcctgtgaaggttttcaccgataagactctctcgttttatctctctcgtctttcatcgccttatggtgcatgcgaaggttttcacaaattaagactctctcattttatctttcaacgggggattggagtgttgccgatatgactctctctttcggagattcttttcggccatcaactcattgccagtttatgaccctcttctttgctggagattagcgtattattctcggcttccattggcctgacttggtacctctcagatattgatcgggatcgatgttggttttgtgtgtcaaatttttaacgtaactttgatgggtgaaatgttacaactcttggaatcaaaccctttttggagattcaaaaaaaaaactcctgccccagttttcttgcttggggaattttatatttacactatgttgagctatgcctattatgcacactatgcacactatggtgcactatgaccgagccgtgaggcgcctacgtatcctctttgaggaatcagatcaaacgtagttcctacgttcctttgtttttcttatgatctttatcttgttttcatttttcttttaatttattttctttttttcatatctttttcccattagtgattccaaaagaggggtatgaaagaataactaaggctcaaaggggggaagcaaaggttaaaagtgtttggatagagaaaagaattgcctccgtcatttcattatccaataagtaccaaatacaaacaaacgaaccaataactaccataattaaagaaattacgcataatatcttttgactgcatcagaattgatatccatgtcgacacatcttccctcgatatctgttagacacaaagcaccgttggacaatactctggtcacgatataaggcccttgccaatttggggcgaacttgcctattgcttcgacctgatgcgggaggatccgtttcaatacttgctgccctacttcaaattttctggggcgcaccttcttattgtatgctcttgccattcttttctgatacaactggccatgacacactgctgccaatcttttttcatctattaagttcagctgctctagtcgagctttgaaccattcatcgttatcaatcccggcttcagcgacaattcggagggatggaatttcaacctccgccagtattactgcttcagttctgtataccaacaaataagaagttgcacctatggaagtccagactatagtgcgataacccaacaaagcaaagggtagtttctcgtgccattgtctagattcttccaccatcttccgcagtatcttcttgatgttcttattggctgcttcgaccattccatttgccttgggacgatatggggtggaatagcggtgtgtaatcttaaattgttggcatatcactctcatcagatttctgttaagatttgcaccattatccgtgatgatcacttttgggaccccaaatctgcagatgatatgggagtgaataaaatccaccactgccttcttagttaccgacttaaaagttttagcttcaacccacttggtgaagtagtcgatggtcaccagaatgaacatatggccgttggttgctgctggcttaataggcccaatgacatccatcccccatgcgaaaaatggccatggtgctgacattgtatgcaattctgtcggcggagaatgaatcagatctccatgtatctgacactgatggcatttcctcacgaagttgatacaatcatgctccatagtgaaccaatagtaccctgctcgaagaatcttctttgccaatacatatcctctcatatgtggcccacaaactccagcatgcacctctgccataactgtcgtggcttgaccagcgtctatacattttagcaatcccaagtctggggttcttctgtacaacactcctccaatgaggaagaaaccatttgacaaacaccaaagggctcttttttggtccccagtggcctgctccgaatatatccccatcttgaggtactcctttatgtcataaaaccatggctcgccatctacttcctcctgtaccgcgttgcaataagcatgctgatcgcgaacctgaatgtgcgacgggtcaacatacattttttcgggatggtgtaacattgatgctaaagtggccaatgcatcggcaacctcattatgaactctcgggatatgtctgaattccactgatcgaaatcgcttggtcagatcgtgcaaacattatcgatatggtatgagtttcaaatcccgtgtttcccactcaccctgaatttgatgcaccaggaggtccgagtctcccaagaccaaacttcctggacatccatgtctgcagctagtcgcagacccaaaatgcatgcttcatactcggccatgttgttggtacaatagaagcgtagctgagctgtaacaggataatgacgtcctgtttcagaaatgagtactgctcctattccaacccctttcgcgtttgcggctccatcaaagaaaagcttccagcttggttcctcgggtaattccatctcacctgtgtgcattacttcctcgtctgggaaatacgtcctcaaaggctcgtattcttcatcaacgggattctcagccaagtgatcgaccagcgcttgggctttcatggccgtcctcgtcacgtagacgatatcaaactctgtgagcaaaatttgccattttgctaacctccctgtaggcataggtttctggaaaatatactttaatgggtccaaacgggagatgagataagtagtatacgaagacaagtagtgcttcaacttctgagccacccaagttagggcgcaacatgtcctctcgagttgagtgtacttgacctcatacactgtgaacttcttgctaagataataaatggcctgctccttccttcctgtaacgtcgtgttgccctagcacgcaaccaaacgaattctccaggaccgtcagataaagaattaatggcatccctggctcaggtggaatggacagataccctttaatttggttgaaagcctcttgacactctgccgtccagtctaccgcggcgtctttctttagcagccgaaatatgggttcacaagtcatcgtgagttgagcgatgaacctgctgatgtaatttagtctccccaacagactcattacctctgttttgttctttggcagtggtaaatcttggatggatttgatcttggatggatccaattaaataccccgtcaactgacgatgaatcctaacagctttcctgatggaaccccaaaggcgcatttggccgggttgagcttaatatcataccttcgaagtctttgaaaaaatctccttaggtctgctacatggtcttcctgacgccaagactttatgatcacatcatctacgtacacttcaatttctttgtgtattatgtcgtgaaacacagtagtcattgctcgcatgtacattgccccagcattcttcagtccgaatggcattacccggtagcagtaagttccccatggtgtaatgaaagctgtcttttccgcatcttcttcgtccattaagatctgatgatatcctgcatagcagtccacaaaggatccgatctcgcgcccagcgcaattattgatcaggatatggatgttgggcaatggataattatccttaggacttgctttgttgagattgcggtagtcgacgcataccctgattttcccatccttcttcggcactggtaccacattggccaaccaatcgggatatcgagtgacccaaataaccttcgcctgcagctgcttaatcacctcttctttgatcttcacactcatctctgttttaaatttcctcagcttttgcttgaccggagggtataccgggtcagtgggcaatttgtgaaccactagattggtacttaatcccggcatatcatcatatgaccacgcaaaaacatctttgaactccatgagggttttgattaattcctccctgacgtttggctcaatgtggatgctgattttggtttctctgacattatctgcgtcccctagattcacagcctcggtgtcattcagattaggcttgggtttctcttcaaattggcacagttctcggtttatttcttcgaaggcttcatcctcgtcatattcaaactcatcgtcataaccgatctcttgtataattaagttggagtcagattgatttattagactaggtcgaagatccgctgtgcatgccatgtcattagaaccagtaaaaagagaactgttcagaaagaaaaagaacaaaacaaaattaaaatgagacaagagaagagaattttattaaatttgcgagataacagggttcacacttttacaaaacaaaatgagatttcgattacaccctggaataatccgaaacaagaaagcaaaaatcaaagcctactaccaggactccccccggataggaagaggagtaaccgtccaattgttggttttggccccaggccccacgaactgtatgtctgccctgctggaaccctctccaacttctaccatattgacattagcgaacagcctttcgaaactctgattcaaatccccgtccatcccaatcaatggtccgagaatttttgggaccggtgaccccttggcacttgctctaataaaggatcttgagagacgcggtatcagtttgggaagaaaccaaactctcttctttgttttctgcgctcgctttacatctgccgcagtcggtttgaaccccggtccaaaggtctccaaattcttgggcaaggagacaggttggacaatcccctgaagatcagccccaggccttttcccggcacaaacccattacccaacatttctgaaaccatcatgaccgttgcggaagctaccctagggtgctgaatgatctcaccctcgaaaatcttgtttgccgatactgcatcaaaaatctggtaaacccaggggcctttgtcatcattggtttctatgaagggcacaatggcgcctcccatagtgcacgcagtgtcctcgccgtgcagtacgatctcttgtctatcccactcgaacttgaccatttgatgcaaggtggatggcactgttttagctgcatggatccacggtcgtcccaacagaaggttataagataccgcggcatctaatatctggaactccatggtaaactggaccggaccgatggttaactcaagtataatatcccccacggtggctgttccatttccatcaaatcctcggacgcaaatgttgttcttgtggattcttctgtggtcgatcttcaactggcttagggtggacaatggacaaatattggcacttgagccgttatccaccaatgcccgagtaactgccgaatcttcacatttgacaattaagtagagagctctattatgttccgtgccctccactggcaggtcatcatctgagaatgttaccctattcacctcaaaaattttattggcaatcgtttcaaggtggtttacagaaatctcgttgggcacatgagctttatttagtatcttcatcagggcccgacgatgttcatctgaatggatcagtaatgataacagcgagatctggtccggtgttttcttcaactgttcgaccacggagtaatcctgcactttcatcttcttcaagaattcctcagcttcttcttctgacacaggtttctttgttgcagctgggttgggtcttctcaactccactggagcaaaacaccgtcctgatcgagtcagtccctgcgcctcacaactttcctcctccacttgttttcccctgtacatcaccactgccttctcatacttccaaggaacgacctttctatccatcattggcaattggactaccgactttatggtgaccagttccctgtatacccctttcaacacaactgcgggtgtgggtggtgtccctgatattaccaatttggctggctttggtttctttgttgcggtggacggactctttcccaatatcactactggcttgacacctttcccttgcaactgtacctctagtcttacaccggtcgattcttctttcggagcggcttggattgtcatcactgcctgtgatggttttattggctctcctccctcgtataccaactcgatcttgtgagcttcgtggtgtactggcaatgggttctggttgatgttgggcgcctccggtgcctggacctcgattttgttggcatcaataagatcttgtattgcctgcttcagcctctaacatttttcagtatcatgccccagcattcctgagcagtactcgcagcttatcgatcggtccaaattttggggctaggggttttgctctctaggttcgacaggactcaccaaacctagctgtctcaatttgtggaatacggcggtataggtctctcccaactcagtaaaggctttatgtctctgtagcctgtcatttctagcagcttgactccctcgaaagcccgcccccggagggttcctgtatgctcttggtggaggataggtgctttgtggtggagggtaggtgttttgtggtggtgcatatgtgttctagggagccggtacgcgccattgcgggcgaaccggaggctgaaggtatgtttgggcttggtgcacggagaagtggggttcttgaggtggatagtagtgttgtggtgggctgtatgggtagtttggcctatgagggctgggtcggttgtagtatggtttgccggacctagaccaattgcttgcctcaaccgtggcgatttcttctttcttcctccttcccaacacacctcccatgccgctctgaatagcctgggtcgttgccttgagagctgagtaattcatgattttgtcagacctcagaccctcctctattatgacccctatctttactactttattgaaggattttccaaccgtcgtcaccaagtggatccagtgtttgcaagaagtagtccaccctttctccctctctcatgggaggatcaactctggctgcctgttctctccagcggaaaccaaactcactaaagctttccccaggcttctttccggtcctcagcaatgtgagacggtcagggactatctcgatattgtattgaaagtgacccgcgaaagcctgcgctagatcatcccaagtgtaccatctgctggaatcctgcctggtataccattccaatgtcgatccactcaagctttgaccgaaataagctatcagcagctcatctttgccgcctgcccctctcattttgctacaaaagccccgcaaatgtgccatgggatcaccgtgcccttcatacaaatcaaacttaggtatcttgaacccagccgggagttggacgtccgggaaagggcatagatccttgtaggccacgctgacctggttgcccaatccatgcaggttcctgaaggattgctccaggattttgaacttcctcattacctcatcttgctctgggaccttaaccggcttttcaatctccgctagtacctccaagtgcggattgtaggtatggggttctggtgcattgaatgtgggttcagggggatagtattgcgtttgagcctgaaacaacggctcgctggttgatctttgcagggtggctgatgtgggtcccataaaagtgggaacatttggtgttgggagaggttgatggggtggtggagcttgggaatcatgggggcttctctcctgatgatagcggtgattcgggaggcttgttgaagggccagagtgagggtattccggcatatgccctagtggttcagggctcttttgtgctttggccaaagctaactgcattgcattcatctctagtcccatcatttctatcttctccttcgcttctttcaacatctggcttactggcctttcttcctcggtactattttctgaagtagtcatgctcgttgttaccggtcctttggatctggtttgataagggtgtgttgccagaatgcgttaacaactaactgtctggtattgagaaaagcaacaaacttattagcgttagagtttaacagatttgataatagcacattggggatgcaatgctcctaggcagcaaaccatttctaacatgctttgcttcaaacacatgcgtcatcccggcttgattatttgcccctttaaagtactttgggaacccctgtatttctttccatttttttcttctttttttctctttttttcttttcctttctttttaatggcggtcgaatcttatgtggattgcctacgtatcacgtccccgcgtgaatcagaccgggcgtagttctgccacaaagtaaagacacaaaaattcttttggaatcattcaattcatcacccaaaatttgctattgcaaattacttatctcaaacaaagaacagcaatagtacagattccaaagttcttaacctgaatcgatgaaaagaaaaagaaaacaacatatgggaagacaacaaagccaataaacaagactcgaacaagggattaaaattccaacttaggggctcgcgaggcatcgttcggcctttccgcagactttgatgtgaggcctttctgcaagctcttcaactcattcatgatccggtggacgtagcccatgatggaagcaaggaggtattccgaggtatttgctcacacgataggcatctcatgtagatgtagtgcccaatctcatcaatccttcctcgaatgttgtccctctcaacgaacaattgctctattcgccggttctttaatcctagtgcttgagcattgtcggcgagtcgatcctggaacttctccatttgtctttccattctggtcatcacatcgtaacagcgccttctgtcagcttgggcatctcgtgcttgtttgaagatccgctcctgaagagtggaatttgttttccttaatatcccgatgctcatttcagaatcccttatgatttgttgcagatgctttctacgggccattgtaccttttgcccatctgacctttattcttgctatgcaagcttccgatctctctagttcttcttggcttttgctgacttgatttcccaattctgctatcaatctttcgtcggagcgacgtttctgtcggtcattgttactcttactgacttggcgaacgcgggcttttagtgtctggttttctttggctaatttgttcttttcaccttgctcagaggcgacttgcacgttgttctcaaatataagcctttcaacttgttgctttagcctcccgatttcagcctggtagtcttggatgtgagctctcttagttggtctgtggtgctcaagctctcttctgtaccacgtgaggtattttggcgacacttcgcccttggcccgatcttgtacacaagtatttactttcagggtttgacattcattccagattctccgaacgactgcttcagggaactgcccaccaggcccgatttcgaccacctggctactgagatcctcttccttcgggattatttgacatcgccccaactgcctcaatactctgtttggcgcataaggctggatactttggagacccattaacaacaaatgagactcgatggctgacatgtgtatgacctcatctatgggtagccacccaaatgcccattctatctggtttgctgaaacagagcgcagtagagtaacccattcggcgaccccttctggcaagctgaacccgtcgaccctggtggaaaactcttctatacaagtctttcgtgatgacccatattttagaaattgagggcgatgacatagatgctctatcatccacatttgcagtagtatattgcatccctcaaagaaacctcctccggttttgcaaacagtgagtgcgcggaaaatgtctgctattatcattggtgccagagtgttgttgtcttgcttgagcaaagtgctgacgaccccaacgatttgtatgttaattttcccatcctttctagggaacaccggaaaacccagaaaggctatcataaaagcaatacacctatgtctttcccatttcagctggctttccccactgcagatcttactctcgggattgttgaaccctccaagatgaccgtacctgtcgtacagaaatgccaaactacaaaacccttatgacaactctgggttgtgtaccgttctgtggatctttacggtatctacgaatctgtgtatggtcacggtccttggtgcaatgagatactattctctcatagggattttaggacatccgatgtaccctgccatctcctctagcgtcggggtgagctcaaagtccgagaaatgaaatacattgtgtgtcgagtcccaaaatgaaattaaatcccttataatgtcccctcgcggatcgatgtccagcaatccaaccaaatttcctaagtatattttgactgtatctcgccctgattcttacaagtcgtttcaccacatgcgtaagcccaaagggactctgtttataatggccccatatgaactcttactcgtgctcattctgcacatttattaaggtgatttagacgaaagcaaaaatctttattttgactccaaaaccatttttcccgttttccttaatttttgagaaaagcaagactgactttcccaatatggcctttcagctcttcaggggtgaagattttaaggcagtgggattttaaccgtccaaaaggtaagaaaaatggccaaaggcggccgttggtgcaagacaaccttccgacgtccctttcgggaacattcggctatttccgcaaaatggcatcacccgactcttttatgaaagaagcaatatatgtatatatatatatatatacatatatatatatatatatatatatatatatatatatatatatattatttgcaaaaataggaagttggacccgataagggttgcctacgtatcccacatccggtgagaatcaaaccgacgtagttcgggtaagaaaattagctaaatcacgaatccaattctctttcctcaaaaatcaaaattatttggacattggtttttctcaaatgagcagctcttaatttttcaaaattcccgttatcacccaccggtcaacatgcaagttcgaagcaaattaaatgcgccaacagacaatatgcaacaagatggtcttttttgttccagtttgctattcctagacgggcccaacccctgtgttgagccccctaagtcagatgcaacgtgatgcaaataagtgttttcctactagggatccggcatgaagtcatgttttactaagtttcaaactgggctttgttctagacctggcttacccgagcggacaactcgagtcgaggagggggctacgtaccggggacccgcgggatcgtccggctttgtaacttgtccggcctttttcttatttcaaggtatgacactaacagaatagggagtctcgaccagcgagcttctccccggaggtaagaagagaagggtttcggcacagattatatacagttcaaataatatcaaagcggtaatacacattattttgcacatgaagcacatatctcataaaaatatcagataaatctaaacataacaatttattctaagctcgatttctaaccctgaaccagtggttctgggtctatttatccccagcagagtcgccagagctgtcacacctcctttttccgcccccgcgaggggtgaaagagtttttccaattaaaggacaattgaaacgagatttgttcgtttatttcagagtcgccacttaggagatttagggtgtcccaagtcaccaatttaatcccgaatcgaggaaaagaataactctgtattacagtccgcgaaccagaaatccggataaggaattctgttaacccgggtgaaggtgttaggcattcccgagttccatggttctagcacagtcgctcaactatcatattcggcttgattatctgattgtatataaatatgaacttatgtgcagattttaactctttaccgcttttattattattattattattattatcttacagggaattgcaacattgtgaaaatgtgcctcgaaccgcgtcacaatcaatgtacccgtggtcgtcgacacactttgactccgttgagatttggatttgggtcacataaatgtgcacccgagtttaagaagataacattattaaatacgcgcctaaagcgattagcgtattattattttgggtaaggccatggagttcgctaagcggcctatcccgagttctaagtaattaacacatacattttttgtgaggaccccgcaataggtgcattttatttggcgaggctcgtctcatttttatttaaaaggtcgtcctatagtggctttgttttctattttgtttgcatctaaaataaatgaaaacgtcctactttatttacatacctatgagttattatagttaagtttcaaatgtgatttgttgaaagagggacgtgatacgagcagtccgtttggcagttatgggcccaggcccagcgcacactgtatggactggacctgggccattccttttccgataagggcctgttaattcatttgactcaggcccaacatttataaggctgaaatgggaaccggtgttattttattctaacggtattgttgcaatttataatgaggcagcctactaaatgaagtgagattaactaacaatggatagttcagcacttaacatgcgttagaagatatgctaactataaacatagataaaattcaagatattgcttactacactatcagtttttttgtctaccagcatacatacacagtatgatattaagttgccatacatgacgtttagttatacatgatggctaccttcattatcctaatagaagatgtgaactattatacacaacttaatgttcaatatacagactatgtatgattcaaaaaaacaacttcaactcttccttttttgtattcatgtttcaactttcagcttacattgacagtgtatcagtggtgtacctggtattgagaaaagcaaaagaagaaaagaatgatcagtggaagcagtagcatacacagcaatagcagcaacaagagaagcagtactcagcagcaaacaacccagccggcagatgtttaaaaccaatacaaatcaagcaagaaaatccaataataaccagtaggaggaaacaacaacagatttaaaccaagaagaagaccagtgaactatcagaccaacagaaaacccaaaacaacttagctgaaatagcgttcaatcaagtatttgcagcccagcagcatcaaaacaaatacaggctaatagagaaggaaacagatgcaaaaaagcagtagcttctgattgttatggtcaaaaaaccagcacactcttaactatttattactctgaaacagactatcctctaaaggttggaagaccaaccttgttttttcttttcttttctctctcacttaaaactgtccaacctctaaacttaactgtccagccttaaaaccatttttttcctttccttccagaattaatcctttctccaaaaaaaatcctctttcaaacagtcctcaatgagcctatttataggccagcaatggcaagccctaggctgccttcccactctgcccatacccccttaaactaatcaattatacccatgatattcctgacaaactccccataccgcatgtttttctcttttttaatcaaagttatgggtgtttaacttattttaatcaacctcccccatgccatttaatcttgttccccactattgcattagtttaatcctatatcagttccctattgtcagcccaacttaaactaaacatttctggtcttttcaaacccccaaactacccctgttaaaccctgattattattgtattaccctactgcagcagtaggacattttgaacttctgaaagttcaaattcaaagcttccctaaactgagttctagttattgcattgtagttacaaaccattcacagataatgtcaaacaatccgatagacgacaatgattcgatccatcatatgaagctatacgaatcagaatatttgaacattcagtcctataaaactaatcgacgacatttatctaatcgactatactaattataacatagaacaaacagtcgaccaaacaatcaacataaataaggcatcaactgtctttgacaattttgcacgacacagggaaactacaggcattatcgatttgacgatattaatcaaattgaaatatgtatatcactatacgtattcaaccataaacaaaataacaatcgaccgaataaaaggtcttatgaagatgggggacaaattggaaaaacaaaatatcagaaataccaaataaaccaaacaaacatgctgacaaacccaaacaacatttaaacaaaaacagaagagagaaagggaactcactctggaaactcaaacacagacgacccaagaccggactggatttgcccatttgaggtcgaacagaccttaatcgaggtgttctcaaccgagaacacttcgattaaagtctattagaccccaaccctctgttatactggccggattccaaggttcttgtgttctagggttcgaaccagtccgatttggggcttgaggatttgtgggtagattcggaccaaaccaagcttggtttggtcacgagtgagggcagggtaatggttggtatgaatccggggtgggtttgtgtagatcggggttttgctcgaaccttctaatgaagattcgagacgatagggactgattcgaacccaacggtttgcagatccgtgtttagggtggttgggtgcatcaagggtgttactttgggtggccaccggcatcgttgcctccaggctcatggtgagagtgtacgggggcggctagggtttggaacgggggtttgggtttgtgtttgggacgatggaagggggggtgttcggataggggcgtggggtaaaggtttaggcttatatacgtagtaggtggttagatcctggccgttggatgaagtgagatcgatggcaggatctttcacttaatggggaatggcaccgtttggcattggtttggggggtcggtttgaatcggttactgggtcgggtttggaaacgggttgctgaaaggggtcttggaccgttggattggactggatggaaggctcagatcaaatgccctatgcggcgtcgtttgggtaagtgaatggcctgatctggaccgttcattcgaatcaatcaatggctcaggatagggatgctgatacggcatcgtttggggcgtgcctgtgaagcctgggtttggactgggttgtggtaattggtttgggcctgattttttcatttaaattttggcccaaatccggtattttccttctttacaattagacaaaaattcctaaaaaccaaaattaaacacacaagtattaattaatacctaacaacaattatcacatgaattaaaacatctaataaagttaccctgataacaaaatagaagaacaatgcaattttgtgattttcgcttttaaaaccaaatcatggttaattaattcgtaaatgtaccattttccctaaatgcatgcaacatgtatttttttgtatttaaatatatcaaagcgagcatttacggatgaaacaattatcaaaaaatattacacaaatccccaaaattgtacccgaaggtaacctgttttatttcttttccaatttcttttggagtagtttgttgtgaagcaaaaatcacgtgctcaccattgggatgaaccgtatcttttacggatatgtaccgatggtgtgatccgatgatgtgtgccagaggaagaacaagtggaaattcttgaggcttgccactcttcaacgtatggtggtcaccatggcggagctggaacggccacaaaagtgttgagttgtggattctattggtctactctctataaggatgctagtggtctggtcaagcattgtgatgaatgtcaaagggccggtgggatttttaaaaagaatgagatgcccctcaccatcttggaaattgacatcttatatgtgtggggcattgatttcatgggactgtttgtgagctcttgtgggaacacttacattttggtagttgtggactatgtgtcaaaatgggttgaaaccttggctttacccaacaacgaagcttgaagtgtggtggcatttttgaagaagaacatctttacaagatttggtactccaagggctatcataagtgataggggttcgcatttgtgcaataaggcttttgataccttactcaccaagtatggtgtcactcacaaagtctcaaccccctatcatcctcaagcaagcggacaagtaaaagtcattaaccggagatcaagagtattatatcaaagacagtgaatgccaaccagacagattggtcaagaaaacttgatgatgctttatggacttatagtacggcttacaaaacaccgactgggatatctccatatcgattggtgtttgggaaggtttgtcatcttctggtggaacttgagcataaggccatgtgggcactgaagaagttgaaccttgagtgggatgtcgtcgcgaacttaagggtggcacaattgaatgagcttgatgaattctggtaccatgcctaaacaatcttgtctctattcaaggagaagatgaagcacatccatgacaagtacattcgaaataaggaattcaaagaaggtgatcttgtgttattattcaactctcggttgcgaatgtttcccagcaagttgaagtcaaaatagagtggcccgtttgatgttgttcttatgacaccattcagagcattggacttaaaaaataagaatgatgaagtgtttagagtcaatgggcgtcgggtgaagcactatcttggaaaagttgatgatggccacatcgtggcggttcttcatttcaagtgattggtaatttgtgtcgtgccgcgacgttatattaggcgcttcttgagaggcaacccatgtgtctttttcttttttcttttctttttcattagatagtctttgttttgtgctaactagttttgaagggtatgcaggaatgggtatgcattgcagggactggatcataaaaattggctaagtgttgaaaaagtgtggaccgcacattaattgtgcacaccgtgcaattctgattgcaacagcagaaatcactctatgtccacacaatactatgtgtggtcgcacaactggaggacaaaaattgcaagctctctgaagttggtctgtcaaaattcatagccaatctgcggccgtacacaaaattttgcggcccgcacaaattctgtggcctaattcacttttgtgcggactgcactcaaaattgtgtggccgcactcagcttaagtttggggcgacttggtcaacctatatattgaaccttagtgcactattcacaactttatacaactctgagttcttgagacctaagaaagcacaatgcacatcgaattagctcacactcctcactcatttcatctatgtagattattacctgcatcattcatcactggtatgttcattacatctttagatttttcaatttctcttagttttcattcttctgtggaagagtattcttagacctaaaatgtctaatgtcattcatgtgggtagtatcatatgtgttcattggggactgggtagatcattaatcatgtttcattgcaactacaatgtctcaattgtgtaaaaaaattgcaaaacataaagtcagtggtacgtgatttcttattgtgcatccgcacataaaattgtgcggtccgtagatcttagaattagagcaaatgtgttgcatgaaaagtgcggaccgcactcaaaattgtgtggtccgtggaaaagtgtgggtgaccgcattgttaaaggatcagagaaccagtactctgaacctgagattgtgcggccgtactcaaaattatgggttccgcacatcagatgtgcgaccgcactttaaaattgtgtggttcgcacatggcagtctgcgaccactctcatttttgtgcggtccgcactgtctctcctgtggtctgttttcctacaactgtaatgcaactgtttccacttatttgaaatccaactgacttatatacctcatattgcaaacaatggtttgatcacgaggaagaggtgatacttctaaagggaagggtgaaccctcccgaggccgaggtagggacaacctcccactctcagtccaaacagaaataagcaaaaaggcaactgccaacagagtccctgaaccctcaaaatgcattgtgtatctcctgtctagggaagcctcagaggaaaactctgtgcaagcataacctgatgcctaatctcaatccaaacaagttcagggtagactacaattgagagacgaatcctcctcctctgctagttcttctgagggttcggaagagggtagccaagattttgagccctcttcctcaaatagcccagcaacaccaatccctattgatgatgatgatgatgatcctaaagatagtagatggggtgacactagagtgggaggcctaaagaggtcgaagaagaaggaggcatgcgaatatcgatttgtgagtttgacagccttcactaggtttagagaatggtggacccaaagataactcacacttgagtggcaattcttagtgaaggatttggataaataaaatccaaatgtccttcagcagttcagggagcgcaaggggtggatgtggttcaccaagagtgtcgtggacgccaaggagcacttggtacgtgaagtttatgccaatgtagcacgcatcaagaaaggtaccaaagtgaccaaagtaagaaatttgaaagtcagatttgatcaatgtactatgaacacctatatgggatttgaggaggtagaggtagttcagtatatggagaagcttacaatgggtgatgcagctcgcccttaggtagtagagatcttagcagctctaggaccactaccaccatggatcacatcgggagctcccattgcacaaaacacccttaattctgaagcaaaagggtagaaaacttttgtgtgcggccggatagacccgagcagaaatgagaacaatattccacttcctcgagcagttctagtagcatctatcatgggcgggtacccaaacaatgtgggtgctatcatgtcggccaacatatcagtggttttctgaaagagtgaaagctcttatccatatccaatcaccctcactaaatactttaaggatgccaaggtggagctgaggagatttgatacacaggtgcaggccaaaaatcccttctcatggtactctctgcaaggacccaggaacccaaaattcaagggtaaagtagctaccaccaatggccagtctgatgagccaacgatggtggttacagattcttctgctgagccctttacaactaccatgcctttcgtagtagtcgatccttctatcaagacatctgacatgctaccacctccatcttctagaccatctacattagtacctgtgcctacctcatccatatatccactcattaagctgcgagtctcccagaaattggcgagtctcaacaactgaatgcagacagctacttcaaagttgtctgatatatctagtgctattgtagcacagtcttctaccctagcagcatcacaggtacctccgtcagtggaggaaacattgtcaaagatcctggaaaatcatatgaccattatggatacattggtggcacatgggacagtcattgaggagttgggcaaatcggtgaagaagatgcaaaaatctcaagcttcgaagaagtcaatggatagattaagaaaagaagttaccaagatagcatctgctgaagatataccacttgatttgcttatggagtcagcactagcagcacctgcagcaccagcaacaccatcagtgtcggagccatcagaggcagcagctggccaatttaaggagccaaaccttgtttcccacactactgaggagatgttgcagatgttctcaaaccctgttattccctggccgaaggatgatgagatccagttggcggagtccgaggatgatgatgaccctatgcacactgagaccatatagggagttctcttaactctctacccttttcttattctgattgttatgaagcattgaggacaatgcttgttcttattcaggagggtggtctattttgattgatttaatatgagattggatgtaataactttaatactctttttcttttatctttattctctttttcattttgtatatattcctccctctcttttgatgtatatattttattcccctcagtttgtattttcatttgtcttactttcagtagtttattttatagcttttctagtttgtttgtcttagtagtataacttcttatttactctaatagcttctttttgatttggtagcttctttttatgtttaagtgagcaataagactttggtttttttaatgtcacgattctttccaaaggtgggttttgtgtgaaccgggtgacttttcccaacgatggatggcgtgacaaccttcttaagggactgagtccattttttatgtttaggtaaaaataatagtattaatgaataaaacgggacatgcatgcttcacttggtaccaacacatttaacaatggtcttatgcttaaaaacaagtcttggcaagaaataactttaattagtgacctatagactcttgtattgacttgagcaatcatcgagtggtttagttgaaccattagcgattttcaatcttgaatatggttgttgtgggccctcgactctatcctctttaacattccaatcgtgtgagaagtgatatttttgtagcaagtacaagtacccgtacgaatggtctagaacttgccccgaatgtatttctaggagaaattctaagttttgcttggcttgagaagtgattgtaggctctccttgatgcacttgaaattttccatgtcccaccaatgttgcaatccctagtcaacccatttaagcctaagacctttctcatttgatagccacgttacaagcacttacccattttgtaatgaccttctcttggcaccctagctttccttatcactcttgagttatcactcttgagaagtaattggctaaaacataagttcgggggagagacaaggaggttgaaagtggtaagaaggcacaaaaagaaaagaaatgaagaaaaagataggcaaagaaaaagaaagaatgaacaaaagaaaaatgtaaaaagaaattgaataaagtaaagagttgaagggattcaaagaaaagcaatgatgcaaatcatggagaaaacaaagaaggagaaaattaccatcttggccgaaaaagagtgatgttaagtctctctagttcccccaaggaaaaagaaaatgactcatagagtcgacaaagtatgagccaaaaagagaaaatggagtatttaagggaagatgaacccattctattccagcaaatcctatcttagtccaaagccttcattacatcccgaaaatgccctacatgatttcaagtcgagtgagcttatattagaggcaagcatatggtacctagagccgtacttgtgacattcttttgagagagatgagcgaacttttcaaaaatccttgaattgagtgctacattcttaagtgagatatgctaacggagagtagaggatgaggagtttgggatccattatgacctacatgaaagagcgagcttccttgatgaataaagtcaactctcgatgctctagtgtcatatttgaactattgtatttggaaagtccaatcgttgccttgttgaaaattcataggtgttgtgggtaattattggtcccaattgatgtgtgtttgattcaccttaggctagctgaaatagatcttttcttgtggaggtgggaattaccttatttgcttgaggacaagcaaaagcttaagtttgggggagttgataagtagggattttgactacttatttgcaccattttacgtgttttagctcaaaaatacttaaaggtattcccgagaactgataaaatgtacttacttgcaggattattggaaaatgagccaaagagataaaaatcaactcaacaaggagtaattttttataaggactaaaacaaagcaaaaaaaagagcaaagtgtggatcgcacaatattgtgtgaggctgcaggcatgaagagacctataatgaattttctttgcaaagtgcggaccgaacaattattgtgcggctgcagaagatgaggttcagagagatgtgattttggaccatgaagaagtgcggactgcactattattgtgtggctgcagaatcaaaagagcggccacactcataaatgtgcggaccacagaagtctcccatgtcaaagctcaaagtcaagagtgcggccgcactcaaaaatgtgtggtctgcagaatttaaagaagtgcagccgcaacccaaaattatgcaaccgcagaagtctatcctgtcaagccagtttcaaagtgcagaccttcacaggggcaattttgtttgataatttcagttgtgtataaatagtctttttggttaaaattaggttaagttttgaacacctaaaaataaatagccgtttttcctttactgctttgggtcactttgtagtagtttatcattttaacattggattttcttccctttatcatttattatgagtttaatcttattttcttctttagtttcttcaattttctctatgagtaactaaatttctagctagggttctgacccagccctagtgtgggtacctaatgggtgtttgaattagggcttgtgtgtgattgggctagtgatatttagcttagttcttgcttgaatttaagaattaatggttgcaagaattgattcatacctaattgacttagtctctacttgagaaagagagattaagtctaggaaaacttggctaacaaggaactggggtgaactcaagaaattgatagccccaattaaagggttgaatctagtgatagtaagacccaacttgagcatttatcacttgttttatgcaatgcctatttggacttaagaaagacaaattgggcaaaaccactctaaataccgagaggtattgagtgggtaattgcgtgtgattgctatattacgaccccgaccaatcaaacttgccctagagcctacaatccgttaggtaaccacctaggtggaagtcacgatcctagatattttataaacttgaaaaacaacaacaccaaaaatatcattctctagctttttatttgcaaatattagcataatcattagaagtagaaaaaacaaccaaacatgtggaagtgcattttgggaacatcatacacttagtctagatatatacctaatccaatataatctatttgtagaattgaccccgactcacgttgggtaattataattgcatcgaccgcttcacaatcccaattagtggtgtaaattgggcgatatcaactgccctctagaaatgcgaggtgaactgcgtacctcaatcagaaatgatagacacgggcacaccgtgaagaagaacgatctcgcggatgtaaatctaagccaaccactctgaagaataggtaactgccatagaaatgaaatgcgctaacttggtcagcctatccacaattacccaaactgcatcaaactttctctgagtccgtgggagtccaacaacaaaatccatagtgatatgctcccacttccactgaggaatctctatcttctgaagcaaaccaccaggtctctgatgctcatactttacttgctaacaatttagacactaagctacatatgcaactatatcgttcttcatcctccttcaccaataatgattccgcaagtcctgatacatcttggcggcacccagatgaatagaataccgggaaccatgggcttcctcaagaatcaactcacgaagtccatatacattgggcaaacaaacacgaccctgcattctaaaaacttcatcatctccaatagtaacctacttggaacctctgtgttgcactgtgtctctaagaacaagcaaatgagggttaccatattgatgctccctgatgcgctcaaacaaggaagaccgaacgactgtactagctagaacacgcctaggctctgaaacatccaacctcatgaactgattggctaaatcctaaaaatctgatgcaagtggtctctcaccgactggaatgtatgcaaggctgcccatactcactacctttctactcaaggcatcggctactctattggccttcccgggataatacaaaatggtgatatcatagtcattcaatagctccaaccacctcctttatctcaaattgagctccttttgtttgaacaagtactgtaagatttgatgatccgtgaatacctcacacgacatgctgtaaagatagtgtcgtcaaatcttttgcgcatgaacaatggctgccaacttcaagtcatgaaaagggtaatttttctcgtgaaccttcagttaccgcgccacatatgcattcacattgccatcctacatcaataccgtaccaagtccaatacgagatgcatcacaatataccgtgtaagatcttgaacctatgggcaacaccaacaacggcgtcatagtcaaaacagtcttgagcttctgaaagctcgcctcacactcgtctgactatctgaatggggaacccttttgggtcaacctgatcaatagggctgctatagatgaaaactcctccatgaaccgacggtaataacccgccaaacccaagaaacttcgaatctccgtagctgaaatgggtctaggaaagttctgaactgcctcaatcttcttaggatccactagaatcccatctgtcgatactacgtaccccaagaaagtgaccgagtccaaccaaaactcgaattttggaaacttagcatgtaactatttgtctctcaaagtctgaagtgcgattcaaagatgttgctcatgctcctctcagctacgggagtagatcaagatatcatcaataaacacgatcaaaaaggaattcaaatagggcttgaacacccggttcatcaaatccatgaatgttgttggggcattttttagcccaaatgatatcacagaaactcatgatgcccatactgagtccaaaatgttgtcttagggacattggatgccctaatcctcaactgacagtagccataccccaaatcaatctttgaaaacaccttggaatcctgaagctgatcaaataagccgtcaatcttcggcaatagatacttgttcttgatggtgactttgtttaactaccgataatctatgcacatcctcatcgatccatccttcttcttcacaaaaaacacaggagcacccccagggcgagacactaggtctaatgaagcctttatcaagtaagtcttgcaactgttccttcaactctttcaactctggcggggccatatggtatggtggaatagaaatgggctgaatgtccggagccaagtaaatatagtagataatatccatgtcgggtggcatccccagcagatttgcaagaaacaccaatggaaactcgtaaacaactggtactgaatccatagggggacctccgcactagaatcgcggatataagccaaataagttagacacccctttttgaccatatgttgatccttcacataagagataaccctattggtagaatggtcggagtccctctccaccctaatcgaggaaaccccagcaaggctaaggtcaccaacttggcatggcaatccaatatagcatgataaggtgacagccaatccatacctaaaatgatatcaaaattaaccatatcgaaaagtagaagatctacaggagtctcaagactcccaatagtaaacataaatgaatattagacatgatctacaataatagaatctcgtacaggtgtggacacatacattggagcactcaaagaatcacaaggcacaactagctatgaagcaaaataggatgacacgtaggaataagtagagcccaaatcaaatagaactgaagcatctctatggaaaactgaaataatacatgtgataacagcgtctgatgactcagcctcaggcctagctgggaaaacataacatcggggctgggccccaccaatctaaactacatccctaggatagcctctagctggttggcctccacctctagcagtctgacctctacttctagtggcctaacctccacctctggctgcttgaccccttcctctagctggctgagcgggcggtagtgcaaccggtgtcagaatcatggcacgataactctgctatggtgtgcctcccaataatctcggacatgtcctcctgatatgcctaaaactaccacactcaaaacatccatcctagtgctatggttgctaaaattgagattgacccgcacaagctagataaccatggtaataactctgaataggaggtgcactgataggagttgacggtgcacaataggctggcttcccagaatgaggcacataaggaccacgactccctgaagcactgtgggatgcctgaagcgctaactgaaatcgcctgagaggatggcccctaccaaaagtacccctgcctccagatgaggcaccgctaaaaccaccagaatgatgaggcctcttatcaggcccctgccctctcttctgtgaaagaacatcctcgatccgcccgccgacattagcagccgtctaaaaagaaatctcacccccgatctccttggccatctgaagcttaatagggtgagtgagtctctcaataaacctcctcaccgtctctctctctctctctctctatctctcggtaggaagcagaagaatagcatgacgagctagatccacaaaatgggtctcatactcagtgactgacatactgcctactggagatgctcaaactacctgcggtaactctctctcaatgtgaccggaaggaacttctaaagaaatagctgagagaacttgtcccaagtaagaccagacgaccagctggtctggtcaacatataatctctccaccatctcttggcggaactaatcatttgaaacacaacaaaattgaccccattggtcttaactatatctatgttccgtagcaccgcatggtagcggtcaagataatcatgtgggtcctcagaaggtgcaccgctaaagtgatctgggaaaagcttggtaaacttgtccaatctcaacaagccctcagaagacatggcatgtcccttaccagcctgtgccacaacaattggctgaactaccccaactagcggggttgctagagtctaatactggggagatatctgctccagagtgttagtagcgggagtctagagctcctcccccagcctgagagatgactggtgccataagaaatgtatcggcctgggccacactctccataaggtcaacacagaccaaagcgttctgaagtactggggtggcgatgaacccctcgggcacctgagctggcccaacaggtacagtctaagttggaacctccttatcaaaatctacttgaggctccactactagtgctgctgctcaaactctaggctaagctttgcctctagctcagcctctgccatgactacgggctcggcctctgccatgactacgtgatcgacctctgcccctagtaggagctaccactgggggctttgactattgttcagctgaagatgcagtgcgtgttctcgccatctgcgagagaacaagagtagaagagttcaattagcagtggcagaacaaaatcgcacgacagagaagaatagaagtgaaattgttcctaactctatagcttctataagataagtacagacgactctgtaccgatcctccagactctactaagtttgctcgtaatttgtgagacctatgtaacctagtgctctgataccaacttgtcacgatccaaaattcccaccatcgagaccgtgatggcgcctaacatttcacttgctaggcaagccaacgttagaataatttatccatttttaatagtttaaattaaataatgataaagaactgaaatatatgcaataatccaaagtaaaaatgaggaagctaaaatagccaaacttctaatacaaccccagacccgatgtcacaaatgcacgagctactagaatagtacaaacaaaggtttgaaacaacataaagttgtctaaaaagaaagtacatagccaaataaaaagggaaggggactccagaagttgtggcgctgagcagctgtacctcaagtctccaaaagcttcccaatccgagcacgctaataactatcgctgggaacgactccaaaatctgcacaagaagtgcagagtgtagtatgagtacaaccgaccccatgtactctgtaagtgtcaagcctaacctcgacgaagtagtgacgaggctaaggtaggtcactcacactacaacatgtatgcagtatataataaagacagaaaaggaaatacgaaaagaaataagatagtcaactgaaaataatggctatagccttacgaaataagctagtgacgttcagaattaccaatccttagagtttcaaatgaaaatactgaaaaccaacacaactcaaggaaataaaaacacatagattgttgttgcgtgcaacccgacatacaacacagaatcctcccttattttaccataacaacatcaacaacaataaataatatatatatatatatatatatatatatatatatatatatatatatatatatatatatatatatatatatattgcggtacgcaactcgataccaccatataacaatatcagtatcataattcacatttatttcaccgtatcagtccacttttattccacctattgcagctgcaacccgatcttaccatatcagtacaacttcacccttattccatcatatcaatccacccttattttacctgttgcgacgtgcaatccgatcccactatatcagtaccaaatactcaatgtgcacagtcaaatcaataattcaaatcacaaggacctttacaatcaataaataccaagctgaaccaataagggaaccttgtacaatatgggaatttacacgggttatactacacaataagtcaagttcggtaaataacaattagaaggtgcaagtaagccgattagggcaagtagtagtggatcataaaaatatgaaagagtccttcattattaacaggaaaaacaatgattaacaggtagcaaataagcattaaaggcatttaggacatataatatttaaaacaaggaaggagataatcaaggaaaagcagaaaatcagggaaaataggtaattcggtggtgtataagcactcgtcacctcgcatatacgccgcaacacatgaaatacacatagcacacagttcgaggattcctaattccatcaagtcaaggttaaactcaaaacttatctcacatcgtagtcaattcagagctctattatgacctttcctctagaatccgccttcaaaccacttgtatctaaccacaactgactcaataatatcaaatattgctaaaagaatcaattacaatgcataaatttagaattctaccgttttcccaaaaagtcaaaaatcgaccccaggtccgcttggtccaaacccaaaattcggaccaaaacctaattactcattcacccctgagcccggttaggtaatttgtcttgaaatccgaccttaatttgaggtctaaattttaattttgcaaatatccttgattctacacaaaccactaattttcaccatgaaaattctagattttaggttgaaaacttattaaatataatggaaaattgaaagaaaataggttagaatcacttaccaatgaattggggaagaagagttcttggaaaaatcgtctctagggttttctagttttgaaataaagaatgaacaaaaatcccgtctaactcaacttttacacagttgcagatgtcgcaattgtgatatcttgttcgcaattatgaacatcgcaattgcgagaaagaggtcgcaattgcgaactcctctcagaatcccagtaatcgcatttgcgatggtcgcaaatacgaaccctgatgccctcacaaatgtggatctttcttcgcaaatgcgaagatcatcacaaaatgtgttgagtcgcaaatgcgactctaccttcacaaaaacggaaatggaaagtttgcaaatgcgaactttcacctcacaaatgcgagtacccctcctaccatgcccaggctcgtaagtgcgatggtttctttgcaaatgcgaaccaaatttcgcaaatgcaagatctgcagcagacaccaaaaactaaatgcatctgctatgtttctaagtccaactcacctcgtcgcctatccgaaacgcacctcagccctcggggctccaaaacaaacatgcacacaagtccaaaaatagaacttgctcacgcgatcaagtccatttttttggaaaattgaatcaaattgtacttttttttataattctgcaaattgataaaatttatgtcaatttttacgtcctttgttcctcacattcttccacttcaaagataagatccaaagacagaggttttctattatctccatgtcgtactcactagtttctcttttaatgtcttcccgcatttctttatttcgtattttcatctttaggtaaaaattcaaaggcttatattctttttctttctcattagttgtcacttctcaatattaaggatattgattttattgtggatgggagattcatcattacaatgaataaggcattagtatctaaacggtataatgaaacaaaaaatatacgtgttatagaaatgtaattttataaaagaaattatcgttataataatggataggtaatatactattataaagaggtataatataacataaaagtttgttttcaaagatgaaatacagtcattgtggggtttttagaatctcacataaatgcttgtggcaaacgtaacagcaaactttttttgaaacccccacaatttattttgtaaaaaatcatcacaaatcttaaaaataatcccacaaaatgagctttttcttgtagtgccttttgcaaatattatgcaaaccggtatagggattttaacatttgattagtgcgattaaaaaatatgtcacaaacttgaaagataactcgtaaagtcacagaatggttgaataattcattgtactacacaggatatatcgataataacacagcaataaactaataatttaatcacataattttctagcaaactgaatgtaaaaagggatcggagttcattctaaaacttattttaggcaagtttcgtatcggaatgtgaggggaaagttaggagcaatattttttttaaaccgccttgtagtagcgaggggtttgacatcgaaccctatcatgtatattaataatcaaaagatgaatatataatgaagggggacattaaacttaacctcctcagaatatggatgagagttcgacatgcccagctctttacagttagcttgcaaacattgatgcaatgaaagatattacacattggagaatgtacagtataatacattaaacttctctccataatatatgttaatgctgattctaggaaaatgctagaaacaaacttagcttatccattagcatcatatacaaaagtagtcttggagtttcttactcagaagcttgtcatccggtacttatccatgtactgttagaaaaataacgggataaaattaatctggcttcgataaagtaatcactatccttaaggaatttaagcttcccactttgttgctgcatggataatagcagaactcctccaggattttacaatgccactgaaatcgagtttcagcaaataacttgaatttcccataagaacagaatatttgtgagttatagaaaataagtaaaagagaaagagatgaaaattggtaaatctttctcttttcttgactaaagaatgcattttatgggtctagcactcccgtcataagacgtagaagcaaaaaaaaaaacatgtcgtagaaggagataacaggtggagccaacaacccactaagactaacctttctacaactacatccccgagtgcaaccaagtccatttttgaataagaaagctaaatcatcaccttatttgaggaagtagccatggaagattgggtttgtatggcttcctggggtcgaaagatcttccttcaaccttgggcaaggacaatcgatgattggcttaatttcctgagggactctagtatcaaaaaatttcggctttcatcgtgaaagtgtcacatttagattgttcttatttccctcaggaatgtttatcatggagcccagtgttgccaatgcatctgcgaacttattttttctctaggtagtggagagaaactgattttcttgaattgctcattgagcttttcagtactttcgtaactgatctttttgtaggtgatgggttggggaatttttggctgtggcaagtcaaggaaaggttaggtcaaggtatttcagacagaagtcccatcaatcagaatctgaagatgtattttgttttggagatgatatcgatatttataataatcttaggagtctgttggaattaatagactcatcttttcataaacaggcaccttttaaaaccaatggtcacctattttgaatttataaaaaaaactattgaaaaacatttttcctgaaattaatttaaaatattttaaattaattaataaaataataggtaataaaatattaattcaggctacttaattggctcaattgtaccaagtgcccaatcttgactattaataataaagtcaaatttctatttacctccaaaatattctttaaaatattcaaactatatgagacaaagaagtgcttttaacaacttcttcctttctttagtttctcaatgaggtaagaaacaacctcttctcaaatacgtccatcaaacactaactaatctaacaagtactactgggctctagctcgacttggaagctcttgagcagagaaattcgtttagttggtcctttcttatccttcttcagctagagcatcagcaactctattagcctccctttagcaatgtgtgatatggaaaatctcaaattgtgatatgaatttttatattttctctgtaacccaattaattaccaataaggaatctaagtcaacacaaatcttgttaatgccttcatccatgcaccattcaagaccatcacataaagctatagactctgctgcattattaccctggataccaaaaggtgctgtaaaaataggtattatctcacattgatgtccccgaacatctcccccaccaccgttggttcctgaattgcccttggagcatccattagtattgagtttaatcatatcggcctggggaagtttctagatagcaatggtgatgtttagttttagctttgttgtttcacaaatagtaatcatttggttccaagtggtgtctatattgacttgtataaactgtttgtgaataagaatagcagcttcacagcatatcaagtgagctatcttagaaatgtaaattctttcttgttcataatttttcagcacctagtcttccaaatatgccaattgattagaagaggaataacatgtagaataagcttatgaattggattctgataattagcaaaccaccatgttaacatctcatgtctaattttccctcaagattctttaattccaaactggttctgaagatattccatatattcttgctaagtttgttacttctaaaaatgtgattcacatcctcactcataggaatatcacaacagtcacacctagagggatatgaaaaagtaagattcctgatattatcatcagttggtagtttatatatcaatagcttctagttaaagaatgaaattttaaaaagggatagccttatgccacagattcttgttaataaaagtgacacctttctttgtctcagagcattccaggtagaggaatatgtgaattctccattagtagctccagtctatactgcttggtcaagtttgtttgagataacaattttgatccctttgatatggttgactagatgatctgggatgcactaggataacttagcaatatcccaattgttgttagggatgaaatgagaaaccatagttttatggagtacgttatagttacatagagttgatatagatcccaaacttgtccagttatcccaaaggaaggatgagttacccttttggatcctccaatatgtttggtctatatctttgtttatattcattaaactcctctaaggtctagattgcttagctttcccttttttggccactggatgtaatctgctactatatttagccttcagaaaagttaatcacaatttcgtgtcctgaatagcaaccatagtgtagctataaaggacttagaaatatcatataatcttttaaaaccaattcctccctcttcagtagggtaacatagtttggtaccagtgatgtttcatattaccttcctgctgcccccagaagtaattttcaaagtatctctcaagagttttgtgtacagtctttggggtttagtagatatataggagatttataggaatatacagtagataatacatgtttaatcagtatggcttttccactagtaaataattgtgatgacctaataagtcactttaagctttagcctttaatttcgtattccgagatctcaactagtaccatttagtatttctcaatttatgtgtatagtccgtgtcatgttcataaagtttttatgtgaaaaatttaagaaaatgtaaaaacttgccttaaaactcatttgaccgtggttttttgccttaagaaaatgtttggaatcgaattcgcaagtccctaacctgaattaacatggtttgttgaaaactagtgatttgaaggcttaaagaattcccaagtttgaccgtgggttgactttattactaccaagttcatatttcagttctgaaacatggaatgggttaatttcaccatttatgacttgtttacaaaatttagtgcaaaacggagttgatttgacgtaattcggacgttcggtagtaaatttgtatgttttttagtttttttgaaagttttattcattttaatgtttgattcgtagttctcagtgttattttgatgctttgatcgcacgatcaagttcgtacgatattattatacttatgtgcatgtttggtttggagcccgaaaggctcgggtgagtttcggataggctacggatcaattttggaattaggaggattactggtttcaaggattcttgattctggtgctttgttcttcgcgatcgtgaagccactcccacgattgaaaagagtaaccagggatggggtgggatttcctctatgcgaacgctagtttgaggtcgtgaatgcgaagcaatagtgggatcactcttcggcctggaaggggatcagttgtgtgttctacgcaaacgcaatcgaagggtcgagaacgcgaagtccagaggggaagagtcatctgaatgcgtaggacatctcacgaacacgaaggccactgggaccgctgcactttgtgatcgcgttggcccttcgcgaacgcgaagaaggcttgacgcccattgacttaaatgtcctaaagacgggattttcttcatttttcaccatcttcacattagagctcgacctagaggcgattttcaagaaacatttcttctccactccgtaggttagtatacttaaactcgttttcttccatttccatcaatacccattgatttctaaccttaatctacgctctttcatggtagaaaattagggatttgggtagaattggagacttttgtaaacttgagtttagacctcaaattgaggttggattttgaaactaatcacataatcgggcttggggtgaatggataattgagttttggtcttaattttaggttttgaccaagcgggcccagggctaacttttgttgactttttagaaaaagtgtaaagttctttgctttctctattgtaattgatttttctagaattgatttttctagaattgattaatgatattaagtcgattttggttagattcgattggtttggagacgaattttagaggaacgttcccggttgagctttgagttgattgcggagtgaggtaaatgttggatctaaccttgatttgagggaattaggaacccttaaactatatttatatgaattacatggtaacagcgtatatgcatggtgacgagtgaatatacgccgtcaaaataattatttccatgtccttctcgtacttcatgaattatcttactctatgccttaattgttacatgctttaattgtcttctatgccgtaatttattacttgtcattaattatatttgtattaaattgttcgttccttctatgactccatgattaattgttacttgccttaattgccttatttgtataccttaactttcatatatttggcttgtcttgttgcttttgtattaattgtagtatttcttgatttggtacagggttcctttattgctttgctttcatattcttttatcgtagaaattcttgtgaattgaattgttaggttgatttcatttattgaatttttgtatggatcgagtttcacgccgcaacggttgtgtacgtaatacttgatattgataaattgtgacatggtgaaataagggaggattatgatattgattatgattatatggagggatcgggttgcgcgtcgcaacggatttaatatgtgattcttgatattgatatggtggaataagggaggattgtacgtgtatagtgggatcgaggttgtgtgccgcaacggattgtgtgtgccgcaatggattgtgaatgatgtattcattgttgttgttgtgttgattttcagtgttattacatgaaattatgaggtcggttattccgggttctctgattacaagaatgtcacgaccccaaataccccggtcgtgatggcgcctatcacgatactagccaacccaaacaagtaactacagtaaattcttttataaaatcattttctaacactaattaagtctcaatttttcataagaaatatctaaatcacttaaatatgcgggaaaaaatagtaaaacatcaaatcaacacagcccaactacttggtatcacaagtttagagcctctaaatacaacaagtctaactagctaatacataataagccctaaaatgtagaaaacaaagataggaaggtggaaagcagggctgcggacgccgtgcagctactttgcagcctccggtaagctccgataatgctggggaccctcactctactgctcgggcacctgaatatgcacacaaagtgcagggagtaacgtgcgtacgccaactcagtaagtaactaaagtaaataaggtctgagtgtagcgacgagcagttaaaaatcatatataaaagtatacaacagagtatcaaatcaaactcaaaagtttaaaagccaattacttcgtaaaaactttagtttcaattgagatactttgaaatcatttacttagtagttttcaacagaggcacctcataaaggaagagtgaaatcagcaaaaattcataaatgggcccctcgggtaaggaatcactcataaatgtagcctatcgggcaagcctctcagtcacttgtgagtcagctcttgtcacacagtactcacactcagtactcaggctcaataatatctcataatagtaataatcataataattgttgcagcgtgtagcccgatccatagtttatagtcgactacgctcactgggggtgtacagactccggaggggctcctacagcccaagcgtcatatctctgcggcgcgcagccaaatccaatatatatatatatatatatatatcgttgcggcgtgcagcccgatccatataagtatcactgcggcgtgcagcccgatccataatatatacatttattattgttgtagcgtgcatcccaatccgtaatatatatatatatatataatcctcaccattaggtcctcaacctcactcagtcattaacctcacagcccctcgggcataacagtggaaatcagggaaactcagcccaaacagttttcacattttaagaagtagagtgataaaaactaggtttaaacaataaacaggtcaaatatgattgggatatgctttcaaacaaatagagtgaggaaaacagtaaaatgcccctaagggtctcaacaggtcggcacaaggccccaaacatggcatacagcccataatatagtatcaatctctaaaatacgtgatatcataagatttcaaatgaaatacgtggcttactagtcgctataggacgaaccaagtcacaatctttactggtgcacgcccacacgctcgttacctagcatgtacgtcacctcatttatcaaaacaatacgaaataccggggttttataccctcagttccagatttacaatggttacttacctcaaaccggatgaaatactactctgcgacgctattgcctctcgcctcggcctcaactcgcactgaatctacccaaaatcagaatcataacattagaatatgctaagggaatgaagccatcgcgaaaataatcaaattataccaaaaatcctgaaattgatccaaacctgacccccgagcccacgtctcgaaattccataaaaatcacatcaatagaatccttatccccaccccccacgagtctattcataccacaagcatcgaaataggacctcaaatggcccctcaaatccccactcaaagttctccaatatcaagccttaatccctcaattttctcccttaatgtccactaataccataattaaacaatgaaaaaatgatcataaacacaactaatgaagcttaggtagcttacccaactgataatcttcgattccccttgaaattcactgccctagctcacttcccgtcttcaaaaatggagaacttaggaaaaatgcgcaaccttatatactttctgacccaggtatttcccacctgaagtccctttctccgcttctgctctactgcttctatggtcctacccaccgcacctgcggaaataactaaaaacctcatgaccgtacctgcgccatcgcagatgcgtccataagttcgcttctgcggctccgcctgacttgcctcttggccgcttctgcggcttgcttccgaatctgcgggagtcgcgcctgcagcctcccaaccacagatgcggttatgacagcaatcataaaacttcagctgccaaactcaactccaaaacctcccgtcaaccatccgaaatcaccccgaggcccccggggcctcaaccaagagcacgaactagtcatataccaatatccaaacttatataaatcttcaaaacacctcaaacaacatcggatcgaccaaatcacatcggattcaagcctaaagttctaaaatctttgaattacgcttttgttcaaaaagtctaacaaaccacatccgaatgacctgaaattttgcacacacatcccaaatgatataacggacctactgtaactcccaaaattccattctgactcctatatcaaagtctcacctatcaaccggaaaacaccaaaattccattttcgccaattcaagcctaaatctactccagaccttcaaatccattccaatcacgctcctaagtcccaaatcatctcccgaagctatccaaaccatcggaattcacgtcaagccttgttcacatatgtcaacatccggttgacttttccaacttaagcttactcaaaagatactaagtgtctcaaaactcaccaaacctctccgaactcaaaccaatccacccgataacatataataccactaaacaaaacaataagaagtaaaaatgggggtaaacggagcggtaactcatgaaatgaccggccgggttattacatcccccctcttaaacaaacattcgtcctcgaacaagttaagaaacatacctgaagcctcaaataggtgaggatatctgctccgcatttcccgctcgatctcccagctttcctcctctatgggtcgacctctccactgcactttcactgaagctatatccttcgatatcaactttcgaacctgatgctccaaaatagacattggttgcacatcataagtcaaatcatcatctaactgaaccgtgctaaaatccaaaacatgagacggatcgccaatatacttccgaagcatagaaacatgaaataccggatgcatactcgacaagctaggtggaaaagcaagcttataagccacttccccaatcctctgaagtacctcaaaaggccctatgaatcgaggagtcaatttacctttcttcccaaatctcataacacccttcatgggtaaaaccttcaatagaaccttctcaccaaccatgtaggacacatctcgaaccttcctgtcagcataactcttttgtctcgactgcgctatacgaagcctctcctgaatcaccttcaccttgtctaaagcatcctgcaccaagtctgtaaccaatagcctagcctcaccgggctcaaaccaaccgaccggagatctacaccgtctctcatacaaagcctcatatggagccatcggaatactcaactgatagctgttgttataagcaaactctgcgagcggtagaaactgatcccatgaccctccaaaatcaatgacacaagcacacaacatgtcctccaatatctgaatagtgcgctcggactacctgtccgtctaaggatgaaaagttgttcttaactcaacctgagtacgcaactctcgcggcacagacctccaaactgtaaagtaaactgagttcccctatctataatgatagaaactgggatactatgcaaacgaacaatctccggatatagatctctgccaactgctctgaagaataggtagtacacacaagaatgaagtgcgcggacttggtcagcatatccacaatcacccaaatagcatcgaaattcttcaaagtccgtgggagcccaactacaaagtccatggtaatctgctcccacttctactctggaatacccatctgctgaagcaagctacccggtctcttatgctcatatttcacctactggcaattgagacaccgagccacaaatcccacaatatctttattcattctcctccaccaataatgttgtctcaaatcctgatacatcttcgcggcacctgaatgaatggaatatcgcgagctatgggcctcttctaaaatctactcccaaagcccatccacattgcgcacacatatccagccctgcatcctcaatactccgtcatcaccaatagtcatatatctggcatcgtcgtgctgaactctatccttaaggacaagcaaataaggatcatcatgctggcgctctctgatgcgatcaaataagaaagaccgagaaatcatataagccaatacccaactagattccgaaatatccaacctcacgaaccgattggccaaagcctgaacatcaactgcaagaggtatctccccaactggaatatacgctaaactccccatacttaccgccttcctactcaaggcatcggccaccacattggccttttccggatggtacaagatagtgatatcatagtcctttagcagctccaaccatctccgctcctcaaattgagatccttctatttgaataagcgctagaggctatgatgatcagtaaacacctcacaagacacaccatacaaataatgcctccagttcttcaatgcgtgaacaatggaagccaactccaaatcatgaacagggtagttcttctcatggggcttcaactgataagaagtataaggaataactctaccctcctacatcaatacacacccaataccaaccctcaaagcatcacaatacacgatatatacattgatggcaaaactaacactagagttgtggtcaaggcagtcttgagcttctgaaagctctcctcaaactcatccgaccacctaaatggagtacccttttgagtcaacttggtcaagggagatgtgatagaagaaaatccctaaacaaaccagcggtaatagcccgccaaaccaagaaatctacgaatctttgtggctgaggacggtttgggccaactctgaaccgcctctatcttttttggatcaacctgaataccctcgctggacaccacgtgccccaagaaagccactgaactgagccaaaactcacacttagagaactttgcataaagcttctcctcccccaatctctgcaacacaactctcaaatgctccgcatgctcctcctgactacgtgaatacaccagaatatcatcaatgaaaactatgacaaacgagtcgagataaggtcaaaacacgttgttcatcaaatgcatgaatgatgctggggaattggtcagcccaaaagatatcacccagaactcataatgaccatatcgggtcctaaagttgtcttaagaatatttgagtccctaatcttcaactagtgataacctgaatggagatcaatcttagagaacactctccctccttgaagctggtcaaacaaatcatcaatgcgaggtaggggatacttgttcttagttgtaaccttgttcaactgcctataatcaatgcacatcctcatcgtaccatccttcttcttcacaaatagaataggcacaccccaaggcgacacactaggccgaaaaactcttatcaaggagttcctaaaactgctccttcaactcccctagttccatacgatatggtggaatagagatgggctgagtgcccgacaccaaatcaataccaaaatcaatatccctgactggtggcatgcccggcaggtctgcgggaaacacatcgggaaaatcccttacaataagaatagaatcaatactagaagtctctgcactgacatctctcacaaagtctaagtatgaaagacaacctttcccaaccattcgctgggccttcagaaacgaaatcaccctacaggggacaaaatcagtagaacatcgccactccatctgtgtcacacccggcatatccaacattactgtcttagtgtgacagtccaatatagcacgacacggagatagccaatccatgcccaatatcacatcaaagtccaccatacagagtaacaatagtccactcgggtctctaggcccccaatagtcaccacaaacgaccggtacacacggtccacaataatagtatcgcccaccggagtagatacatgaacagatgaaacaagagactcacgaggcatatctaaataacgagcaaaatatgatgacacatatgaaaaagtgtaactgggatcaaataacacagaggaatctctgcggcagactgagacaatacctgtaatcaccacatttgaagcaacagcatctggtctagctgggagtgcatagaaacaagcctgaccaccacctgatcgacctcccactctggggcgacccctatctgactgaccctcacccctagctacctgagcgagtggtgaagtaactggagctgaaatcgagggctgacccctctactgagatagaccctcaagaagacaaggacattgcctcctcatatgcccaatctctccacactcataaaaactccccggtgctggagacagggactgaagggaacccctggcaccggaatgaccagtagaaggacctagcatggaagaaccctgaactgatggagcacgggacgaactctgggctagaagggcactgagtgatgaatggccctgatgaggaatgtgaaaaccatgacccgatgatgccccacggtaacttggatgagctaactaagcctgcctgaagggatggtctctaccttgctgaaattgaactctcgaaagagcactaccaaagctgccagatccccgaggcctcttggcctctctctcctctctctccatgcaatgaactgactcaatctcacgggcgatgtcaacaacctcctcaaaagtagcacctgacaccctctcctaagtcatgagaatctgaagctgatatgtgaggccatcagccaacctcctgatcctctctcgatctatgggaaccaaccagaccgcatgatgagctaactcagagaactgcatctcataccgtgtcacagtcatatctccctaatacaactgctcgaactgcctatgtagctcctctctacgagactgtggcacatacttctccaaaaaaagaacggagaactacttccaggtaaggggcgctgcaccaacaagcctacgcctcttataagcctcccaccaagtaaatgcagctccagaaaattgaaagatagtaaatgctacaccactggtctccaaaatacctgttgtacgaagaatcctctaacatttgtccaagaaaccctgggcatccttgccctcagtaccactgaaagtcggaggctgaagtataccaaacctctccaatcgacgctgctcgtcgtctggcataactatttccacatactcttgatctggtgcaaccagctgggctggaggtgcctccagtgtctgaagtccctgcacaacctgctcaggtgtgcgagcaacgggagtttgagtacctcccccgacctgagaagtagctacggccgtagtaactgagaccgcctgagccaaactagtgcacactgatagaatttgagctagagcctcctgaaggcctggaatcataataggcacaaccgatgcctgagctggtgatgctggagcgtccgtaactaggacctgatcgtgaactggggtggctagtggatctgtaggtggtgccctagttgatgtgcgggctacacccctgcccctaccacggcctcgaccacgtcttcgacctctagtggccccaactggtggtattggtggtcatccatcctgaccggtagcacgtgtcctcaccatctgtgagagaatagaataacagaagtttagtactcggatcaacagattcgcacaacaagatttcaagaatataaagtttttcctaaaggttctgtagcctcctgagtttaaatgcagacgtatacataccgatccttaagactctactaaaccggctcatgactcgcgagacctatgtaacctaggctctgataccaacttgtcgcgaccccaaataccccggttgtgatggcgcctatcacaatactaggtaagccaacccaaataagtaaccacagtaaattcttttataaaacaattttctaacactaattaagacttaatttttcataagaaatatctaaatcacttaaatgtgcgaaaaaaaatagtaaaaacatcaaatcaacacagcccaactatctggtgtcacaagtctagagcctctaaatacaacaagccagactggttaatacataataagccctaaaatttataaaacaaagataggaaggaagaaagcaaggttgcggacgtcgtgcagctaccttgcagtcttcggtaagctccgataatgctggggaccctcactctgccgctcgggcacctagatctgcgcacaaggtgcaggaagtaatgtaagtatgccaactcagtaagtaactaaagtaaataaggtttgagtgcagtgacgagtagttaaaatcatatataagagtatacaatagagtatcaaatcaaactcaacagtttaaaagccaattacttcgtaaaaaattcagtttcaattgagatactttgaaatcatttacttagtagttttcaacataggctcctcataaaagaagagtgaaatcagcaaaaatgtcacaaatgggctcctcgggcaaggtatcactcataaatatagcctctcgggcaagcctctcagtcactcgtgacttagctctcgtcacacagtactcacactcaacactcaggctcaataatatctcagagtagtaataatcataataaccgttgtggcgtgcagcccgatccatagtttatagtcgactacgctcactgggtgtgtacagactccggaggggctcctacagcccaaacgtcatatcgctgcagcgcgcagcctgatccaatgtatatatcgctgcggcatgcagcacgatccataatatatacatatactattgtttcggcgtgcaacccgatccgtaatatatatatatatatatatatatatatatatatatatatatatatatatatatataatcctcaccattaggtcctcaacctctcttagtcattaacttcacagcccctcgggcataacagtggaaattaggaaaactcggtccaaacagttttcacattttaagaagtagagtgataaaaccaggtttaaacaataaataggtaaaacatgactggggatatgctttcaaacaaataggtgagaaaaacagtaaaaatgcccctaagggtctcaacaggtcggcacaaggccccaaacatggcatacagcccataatatagtgtatcaatctatatgtaatatcataagatttcaaatcaaatacgcgaattactagtcgctacgggatggaccaagtcacaatccctaccggtgcacgcccacacactcgtcacctagcaggtgcatcaccttatttatcaaaacaatacgaaataccagggttttatacccacagttccagatttacaatggttacttaccttaaactggatgaaatactactctatgatgcctttgcctcttgcctcgacctcaactcgtgtcgaatatacccaaaatcagaatcataacattataatatgccaagggaacgaagcccatgcaaaaataatcaaattataccaaaaatctagaaattgatccaaacccgacccccgggcccacatatcgtaattccataagaattacatcaatagaatccttatcctcccacgagtttattcataccacaagcattgaaatcggacctcaaatggcccctcaaatccccactcaaagctctccaataccaagctttaatccctcaatttgctcccttaatttccactaataccatgattaaacaatggaaaaattaccataaactcaagtaacgaagcttaggtagcttacccaattgataatcttcgatttccccttgaaattcactaccctagctcacttctcgtcttcaaaaatggagaacttagcaaaaattcgcgaaggaaaccttacatactttctgacccaggtatttcgcacttgcggtccctttctctgcttctgcactaccacttctgcggtgctacccaccgaacctgcggaaatgactaaaaacctcaggaccgcacctgcggtcattctctagcacctgcgccatcacagatgcgtccacaagtccgcttctacgattctgcctgacttgactcttggtctcttctgcgacttgcttctacatctacaggagtcgcacctgcggcctcccaactgctgatgtggttatgacagcaatcataaaacttcagctgccaaactcaactccaaaacctcccatcaaccatccgaaatcaccccaatgccctcggggcctcaaccaaaagcacgaactagtcatataccaatatccaaacttataacaatcttcaaagcacctcaaacaacatcaaatcaaccaaatcacatcggattcaagcctaaggttccaaaatattttgaattatgcttttgatccaaaagtctaacaaaccacgtctgaatgacttaaaattttgcacacacatcccaaatgacacaacggacctagtacaactcccggaattccattccaacccctatatcaaaatctcacctatcaatcgaaaaacgccaaaattccattttcgctaattcaagcctaaatctacttcggacctccaacccaaatcatctcccaaagctatacgaaccatcggaattcacattcgagccttgttcatataagtcaacatccaattgacttttccaacttaagctcactcaaaagagactaagtgtctcaaacctcaccaaaacctctctgaactcgaaccaatccacccgataacatataatacagatgaacaaaacaataagaagcagaatgggagaaacggagcggtaactcatgaaacgaccggccgggtcgttacaaagaattgggttcttttcatgagttaactgccttactttttttgttttccttttctattactattactgtaatgcgtacaagttattgtgagtgacccgccttagccttgtcactatttcatcgaggttaggctcagtatttataaagtacatggggtcggttgtactcataatacactctgtacgttttgtgtagattttggagtcagtcctaacggcggtcagtagattgatcggatccaatgcttgtcggagacttgaggtatagctacacagtgtttgcagccctgaagtcctcttctacattaccttagaagtttattttaattcaaacagttatgctttcattcagactattatttatagtactctagtcgctcgtgtacttgtgataccaattctgggattgtatctagatatcgttgttattttagtttattcactctattttagtttattccacttattggttttcatttagtttaaattgttaaaaaagactaataactatttctaatgttggcttgcctagcaagtaaaatgttaggcgccatcacgatcccaagagcgggaattctgggtcgtaacaagttggtatcagagcattaggtttcctgcgtctcacgagccacgagcaatcttagtagactctggaggatcggtacagatatgtttgtacttatcttttataggttgtggagtttagaaaaaacttcacttttttccttctctatcatacgattttattctatcattgatgattgaactattctattcttgttctctcatagatggcgagaacacgtacaacacctacagccggataggagccgaagccccctatgacaactactactaggggtagaggccgaggtagagccagagctcagtctagagctcgagcaacagcacccaaagtggagcctcaaattggtcacgaggaggaggtccctactcaaactgtgcccgtcggaccagcttaagccctggagggattcatagccactttagtgctttaggatgctctagtccacttggtggatcttatggagagtgtggcccagaccggtgcattcctggtggcaccacccgtcttcgggatgggggggagcacaaattcctgctactcacacctcagagtaggcggtgcccctatatcagactccaacatccccgtcgttgggatggttcggtcgattgttgtggcacgggttggtgataggcccgctatgtcttctgaggctttgttgatgatggataagtttaccaagatcttccttattcattttagtgtatcttctgaggatccccaggattacttggaccattgccacaaggtgttgcacaacatgggtatagttgaaaccaataaggtcgactttgcactattttagatgactggttccgtcaagagatggtggagatattatatgctgactagaccagatagtttgcctgcacttacctgggattagttttcatagctatttctagagaagttcatcctggttactctgatggaggattaccccaggcggtttaagcgtcttcattagggtagtttgactgttacccagtacgagactagatttgtggacctagatcacgatgccattattttactccctactgagagggagagcaggaggagattcattgatgggctcacttttactatcaggatacggataggcaaggagactggagatgatatttctttctagaggaccgtagatattgctagaccgatcgagatagtccatggtcaggagagggagccggtgtctaataagaggcctcgtcattctggtagtttcaatggtgcctcatctggaggcaagggtatttttgatagaggccatccttccaggctatttcaatcagcgctttaggcatctcacaatgcttcggcgagtcggggtctttatgtatctcattctggacagccagcctatagtgcaccattaactcctattagtgtgcctccgatccatagctatcaccgtggttatcctgcctgttcgggtcaacttcagtttcagcatccacagcaataagatgggtgttttgagtgtggaggtactggtcatatgaggaggttctatccaaattgttgagcagcatgccatagcaaagttcttgtgctatggtcctagcaccggttgttccatcacccacgcaggtagctagaggtaggggtcaagcagtaagaggtggatctcaggccattagaggtggagtttagggcattagaggtagaggctagccagatagaggccgtccgagagacggaggtcagagtggtgggggccagccccgattttatgcattcctagctagacctgaggccgagtcatttggcgccgttatcacaagtattgttccagtttgccatagagatgcattagttctatttgatctgggctttacttattcctacgtgccatcctattttgcttcatatatggttgtgcctcgtgattatttgagtgctcttgtatatgtgtctatcctgtgggagattctattattgtagatcgtgtatatcgcttgtgtgtgattactattggtagtctttagactactatagatatactacttcttgatatggtagactttgatgttattttgggcatggattggttgtcaccattgtcatgccaagacagtgaccttagccatgctgtggttgcctcaattagagtaaagagggactcttagccattctaccagtagggttatttcttatgtcgaggttcgacgtatggtcgagaaggggtgtctagattatttggcctatgtttgtgattcgagtgcagatgttccttccatggattcagtatttgttgtgcttgagtttccaaaggtgtttcctgcagatctgccggggatgctacccgatagaatattgacttctatattgatttggcttcgagcactcagcccatttccatcccaccatactatatggccccactggagtggaaagaattaaaggagtagtcgcaagatttgcttgataagggattcattagacctagtgtctctccctagggtgcacccgtgttattcatgaagaagaaagatgggtcgataaggatgtgtatagactattggtagttgaacaaagtcagtatcaaggacaagtatccgttgttgatgatttatgaattatgagatcagctttagggtaccaaggtgttttcgaagattgatttgaggtttggctaccatcaattaaagattagaacattggatatccttacgatggcttttcggactcggtatgggcattatgagttcctagtaatgtcattttgggctgacagattccctagcagcagttatggatttgatgaaccgggtgttcaagacctatttggattcttttgtgatcgtattcattgaagatatcttgatctactcccgcagtcgagaggagcatgagcagcatcatcggattgtacttcagactctgagatatagttagttatatgccaagttttgaaagtgtgagttttgcttagactcaatcacctttttaggggcatgttgtgtcgaagagggtataaaagtggatcctaagaagattgaggtagttcagaactggcctagacctacttcagatacaaagattcagactttcctaagtttggtgggttattatcagcggttcatggagggttttcatccatagtatccccattaactagattaacccagaagggtgctccattcaggtggtcgtatgagtgtgagttaagctttcagaagctcaagacagctttaactatggcgccagtgttggtattgcccacatattcaggatcctatatggtgtattatgatgcatctcgtattgggctcggtgcagtattgatgcaggagggcaaggtgattgcctatgtgtcacggcagttgaaggtacatgagaagaattaccatgttcatgacttagagttaggagccattattcatgcgctgaatatttgggggcactatctctacggcgagtcatgtgaggtattcatagatcattggagtctacagtattttttcaagcaaaaggatctcaacttgaggcagatgaggtggttggagttattgaaatactatgatatcaccattttgtatcattcggggaaggccaatgtggtgtctgatgccttgagtagaaaaacggtgagtatgggtagccttgcgtatattccagttggtgaacggcccctagcatcagatgtttaggatttagccaatcagttcgtttggttagatgttttagagcccattcgtgttaaagcttacagggtccctcggtcttctttgtataagcgcttcagagagcatcagtatgacgatccccatttacttgtatttaaggacacggtgcggcacggtggttccaagcaggttactgttggagatgatggggttttacggatgtagggtcggatttgtatgcccaatgtggatgggcttcatgagtagattcttgaggaggcctatagttcccggtattccatccatccgggtgcggccagaatgtatcagaactttcggcaacattattagtagaggagaatgaataaggatatagttgcatatgtagctcagtgtctgaattgtcggcaagtaaagtacgaacattagaggcctggtggtttgcttcagagggtggagattcttgagtgcaaatcggagcgtattaccatggattttgttatggggctcccacggactcggaagaagttcaacgtggtatgggtcattgtggataggttgaccaagtcgtcacatttcattacagtggcagttacctatttttcatagtggttaaccgagatctacatccgtgagatcatccgtcttcacggtgtggccgtgtccatcattttttatcaagatacacaattcaccttacacatatgtaggtccatacaatgtgagttaggcacacgggttgagttgattataacatttcacccctattcagatattaaaggatatgtttcgccttgtgttatggattttgggggttcatgggatcaattcttgtcgcttgtggatttttcctacaacaacagctaccagtcgagtattcagatggctccctttgaggcattgtacgggaggtggtgtcgttcgccagttacttggttcgatccgggagaggctcgattgttgggcaccaatttggttcagaataccttggaaaaggtcaagatgattcagaatcgacttcgcacagctcagtctaggcaagcattatgccgaccgtagagttcgtgatgttgcattcatggttggagagagagtattgctctggatttcacctatgaagggtgtaatgaggttcgaaaagaaaggcaagttgagccctaggtatatcgaaccttttgagattattgagagagtgggtgaggtggactataggcttgcattgccatgtaatttatcagtagtctatccggtgttctatgtgtccatgctccgaaagtatcacgatgatatgtcacatgtgttagattttagcttggtccaattgggcaaggatttgacttataaggaggaaccggtggccattttacccctgcagatccaaaagttgaggtctaagagttatctttcagttcgagtaaagtggagagatcagtcgatcgaggcatctacgtgggagtctgagtcggacatgcggagtaaatatccacaccagtccagatacctttctatgtccgttcgggacgaacgtttgttttagaggtggagaatatgatgacccaaaaggtcattttgatttttagcctttaattccgtgttttaagacctcgactagcacatttagtgttcctcgatttgcatgtgcagtccatttcttgttctgaaaagtttttatgtgaaaaatttaagaaaatgtgaaaacttgcattaaaactcattgagttgactacggtcaaaattttgtgtaaacggacccagattagtgttttgacggtcccagtgggtccgtatcgtaatttaggactttggcatatgcctggaatcaaattcggaagtccctaacttgaattaacgtgatttgttgaaaactagtgatttgaaggcttaaagaatttccaagtttgaccgtaggttgattttgttactactgggttccgattttggttctggaacttggaatatgttcatttcaccatttatgacttgtctgcaaaatttggtgcaaaacggaattgatttgacgtccggttgtaaattgtatgttcttgagtttctttaaaaatttctttcattttgatgttggattcgtagctctcagtgttattttggtgtgttgatcatgcgagcaaattcgtatgatgttattacacttgtgtgcatgtttggtttggagtctgaggggctcggatgagtttctgataggctacggatcgattttggacttaggagcagtgttggtttcaagattctggtgtctggtgctttgttcttcacgatcgtgaagtcactcccgcgatcgcaaggagtaacctaggctagggtgggatttcctctatgcgaacgctaggttgatgtcgcgaacgcgaagcggtggtgggatcacccttcgcgaacacaaccaaagctatgtgaacgcgatgggtatggacctggaagggggatcagctatgtgttctacgcgaacgcgatcaaagggccgcgaacgcaaaggctagggggcagacgctcagtgacttaaatgtcccaaagacggaaactttctttattttccaccattttcacattagagctcgacctagaggcgattttgaagagaaaagttatccccactttgtagattagtatactttaactcgttttctttcattttcatcaacacccatggatttctaaccttaagctatgctctttcatggtagaaaattagggatttcggtagaattgggggttttgtaaaattgagatttagacctcaaattgaggtcggatttcgaaactaatcacataatcggactcttgggtgaatgggtaattatgttttggcccgaatctcggattttgaccaagcaggtccggggttgacttttgactttttgagaaaagtgtaaagatctttgctttatctattataattgatttccctaaaattgattgatgatattaagtcaattttggttagattcgattggtttggaggcgaattttagagaaaaggtcccagttgagctttgatttgattgcggagtgaggtaaatattggatctaaccttaatttgagggaattcggaaccttgaactatatgttatgtgaataacatgtgtaatagcttatatgcgtggtgacggtgtatataagccgtcaaaataattgtttccatgtccttctcgctcttcgtgaattatctctctatgtcttaattggtacatactttaattaccttctatgtcataatttattacttgtcattaattatctttgtgaagaagattgaggagaaagtggaaaactagtttttgtaagagattactgtttgaccaaaaattagttttgagaataaacaattaaatttctatttttcagggctactagcaatttatttgatcgagacagttacaaataacaaacaatgataaataagaaatagcgaaatagattaaatagaatggtgaagaggagaaaatgcttctaaattttcaatcccccagcgatctccgatagcaggtgtggtcgaattgcgaagctatttaaaagaatctaattcaagatgatgctttgtattcaagagagtttttcttctatttctaatgctcctaccttggagcattggggcagcctttatagtggtggggaaaactgtcgttccgagtttcgggccagtacaccaagatattagctaagaatcgagccagtacgccaagatattagctagtgggagcaagatcctcgatagtaaacgttgatatccacggcctacggataaggttgatcgagtctccgaatatacgcatccacctttcggatgcttgacattccgatgaccactatgagtatctcatcatagaagacggatcatgttacatctcaagcaaaagctagtacgacttaaactaatttacatatgtatttctcattacaagtaaaacttactcctcagcaagaaaaagaaatttactctcaaataaaatacacaagcaaacatagaacctagttacacaaatagttttcttggtgttccgttttcagatgacgactccggcgagtgcgagcgacgcctagggttcactctagccggctccggcatgcctgagccgactaagtgaggaaaattgagccgtgctttcgagccacgaattttgaaagcggcttgatcataagccaatgctgcatcctccggtgtctcatatgttcctaaccataatcttgcatttttcttattcggatcccttatctccgccgcgaacttgccccaaggccgccgccttacgcctctgtaccgcttccaatcttgtggcgcgtttgccaccttcgccgccacagtctccttattattagtctcttcaaattcatgagacttttcagtggcgcctactaaagtagggtttatcaatggtgttaattcaccatagtaaaagttgttttctgtagaaggagagttgctaaaacttgaactagggctattggaatccatagctgaaaagatttctggaatattagaatcatttagaagatgatgctgtatggattcaaggagggaaagatcagctgaattcattttttctcttcttcttttttttttttttccttttggtggagtttagggttttagaacgtacaatatttatatatatgcctgacagatgggaactaagaaaggaattctttctaaataaagttttttggaaatgcccgcgaaggttccatttgaagcacctgcatggcatggttatttttgtttgaatatatattttcctacaacaatattaaatttatatgtttatttgacaattaatttgtttttgtttttttggtcaggagtggtcgatgtagatcatgtcttgtagtaatttatttatttatttatttgggcaaaaccccacgtttcacgtttatttcttttgggtattataatcttagctcttttagatcgatctcaaagctggaagcttcttctctatatctcaaaagttgtacggaagttagcaaatgaaatgcaagttttgtaaagtaacgttctcgagaatatgattattgtagcatttgtctttaaaaaaagtcgatttgatatcttatttcaaggattttagattgaaaagagataactagaaacgtacaggggatatcttattgtagcattttgaatttattaacatttctgaataatgacatagaatcttagaaaaacaaaacccgcgttaatttctacattttagttcttttttgcttttttctcaaaggttgtgtgaattttgcaaatgcaagttctgaaaactgaagagctatcttttaaatttaaaaaaaaaatctcatcttacttccggtgtttttgattgaaaaagaaaattgtagattataatgactttgaaattttaatattttttaacaaaaagcatagattcttagaaaaaattactatctcatctcttgctgtgtaacctgacaggagacagtaaattcagtttcacaaacatgttcagtcgtagtaatagagggaggatattgtggttcataacaataattcccaaataaataatcttttcgatccacagatttaacaagacaatagagaatatcgaattgaacaattaaccggaaaattggtaccaacagtttgcttatattgaattatcaagattgttttccccaataactaatttttcacgaaagaagaaattaaatgattttccttatatggaactcaggttttccttataagtatgtcaaatcttacttcatagtattaattttaagcattagacattgtcgtcaatctttagtactcaaaactatcaccaaacactacttaaccatatacatatctgtattgggaaaaaactgaatttacattgtaggtgacgtggcatgacacgtagactggtcaaacggtcaaaacacaataaatagccaagaggcacgggtgacaacagataagggaaaaagaaagtaacattggtgcggaccgttactaaaataggtacgagtctcgtacctatccaagtcatctaaagaccgaagagcggaagaagttgaagatacgaatctgatgatgtaaaagagtttaaatatagcattaaatatcaaatacgttagaatatttgttttaaaaataaatgattgtgtaacgtttcttttaatgtcatttattgctcataattgcctcattaagacaaaggcattacctcttctcctaggattagctataaaaggagaagaactcaccatctgtaaggagacgaaatattattgggatcttactgtaatacaaaactatttactgctttaccatcattctcaaaagtattttgttttcgtctcctgattatcagtaacccgaatttctttttagccttgaccaaagactcagatttttggttaaacaaattggttccgttaccgagaatctgataatcttttcctttaagctatatcttgtccattgtcgtcaccatgtcaaacaacaacaccgacaataatagtaataacacattgggaaaccatgaaaatcaaatccatcaaaatcaaggtgacatggttccctcccctccagattcaccacgtcaatctcgtgaaggcactcctgttactgaatcctgtgttgatcaacaagaacaatctgaacactttgaaggagttacaactgaagctttacaaaagctaattgatgcacaggtcggcaaagccttcaggcacttgttagtcgattgcttgctgcaccacccacaccaactcctaataataatatattggagaatccccgttctggccttgataattctggaaacggagcaacccccagtgaaccacaggaagggggaccaggtaattcaaataattcatatttgcaaaatttagtactaaccttgcagaaacagattaaggaacaaaatgagcgtattgagcgaatccctggagttccgcctgtaataaaaggagtagacatggacaaatactcacaacaaccatggaagccaagtgtttctccccttccaattccgaaaaagttcaaaatgcctgacatcccgaaatatgatggtactacagacccacgtgaccacgtgactgcatttacaacaggcgtgaaaggcaacgacttgaccaaacaagaaattgaatcagtactggtcatgaaatttggagaaacattcaccaagggtgtattaacttggtattctcttttatctgaaaattctattaattcttttgctgagcttgcagattcttttattaaagcacattcgggagcacaaaaggttgataaaagcatggaagatattttcaaaatcaaacaaggggattcggagttgcttagaaattttgttgatagattccagcgtgaaagaatgactctacctcgtatgcctgacaactgggctgcaatagcctttgcaagtaatttaaatgacaaaagttctgaagccacgagacgactcaaagaaagccttcgagaatttcctgcaaccacgtggaatgatgtttacaacaggtatagtacgaagctgcgaattgaagaagataccgtacctaagtttcatcatgaagaaaggggtggtccccgaagatcaaaaaccgaaaaaagatcaggtaaaaacaagtacgatccatatatgggacctgcaggaaaagacccacggtcgaaacaagatagccagcaatatgatcaaaaatcgaggaacatggactctggttcttcttcaaagttcaggaatgatcggaacagacaagaatcacgagatgatgacagaagtttaaaggcacgattcggtggatataattttaatgtctctacctccgagctcgtagctgttttatgaagcatgggagataaggtacggtggccaaaagagatgcggtcaaatccaaatagacgcaatccagatcattggtgcgaattccataatgatcacgggcacaaaacttcagaatgtagattcttgcagagtgaagtggatcatctattgaagcaagggtacctcactgagttatttagcaagaaaggaaaacaagcttatatgaaaaacaggcaagagccaccacaacctcattcacccaagaggacagtgaatgtgataagtgggggagaagatattcacggcataacctacacagcctccaacaaggtttctaaggtaacaattacacacgggaaacgggtgcggcaggtcctagaaaatgaaagtatttcgttcgatgatgcagataccgaaggagtgacaactccacataatgacgcactggtaatatctttacttgtacatgatactaatgtaaaacgagttttgattgatccagggagttctgtaaatattatactactaagggtattacgtgaaatgcaagctgaagacaaaatgatacccaaggcgcacaccttgtcaggcttcgacaattcaagtgtggtaacaaaaggagaggtaattctaacaacttttgctacgggtgttgttaaagaaactaaatttcaggtagttgatatggaaatggcctacaatatgatcatgggcagaccatgaatacacgatatggatgttgtcccatcaactctacatcaatttattaaatttccatcaccatggggaatttgccaaattcgtggggatcagcagatggctagaagtgtcaacgttgtaacaagtacgagcaccgtaaataaagaaaaatagcaattacaggaaacagttgaaggtaaaaaagatcaaacttcaactgaacaagaaaagacagatttggactcaaggcctgacacaattcaggaacctgaagaaaatgaaagcatcaaaacgacaattgaagagctcgaggcagtgatattatttgagcaatggcctgaacggaaggtttatgtcggagccaatttaagcttaaacatgcgaggtatgataatcgaatttttaaaagctaacttagactgctttgcttggtcccacgctgatatgacagggataccaccggatgtgatgactcacaaactcaatgaggacccttctttcacaccaataaagcaaaagaaaagaaatcaaggtgctttcaagaaccaggtgactcaggatgaggtccaaaaattattaaaaattggattgatccgtgaggtaaagtatcctaattggctagctaacacggtggtcgtacccaagaaaaatggtaagtggcgcgtttgtgtggattataccgatctaaacaaagtttgtccaaaagattcctttcctttaccgcatatagaccaactaattgatgcaaccgcaggtcatgaacttttaagttttttagatgcatactcgggatataatcaaattaaaatggatcctggtgatgaagaaaaaacttctttcatcacagacagggggacttactgttataaagtaatgccatttggtctcaaaaatgctggggcaacctatcaaaggttggtcaccaaaatgttccaagaacatttagggtaaacaatagaggtatatatagacgatatgctcgtcaaaacccagcgatctcatgatcatatttctcatttatctgttacatttgaaattttgcgaaaatttaatatgaaactcaacccagaaaaatgtgcatttggagttgcatcaggtaagtttttgggttttcttgtttctaaccatggtattaaagtgaatccttctcagatcaaagaaatagaagaaatccctgatatccttattaataaaaaggaagtacaaagattaacgggaagaattgtagctttggggagatttatttccaaatcctcagaaaggtgttttaagtttttctctgcactcaaaaagcaagatcattttgaatggaatgaagattgtcaacaagcccttagaaatttgaaagcttatttgtcaaaaccaccgttgttggcaaaaccaaaggtggggaaaaaacttctcatctatctggccgtatctgaagtcgtggtgagtgttgttttagtccgcgaggaccaaggtaaacaatctcctatttattatgtaagtaagtccttattggatgctgagacacgatacccacagctagaaaaattagcattagctttgatcatggcatctagaaaattaagaccttattttcaatgtaatcccattaatgtagttactgcttttccgcttcgaaatattttgcataaacatgaactttcaggaagattagcaaaatgggctatagaactaagtgaatatgaagttgtttatcaacccaggactgctataaaatctcaagtactagctgatttcgtggctaattttagccaggggatgcatttagaagcagaaaaagaattactagtttttaatggtgcaaacccggggacttgggttttattcactgatggttcatctaatgtaaaaggggcaggcctagggatagtcctcgtaccacctgcgggtgagactattagacaggctataaaatgtcattctataactaacaatgaagcagagtatgaggctgtaattgcaggtttagaattggcacgagaactcggcataacatagattataatcaagagtgattctcaactcgtggtcaatcaaatgttggggacttatacagccagagagacgcgaatgcaagaatacctcgtaaaggtaagggagttgataaagcaattccaaacttgaaaagtagtgcagatcccaagagatgagaatgtagaggcagatgctttagtaaatctcgcatctgcagcagacgtagcaaacgatacaaatgcttcattcatacatttatttcattccattctcgaatctgataaaaacgaggtaaattttaatcatttaacatgggactggagaaacgaaattgttgcctttttacatcacggtaccgtgcctaatgacaaaggaaaggctcacgcgcttcacaaaaaagctgctcgatattgtttatatcaaggaaatctttattgaaagatgtttagtggaccactagcaaggtgtctcggaccctctcaaacagaatatatgatgagagaagtgcacgaaggacattgtgggaatcacgcagggggacggtcactggtaagaacattaattcgcacaggatattattggcctaagatggaagaagaagcaaccagtttcgtgtccaaatgtgataaatgtcaaaggtacggcaacaatatgcacagaccagctgagttactacatcctgttatagccccgtggacctttatgaaatagggaatggatatcgtaggtccacttccacaagaaaaaggtcaggtaaagtttctacttgtgcttacagattatttcactaaatgggtagaagcaggggcatttaaataggtacgagagaaggaagttaaagacttcatatggcgaaatataatatgccgttttggagcaccaaaggagatcgtgtgtgacaatggaccacaattcattggagctcaaatcacagaatttcttcgaagttggcagatcaaaaggataacgtctgcgccataccatccagtaggtaatggacaagcggaatctactaacaaagtcattatcaacaacttgaagaagaggttacaagattcaaaaggtaattggcctgaggtgttacctggagtattatgggcttatcgtacaacgaccaaaataggcactggagaaacaccattttcaatggtttatggtgcggaagccttaattccagttgaaataggtgagccaagcacacggtacgatcaggcaacggaggaatctaatgatgaagagatgtgggtcaaccttgatttacttgaaggaagaagagaagctgcattgataaggatggaagcacaaaagcaagtaattgaacgatattacaataggaaagcacgcctcagatttttcaaaattggggacttcgtgcttaaaaaggtgttccaatctgcaaaggctgctaactcaggaaagctaagtccaacatggtaaggaccgtacaaagtccgtgacattgcgggaaaaggagcataccagttggagacaatggacggcaaagttttaccctcacattggaatgccgtccacttaaaaagattacttttgagaaagtacctacggtcaggtatcaccatgttaaaatttctctcttggattattaatgttttactaacgattttagatgctaggcaaaacaccctaactcgtgccaaatgatgaatcacaacctgcaaggcaaaatggagtattcttaaattcccagcccagggttacaattaatctgatggaaatacacacgagttaggcagtcttcatctataatcgcacctccgagtcccgtatatatttctgtttcaggaaaagggccaaagtaaaagaaataaacaagtgctcgaggcttcatacttcaccgctcaaacacttgggggactacatattgtacacagatacgtgtataagtgcagatacgaatatcgaacaaaagtcggccacaaagagacaagtgttgagaaaaagttacgaagtcttcagcattcatgagaacaacaaagtcatctctcaaaactcataaacaaagtcacctctcaaacccttcttaatatataaagatagggtcatgactatgtactgaaacaggttatgaagaaaaaccttgtttattctatgttatgtacaaatctgttataaaaaaacagttacgagaaagttgtagatgtattgtaatacatgtaatagtcaaacacttgttaaagttcatgaatagaaacttgccaaagttgtttcatacaaaacgtgtgtattcctatttctttcatcgtattataaacaccattatgaagttgagacgtcttcttcattaagtgtcgataaaataaaagggccctcttttataagcctcatgttgataatccatgagaagaatcattaagcattttaaaagaataaaaatgataagctattctataagtcctagataaatgggcaagaataaaatatacggaagtaccaataaaaacttcttaatataaaagactaagtacaaacttagtcagcaaaatatttgttttttacaaatgccccattatgataactggggacttcgtcaaaagatcccttaaagttgccaagggataacaccaccaattaataaaaacaaaaacagcaatttcattttcagctagtcactgaaggggttagaacatcagaagttgcaatttcattttcaagagcaattttaattgggcttggaatattgaaatcaccgaggggagcaagaatcacaggagcttcagcttccatggaaggtgtcatagaagtttcaccctcgggagccggaattgcaacctcaattgctgcagtagccacttcttcatttaaaagctcttccgttccaggagcttcaagtgcaggagaaggagtatcaataggttgttgacttttctcgatagtgtctaagactttggctaattcagattgcaaatcgaagctttcctgagcagcttccattagagcatcacggcgagatttcaggaaagcccaactcacctctatgttgaagttctcctccagaagtccatactccctttcccacatagcaagatcattcttcaatatttgatgttcagctaaatgggaatcaagggaagcttcaagggaggcatgagagctcttcaaagctcgaatctcgtcagaggaggtatgtaagtcagcttgagcttgagtcaagctttgcactaattctcctgcatattcttctttcttggctaaaagtgccttaagctccctgacttcttcactagcctttgataattgttctgacattgagcactccaaaagctctttatctcttttaaattggcttgaagaagccttggcagtcgctagttcagaagtcaaaccacgcttttgctgctccaggagatttctactttcttgcaactcctctatggtccccttagcattctcaaattgttctttccaattagctgcttcaagctgggctcccctggctatttcctcggcctcatggatggatttcttagactcacgggtttttctttccagaagggaaattcttcccatcaattcggtaccaataaggttagcctacagagacaactcatagaaatgaggatttgtatatcgaaaataaaaaacttgttggtaaaggaaaaatagcttcaaagtagaatgaactatgtcattcatcagagtcaggcagctgtggctctccatcttcttcttctcaatatcaccgattagaggctcgagccaaacatcagctctaccagtctttctcaaaaggttatggttggtaggaacttcaagaataacacttctcatagccatggttctactgctagaacccgcctctgtatgctgaacgaagggaggaggagccatggaatgaggagtagtagaaaaggaaaacacagcagcaggagccataagagtcaaagaagggatggaaggagaagatgaagaaactgacacaggaacggaagcaggtgcagttgaaactggcaaaggaatggaggaaataggaacgaatgaggagagaggagcttcatcaaaaacagggtcgggctcgccactctcaaaaccactatcaaaaagacgctgagttaattcattagtatcttttggcacggtgtcctcgtcagaatgaatcaaaacaggctcggtggacaaagtttgagcaggggtatcctcaatttcatcactattaatgactcgtctcctatctcttggcctggcaattaaagaggtatcttcctcttcctcattctcagaactttctcctatagctttcctttttggaagcgaagctcgagctttgttcaaatcaagtgcagcattagcagacatgcgaatggtcataactacttcagctgtcattcctctaacaccaaatcctgatcaaaagaaggatacataatcaacattgagaaaaaggtgcttggcatgtaaaaaacgtgtaaaaagggacataccatgtgttgtcaccttccagccatgtaaagaagaaattgatttccaagttctttgatctttaggagcaatcttcaaaattgaatcgaaccaaccacggaagttaggaataagttccacatctcccatggttgctacaaaaaaaccaaaaagagacgaagtgagaaaaagaatcagaattctcaaaaataggtgcggtaaataaaaggaaacttacgtgcaaaattccacttctcagggaagggaatatttgtttcaccaagaaagtccaccgtacgtacagcaatgtaacgggtgtaccatccacgatccttgtcatcttcagggtttaccaaaacctttttgcttcttgcagttaaggtaaaaaacccatggcgcattaaattgggatggtataaatgaataaggtgagaaagggtgaagtcgacattggctttggcagataagtatctcagacaagccactgctctccacactaggggaccgacttgggccaaacagattttaaagaaacgataaaagttaataatgactgggtcaaccggaggattaaaacccaaagtaaatgggtaagtataaacgaaagaataaccatttctaaaggaagaaattctttgatttggggaaggaattgacattcgtagactattgctccagttacaatcccttctgatggtagggattgtaagctcggttactaatgaaggataagtgtcagctttttctaaatttgcaatttgcctttgaagagacgttctatcactcccaaaagacaaattactgggaaaaatttcatcgactaaaggttcttgagaagaatcaaggatttctttacctttagaagaaggggtcttcggaatagaactcccgatattaggagaagaagaagcaggaccagataaaccatcacgagcggaccctaggcccaagctccgaagcctacctcctctgcctctcatatgtcttgtaggggcattggggaagtgatcaagaattggaacttttctagggttagggtttggagatgacattgttgaagaagggtgtactaaaagggagagaaaatacaagtaagtaagaaattgcttgttgaagatctatgaagaagaaggtaaacgaaaaagggttaaaaatgcttataatgacaaccgtcaaacttagaagtgcaatgaaggaaagcttataataaaggcaactatcatttcgtgaatagtgtaaatgaagaagtctcgaaaaaaggggtagaattgcagaatcaatcagaaggtgacacgtatgtaaagcattaaatggaagggacaattgaagcgtcagtatttgtcataatattaattacggcaaaaatttcctttttatgaaaatccacttcccaattatttacttgataaataaatggaagtggggggactatctgtattgggaaaaaactgaatttacattgtaggtgacgtagcatggcatgtggactggtcaaacggtcaaaacacaataaatagccaagaggcacgggtgacaacagataagggaaaaagaaagcaacattggtgcggaccgttactaaaataggtacgagtctcgtacctatccaagtcatctaaagaccgaagagcggaagaagttgaggatacgaatctgatgatgtaaaagagtttaaatatagcattaaatatcaaatacgttagaatatttgttttaaaaataaatgattgtgtaacgtttcttttaatgtcatttattgctcataattgcctcattaagacaaaggcattacctcttctcctataattagctataaaaggagaagaactcaccatctgtaaggagacgaaatattattgggatcttactgtaatacaaaactatttactgctttaccatcattctcaaaagtattttgttttcgtctcctgattatcagtaacccgaatttctttttagtcttgaccaaaaactcagatttttgattaaacaatatcatcaatggcatgttgtacggttaacacatgtcatctatgtcccagccaaatactaaaagttgatcgagctagattaatgaattctcaggtaaaaaccatttttaaaataaaatagtttctgagaaaaacatttaatctcaaatcacacacacccttaattccaaataaaagttgatagttttgaggcaaaacacattattaatgccaattatttcaccttttctacatttcactgtaaagaaatttcagattaataaatttcacagtaaaactgaataagaaaagattaatactttctggttctcgagttaaatttgaatgtcaagtatgtgctctatttttgtatttagaaatcatacagatatataactattactctacgagttttagaaaacactcagacgtaccttcataaactagtgtttgattgacgcttaccctcaaaagtgggatttttcggcataaatctggattaatcatgacccaaagcagatataggactacatcaggcgaaaaaaatcaaaaatatgaaaaataaattggtgtttgatctagatatcatcagaacttaaatgctataactaatcaaagttcaagtgatatataacacgatgctatatcatttttctcgtagcttaaaataaaaattgaaatagaaaaaaaaagtatttgtaacttaattctgaaatgggcgccatatcctaatcccgtccttttatatatagaacgaagaagcaactttacaacaacttaaactaacaatatttccctctacgacttctacaagtttagcctctaattcaattttcagccaattttctcttctttagaggtacattttttacaaatgacaacgaaaaagaagatgatgaaatctccggcgaaaggcaacgccgcctcggagccactctaaccggctcggatatgttcgagccgattaagtgagggaagttgagccgagccttagagccacggatcttataagcggcttggtcataagccaatgctgcatcttcgggtgtctcgtaagttcctagccaaagcctggcgcctttcctatcagggtttcttatctccgccgcaaatttaccccacggcctccgcctaacacctctgtaccggttccaatcctgaggtgcgtgcacaccacgcgccaccacatggttcttctttgtttcctccttgtactccaaattatcgactcgttgccacgtggtattgacactagttaacatatcgccccagctaatttcttctgttggagagctaccaaaactcgagtccgggctattaataatttctgcattactaaaacattgatcaaacgtggaatatatctgtgaaaaatcattatcgtttagaagatggaatttgatgttttcaaggacggagagatcagaatctgagatggttgtttgttcgtacatttcttcttctttttttgagttttaaggaatttttttgttttgctacaatgaagaagtttagaggtcagtactgtgaatgattgataaggtttgcatttgcattttatatagagcaaccacactgtccactattttaattatgtagatagaataatattatttgtttaatcgaacacatggtcttttcctttaattataaggagcgtaacttataggaatttcttggaagctacaagccaatcactcagagtagttattttgaacatgtgttataagaagtgctccattatttttttcgagcaataatttgtttttcctttctttttatgatttattatattttactctcggaatggacaacgcatcctttgtttagtatcataaattacgaacacctatacacatttgttaggaaatattacttgtttaagattattttaagaaatattacttgtttaaaattattttattctaacatctttcagaaactaaattagctaaaaccaaaaagctttcagttggtaatataatgcttttccgattcacagttgcttagaaaatgaattctttttctccaaacgattgacatttttttatttagtgggataatcaataaccatgcatgttcaatatggtaacttatttaagtaagacttgaagattttgattcgaaacaaattatagaagtattcttattcttagggaaaagttgatttaaaaaattgaaagccaaaagattatgacatgtgatgatttgaaataaaagaaatttgtaaagcttttatttaaagaggaataaattgaactcggtccctgttttatatgttaatttcaattttagaccctattgtttaaccagcacatatagaagttccatttgttggaaatcaattgttagaatctaacgagttgatttttccccttttctgtgctttactgaaataaagaaaggtagagtatctttcaaataaataaatatatgcgaagtttgagaatactaattaaaaattaactaaaaagtagaagaaaatgttatacagtgaatgaatattgtccccaaaaaaagaaaaaaatacaaccgtccaaacggatcagaagtcatagttaccagtcatacattcgtcttaattttctttacttaaccataacgtgtatttggagtcgtgcaaaaaaattaaagtcaataaaaaggagattggtcaaagtcatcagttggtacactattttatatatcctccgtacttataaatatacttgtctgctgctaccacatcatagtcgaagagcaacagttctaataaatgtactattaaaatgaaggcagaatagccttatagaccaatgtacttggccgatccgtgtattctataaagtttcatctagacacttatagttgctaaaatacattatctgatccgtatattctataaagtttcatctaaacacttatagttgctaaaatacattatcttacacctctctgaccctgcgtataatatctacctcagataaaatatgccacatcatttttttttattttattaaaggcaaaatgaccaccattttcaccttcttcaccctccaacaccattgtaatattcagtcaccttcccagttaaaacctcaccatcgaaccacaaaagaggtactagcaaacatcaaaagcttgtttttttcttacctctacctctataaacaaagaataaaaagaaggatttgtgaataaacaccacaaattttcgagggattgaaagtgggagaggaagcaattgaagttgcaatcacttcaaaatctaataattttcacaaaccaagcaattgatttgggtacccacacgctattacagattagattcgggcaccccatatctttcttccttctttatgctcttcgtatcctttggtattcttcacctgatttgacttgaactgctagggtttctctttttttgtatttttttattttctacttagaagggtgatgtggaagaaataattgtggtggacattgtattgggaaaaaactgagtctgaatattgaagatgacgtgtcatgacacgtggactggtcaaaaggtcaaaacgcaataaacagccaagaggcacgggaaacaacagatagggggggagaaaacaacataggtgtggaccgttactcaaataggtacgagtctcgtacctattcgagtcatttaaagaccgaagatcggaagaagttgaatatacgaatctgatgacgtaaaagagtctaaatacagcattaaatatcaaatacgttagaaaatttgaattaaatagaaattattgtgtaacatttcttttaatgtcatttattgctcataattgtctcattaagacaaaggcattacatcttctcctagaatcaactataaaaggagaaggactcaacatctgtagacacacgaaatattattgagattacattgaaataaaaaactacttattactttattattctcaaaagtcttctattattttcgtctccagattatcagtaacccaaatttctctttatttctagctttgactaaagactcagatttttggttaaacagtcatcggtggtctccgtcgctggtgatggcgaacttttccagtgtgttctttgtcattgatgattcagaagtttcaacactagccagcgatgattgtttgacagactccgatgaaattcttattcttcttgatgttgttggttgaagttctttttgcgaaccatgagctcttagctgatcttgtctattggttcatcttttgttgctctttaattatgatgaaaagaaaagctatgactacagcaacaggaagagaaccatgggttcttcgtcttttgtgttttctttttttcttttttccccctcttattttagtcattttctgtggaatccttgtaatcacgctctttttgtgtgtgtaccaagcattttatccacctcagtcttacctatgccacatattctaggtcaaccgtcagagggatgtaagatagtgtgtttagcaatgtaagtatctaaatgaaactctatgtagtataggaaccgagatgacaccggaacaaatacaatggtctactgagctattctgcctaaaatgaataaagaaaagaacaaactaacctctatagcccctcaaaattttaatagctcatgttttgtcctacttacaaaaaatggcccttcggcctaaacgtattgcatatagtagccgaaaagaataaacatgacgacacaagcgcctgtagctcagtggatagagcgcttgtttcctaagctgaaggtcgtaggtttgacccctacctagcgcgctagagcaacccttttttgcctttttaaatgtacttttggatccgataagtattagctaacaattgaatgaaatatgtaatgtaggtcatatacgaaatgtctatttttgtatattataacagtctatttttgtatatttttgtataataacagactatttttgtatattttttgcatagtgatagtctattttgtatattttttgtatagtgacagtctattttgtatattttttgtatagtaacaatctattttgtatagtgacagtctattttgtatattttttgtatagtaacagtctattttgtatagtgacagtctattttgtatatattttatatagtgagagctaattgtatataaattgtatagtggcagtctatttagtatatttttatatattgatagtctattttgtacatgttttgtataatgacagtctatttagtatattttttgtataatgacattttatatttatatatattgtatagtgacactctatttgtatataaattgtatagtgacagtctgttttgtatattttttgtgtattgacagtctgttttgtatagtgacaatttattttgtataatttttgtatagtaacaatcgatgttttatatattttgtaatataccaatattcaaatctattttcgaaagaaatatataaatatccatgtaaatatatactaatggtgggcctaaaattataattcccatcaaaatcaactaatgacatacatgtggaaatggaaatttatttggtgaaacccaaaggattttcctagcaaagaaagttagcccagaaaaaaataaagcaataacagagagcttggaatttttattcaaagagtggttgcccctctctctttagccaatgattttccttttccactttttaaacaaaaccaacggcccttgaattcctgaaaatacgtactactatactgtcatttcttcggtatcaatcaacaacagccatatctctctttttgtctctgtttttgtgattttagttcctttttttggtacataacaattgaggcagtgatgatattttatctggattctaagctaattggatcgagcatatagattatccaactcgtatcttggcctggcaaatcactggacggcaagcgattcaaaggttttttctttggatgcaatcggtgattttgtagccatagcgtggtcgcctctctttttcgcgatctgtctttacagatctgagcctcagtacttttgggctagccactagaattatttttggactataaaatgtatgttgcagtttttgggctaccgggtgaaatatgtttgggccgatgggctcttaatgaagtttgctctaaagaaaacgcctgctgatttgggctacctttggatcaaaccttttggcataatacttaacgaataatcttctacctttgaaacttggaaattctttttctttttcaggctttctttgatgttgtgtactgcaagttgtataataacacgccaaacaaagtagggtttggacaaaaaaaaaataagaattctaaaaaaaagtagcttttgaagttaagttgaaaaattatatttggaatttgaaattgtattcgacatgcattttactagaaaaaaatgataaagtttaacaagtgaaaaccaaattttcatgaaattttcaaatttaaaaactcattttcaattttttttgaaactcatcttcaaaaatttaattaaatgtataaccacacatgatttgaaaatattttccagaaaaaggaggggaaattatgtccaaacggctcctaaattaaacattaaaatccaactgctatactcaaaaatataggcgggaagaatgcaatcccctgactaataattacatctaagacaaatcaataatattgatggactaatcgttttatccttcttactttttggtcctagtctaggccatagagttcatcaacctaccatcaaagccctcactgttactcatagtataccacattatgaagattaacttttatacaccgacactgtaaaaataatttacatatcagaatcttaacctattgtagcaagcaaactactttgcttttaatgttactgatcttgctttagttatttagatgactagatagtgtaaatcagctgctcttaactacatactctcaggaaatttttatccatctacagcaaaaagatcctccacctatgaatatggcattacctgtatcccatatgcaactttgggaaaaatcatgaaagcatatcgacttataagaatgtaaaaggaaatcagctccacaagtttcagccgcatcatcctatttgaagatcttaccaactcaaaggcaaacaagatgaaaaataatggagttcagtacaaaatatatttgagtctacaagttccattcacggcaggttaaactttaaagaggtgaaaccatccgctaaagcacaaagcatctatggtcggaatgctatcaacaaaaaaactggccatgcagcctctttaattcatcctaacatagccctactccatcaccttaaccaatagggtgtcgtctcctgcaaattttacaagtaaaaagatcagcagacgagagacaattctataaagatttaagttatacactaacaatataagaaatctttgtggattctaactaccttactttccaggtttactaattctacttttagttacagacactcacctgtagtgttatctcttaggtgaccttataatgtaaaaaatacttttacacggccagtgtatagatgttaaactcattctacaatttgaaagtaaaggcttccagggtctctagcagtcaacacgcatgaaacaatagatccaaatttttggtttgaagcatctttacaatggcattggaattgacttaagtgacccagcagtccccccgccccaagacactataccccattggctgcacttacggattagcaaataataggacttaatcagatgttttaatatgacatatctcacaggtcaatatacagaccatgactagctgctaaatgactataaagtttaatcccgggaatattagactactactacctcttcggtcgacctcggtcctcctcataatccatcactccaccagattcagagtagatctcctcatgccctctgaagtcaacatcggcctgcttacagtttgtagcttctgccacagagtaagtaagacacatcgacaaaaatatcccagtgcttaattataaaatgagtcttcaacataacgaagtgcttaaatatgaaatgagggttactaagactcaaatgagcgaactactaaggcattctctacccaaaagaatcacatcccaggttgaccaagcccatcctatgaaaggcacgatcaccaatggtctggtgcattgtggaaagcccatttatggtttagaattaacagagctcatcttttgaaacacaatacttgactcaccttcaaagagagtgacttcttcacttcgtcaaccctttcctcaacttccttccggtgcttcctgtcagattcactcattgtatctgcccatttgattttctcttgaattgagataagaagattgtctgatgtagtcaacctatgtttttcatcaaaaaaaatgaaatgaattagcaagtaggttgaaaaattacagttaaatttcacagctttttttaatcatcatggctatgtctcatagtttgcatgggaaacattcacagttcacaaggccctcctgtaagaggcatacaccacactgtacagaaaaatgtcaaacacctataatcttatccctcgcctaactacggtggtatacctcaactccacagactcaatttacatttgatttatggcttaaaaagctgagtgggactgtactcagtaagtcagattatcacataatttcagccggcagttactatttacattgccaaaattgtgttgttcatagttgcaagaagaacacacatgtatatatgcttatcgagaaaaaaacaagtatatataaccattgtgtaaattgacatgaatgaatttggcaggatgccttcattattagctcaaataaaatgtatgatcatcttgacatgatgaataacattgacaaaatgatgtttccaaaattggggtccaagatggacttgttaatgggttggttcaaaggatactaaccttaaaaccagaacaggtaaggaataatatgcttctatgtcaaaaatggctactaataatgggttaaaatctagtctatattcctaaactagaggacagagatccatcacctaggaaagtttgtgttgaccgctcttagcacaactttgtgtcaaacatgacctgaggacatgttagacacaattcattcttatccaatttcttgactactaaatcattcaacagacacaaggactccacaaggactcatccaaacataaatctgaactaaacaattttttggtagctagacatggaaattttggtagaaaatagaacccaacatgagttccatcacctaggaaattttggtagaaaactagaggacagagatccatcacctaggaaagtttgtgttgacagctcttagcacaactttgcgtcaaacatgacctgcgcacatgttagacacaattcattcttatccaatttcttgactactaaatcattcaacagacacaaggactccacaaggactcatccaaacataaatctgaactaaacaattttttggtagctagacatggaaattttggtagaaaatagaacccaacatgaatgcaactaagttacagaaaaagccaaagaggaggcgcaaaatgatccaatgagataatgacttgttgcatgcctccaagttcgctcaaattaaagtaccccaaaaacctcattctaccttgttttcttttgacattttcaacaaccacaacatttcactattggctcttcccttgaaaagtcgaacacctttctacttttcaccttttcaaagcaaggagcagaattcccagaaccccacaacatttccgcactggacagcagggcccaaccttttcctcctcctgtttggggccaagatctttgagctactacaccagcatatgcaatgctgcctgccttaccttctgcatttcaagctccatcaataagacaacgaactgatcaaaggcaagaccccccagccaaaaaccttcactctttcttcaaatctcagtcttcattagggcttttagcccttgatcgatcgagggcatatcactcctagtccagaagggaagagcttgtttgcgacaagcagtagctggcaacggtctttgacacatctattaggtaaagaggcctaaggctggtctctttcctctcataccatgccagttaaaagttccttgccttttcccttcaaccgtgtatgaattcctaaatccatttacctcgaccagcataaactctttttatgccctaggaaaaagctaaaagttagtcattcatcaagccagagcaagtttcacagctaccgattctcggccgtgggtcaaagaaaacaagagctttttgcggggaaacttgcaagtacagtttggggggagggggtgttgacctaccttatgagtattcagattgtaacagttccaatgaacagtcactcacttttgacatcttcatgtttaatcttccttaatcaaatctcagtcttcaagcctatcttcctgttttcatcttccttaatcaaaactcagcctttaagttttctgcccatcttccttaatcaaatcttacttcaataaaaaaaccgaacctccactggaaactcatgtcttcctgggaccctggttgtctatccatatgaggaaacacctcccccctaacttactatataagagctttaccagaaacactgcaatctacatatcctatcccatagtcctaaaagattttcttgttttttaccagcagtgctgaacttcaaataacagcaactaaatctctatatgccatatgctcatcaataatgtaggtcaacaagaatggcatctccataaccaaatagaaacaggctgcactcgcttttcttaaaaagggaaaaagaaatgatgaagaataaagaagaacgataaaaataaggtgactgaactcaactttttcactaactgcttctctgcccttcaattattaattgaagagaattccttcatcaaatgcttattcaatctactaatagcatctacttgtttatttctcatccggtgatagatatacataattatcttatttaggtacccagcattgaatttttttcaaaaatcagagcattcttttttgaactcaggtatcctgctttgagaaatttaaagacttcagcttaatttttttctgataagtaagaattctacttgaaattacatagatatgtttccattaaacaccaagttcttataagttaaactggaaaaatggcaagatcccataagcaggtgtaactcaaatcactcctatagcctagctgactgctttgttttaagaaagaaagaaaacatcagtctttacaaattgcagctcagtaagtcattatgaagcacaggagatcaagacatggaggagaaatacagaaaaagaacttcaacaacaacccttaagaccagctatttgtggacagaagatgtttgctgtataaataggacaacagaatcttgacaggaaggatcaatgcacagccaaagcccacaaagaaataactaaataatatactcacactcagaaaatacgataagatacaatggcatcgcaattagacccatctagataaaagcataaacataaccccttttgaagggaaaaaacataagcataccagtcagttaatgtttgtagcatattccccaattgaccaggtctgagatccctccctgcagcaaattgtacctatagttgtatgatgacagttaattaccctatttcagcccattgcaaccaagagttggcaaaacaggaaaagcatagtaccaacctcaaagcatcttttcaactgatcaagctttcctctaactatgccctatccatggatacagaaagatgggagttagtgaattttttaacaagagcctgaaacattaaatcaattattagcagcaaagcgcccccccccccccccccccacacacacaccccaccaaatcgccccaaaaaaaagggaaagaagtgaagaagagaaggaataggaaaaactagggccagaaataacctatgaggcaacagaaaccacattaaaagattgagttgaacttctatccagaaggcaaaaaactaccacttgaacatcagcagaagcaaattccaacaataaactttagcccaacacactttcaatagaggacggtacaatggtacctccattaataacacaatgatccagggatgagaggtgatactcaccacatacatgcactcatttatgagaaaatcttcaagttcacgcacatttgtgacatccaactcctgcataagttgatcatatggaagctcctggaaagacgaaaggagtcattattggcagtgactaacaacaaacggtatcagtgaaacaaaagtcaaacaaatactcaatatgaatatcaaaggttttgatatatgaacaggttatagtgaagaaacacaaaaaaagaatgtcaaagactcgaaaaaataatgcataaaatttattctattccgctatgagaaatgtacttgagagaaatgctaatcatgcaagtcgcaggagacatctcatgaatagtacgatatatagctgttgacattgagcaaagtaggcatataacaaagtatcccattatttacttgaatggcattatttgagtcatggccaatgatgtactttattatagtgggttgaagtaacactcaaatgttacacagcaacaaaaagaaggaagcaacaatgaactcattcaaactcagggaggcctaagcaaaacaactttaagaatactgattcaattcaacgtcaatgtcttaaatttaccaataaatagattgtatccattatcctgatcaggtaccaaaaacaaaatttcaaaagctccaacaaacaagcaccagaaagctaagacatttctctcattcattacaagcttcatttctgaaattttagcaataaccaactgaagaaaggatgttaataaggatgcagcaattgctcactttcgccaaaggataaattacaacgccaaatgtttattacatttcaatatactgtaccttgcttgtctcagctagcgtaagcacagtaagctgcttcaacttgagaacttggtcaggcaccaactgaggaagacggccagcaatacctatagaaccacatacatgctaaaactgacaaatttgaaatgcaggtaatatagaactccggagtacatcatcttcctcttacaagacaaccctcttcggtaatatgttcattggcaattcacaaacgatattttccctaatttgtatgtttagcacttattgcatatgaaattccatccctttcacactaggatcaatagaaggaaatcactgctaaatgtgacacttgtcactcaagagaagtattaaggtaagtgacacgagcactggcatagttaaggatgtaacagtgttacttacccatgataatgaaaagaattcacagcagtagaaagggcagctaagccatgccctaatcaactttctagccagtaatatactcagttttggagatacaacattgtaataatgtgatgtttaataattagaagaatcttcaagatattatacagatggaaaaaatagcatagtcttttagagtcaaaaaatatctcaagctgataaggtacaagttccccgtactataaaacttaaggcatttaatctgacagcgggcagatgaagagttacaaataaaatggcataaaagcaataaaaagaacttttccttataaaaaacagcataaaaagaacattgttgaaatctcaaacatgaaaacctcatccaatcagctactcaccgtcccaccccacccagtaaaaaaagaagtgaatcagatgcaaaaatgtatgcttacttttgtaatcactccacgttccatgagcaaacaaacggagcaaatcaaggtatattgaattttcagttccttcaagctgcatacaggtccaacaaaaaaacaaattagcagcaaatgtgaaagggatcctaaagtgtacataaagcaacaaggcaacagagagttaccaacacaacttgccaatagtatatcaaggtgacttattcccagatttatatctaattgacataaaaggaactctaaagagaatcacaacctgggataatacccatctcaatatgcttagggcctaatgctctgaacttgatgggattgggaggacaaatccaagttgtttcctcaacaatctactgtatccactatgcttccttaacctccactaaaatttgttcaatttcgtagtatctcgattctatttacttccactctgcatttcatgattttcattccttttgtctctgctggggtttgattccaatattcacttacttggggttctgacactacatgttctttattttctactgacataaagaaagcacacagaaaaccagcaagtgattcaatgtgacatgaaaacccagtagccaaattatcagaaaaaatgccatcatattctagatattaccaaagcaataacataacataaacacaacacaatgtgtactgtaaataccacgaaacctagaaaaaaacacagaaatacaaacagttcgacacaaaaccgactaatccaaatcagaaaaataaaatataatcaaatcaaatcaatagcagaaagaacaagcaggaacctcaacaacgttgggaacagaaagaatctcggagaaagcgaaaagtgagggatgcgaagtggcttcactaataacgttgttaagggcagaacccttgagcgctgatgtttgtttcacaaagtagtcgatgtgctccgcttgcttttgttcgatatccatctctcaagggatttgaaattctccagacaaattaaaaagtattaatcacaaaaaatgtcagggatgattagggttcaattacatttatatagaagaaaaatattagggtttccgaatatagtttatttctcgactgaaatatttgagtcctggcagaggaaggatcaaggaatgaagctctttgttggtctggtaatctgattttatatgatgcgcccgtcgatggtcgttttacttaggtgggctttggatattttttttggaaatatttttcaataaaactgaaaattctgaaattattttaagaccacttaagttctatattttctaaagttaattgtgaaaccgtattagaagtttacactaataagcatttggaatgactaatagatcaatacagtaacgtagagagattagttaatattgtgatattgagataacaattcatgcacacacattttatgcaaattgatttagagtactgttggttgggatatactattggccatgcgttttagatatagtattatgctttattctttatgaaacaattatttatttgatttatttaattcaataaattattattttaaatagatcagttgttacatgtatgtcttttagttatgtagtagacaatttagtgaatggagtcttagctcatgcaaagaagattaaattatcggttctcataattaataaactatgttcacaatcaaagatattgttgggcaaaatatcttgatgattgtagcacaagattaaagtataatttatcttggttatgggagtggttttgctccaacttcttgtgctagtatacttagtgtatattgaacagaccaaatagcgaaaggatgtttttgtactgaatatatataaaacatcttctctaattcattaaatgagcttatactcctaatcttgatatagttattatgatcaatgtgatttgtttattattttatttatcaaaaggtacaactctattcagaattagtgtatgcctaatagattggacaataacggatagcaattgtaaaaaaataatgaggtgatagaatccgtgattcggttttgagtttgatgacacccctttatgtaagcttataaattttcatgtgaacctggccggtgaattttgtatccgtcacatgaaatagtttaagcggaattgtaacggatttaattagttgattaaattaaattataagtgatttaatttaattaactggtatttgtaatcttaacatgaggagttaaaataagcattaataaattttgaaattcatattgaggagttcaattgcagctttttagtggaataaacagcgattaattatagtaagatttaattcatccgaatttcgaattaatactatattttgtagcctcttaatgtttttgtggtccctgctatacctagtaaaaacctggacagacttggataaaaaagtggcttgggtgaaaagttatccttttggagttagagtacgattctacttgcactagcagaattcaacatgttttttagccctttttttgcttaattgtgggtctacaaaaaggaagactagtttcacctaataactcactcttcagagttatatttgtaggatataaaactagtcttgaagatttaattgtaggcaaaaaagactagccttgaagtagggggtatttgtaggcatataaattttattaaaattaaagtcataaaataatttggactatatttgaattcaagatatattggtccaaataaatattatgggataatataatcgaattaattatataatctgatatatatggattaaataaataagtcttaatccactaggctaacccatttaattgggctaaagtgatgagttcacttcattaagcccaagatgtcatcttattagaggcccgatttggtgtcacgtgtcaaatgacgtggcacgtcaagtcaaccagaagagccaatgggatcatgccacgtgtcaaaatgacaaggcatgccaagtcaaattaaaaggccaatgaaatctcgccacgtgtgcaagtgacatgttctaaccaatcaaatgcggtcttgtcccacttcaatatgattagtcagaaatagtttgttctcaccacaactcttccctcccacgactataaatatggatctttataactcacaaaaaggactagaagttataacaagaagacacaagggagctcgtggatcaaaggtcacaattctttgcaaactgcaagtgttcaagcattcaagcacttcaacacaaatttcaagtattcaagatcaagaacgaagtcaaatcaaatacaaggcgttcaagatcaagtctacttgttcgtgataaaatttgtggaacaatcaaagcgttcacgatagataaatcaaattcaaattcaagatcaagctcaagctcaaaaggcccttgaatttatattgagaaagaagaatcagaggaatcatggagattataacactcaaactatttgaaataaaagactgcgattgtcgcaatatttttcggcctcgattattttcttgacgcaattttattgtctaaaaattctggtacgcccagtgggacaatctctacctctcatctcaacttttcaatcaccaaagttcaagaacattgaaatgtcttcaaataaaaccaactccagatcaacttccacgaaggttgctaattccaggttttatgttgatgttgaaagcattctcgatgttacctttggaagctttggaccaattatgaggatcaaagcaagctctttagaataacaagcactccaagtgtcgtctgcatcaacccttatttttggatctttatcctcaaaaggagcaagatcctctatgaacgtatccgaaggaggaagcgatattgctgaaaagattaaaaaaactctagctctacttgacctctccggatcccagaactctgttgtgaaggaagatgatgatatttcaagtgatggatctttcccacttacaccatatagcatgagccattcgagaattaatttgtgtgacaatccatacaactccccatcatccacaacaatcatgtaaggcatggtgacaaacacttcatatatggaggagcagttggcaaacttgacggaagcaatcgctggcttgaccaagtgcatgcaaaatcaagatgctagaattgacaagttaacagacagggtaggaatcttgatggaagaagaatccacccatgcacttggtaagctcctagaggttctagagagtaattctcctccaagacaagtagcatccgcgaaggctatccctgtctcatctgaagggatgattccaatcgataaactaaagaaattcattgaagaaactattaaaagcaagtatgaaattgctaccaagtcctctcttacatacgcaaagccatatactgcgaggattgatatgttgaatatgcctagtggctatcaacctccaaagtttaaacagtttgatagaaaaggcaatccaaagcaacatgtggcacacttcattgggacatacaacaacgctgggaattatgaagattacctcgtcaagcagtttgtctgctcgctaaaaggaaatgattttgattggtatacagactcgagggaggatctattgataggtgggatcacctagagcaagagttcctcaatcgcttttatagcacgaggtcattgtaagcagaggcggacccaaaacttgaagatgacgggggcactattaatagagaactttaccaatagttcttgggtcctgccggatgtcgcaaactttcggtaatgactgacatatataagtaagttaggaggtgaagttgggtatggattttgggaaaagggaagagagaagtgatttagagcttttaaggttgggatttaatcaaaacaaaaaacagttgaaaaaataattaaaagaaaaaaaaaagaggtttgggggggttgtgaatcctaatctaaaaacggtaagacataaataaatgaaaaatctaggctacagttaatatttaagataaaaaggaaaattatttaaggaagtaagatagtccagattcgaaccttggacatcccacatggaaacagaggtgagtagcacattcgactagtgcccccagcacgattttgtgcttcagggtgcctaattaaatataaactcgtttctcaaggtatatatacagaattttcccaagattttcggggtcctgtgaccccctaccatccacgtaggtccgcctctaactgtaagcatagtggaacttacaaatactcgtcaacggaagggcgaactagttaccgactttatcaattgttggaggaatgcaagcctcaactgcaaagacaagcttagtgaagcttctagcattgaaatatgcatccaaggcatgcattggggactgcgctatatcttgcaaggtatcgagcctagcacatttgaagaacttgcaactcgtgcccatgacatggaattgagcatggcctccgctggaaataaaaggttgcctatctatgagcctcgcaaatggaacgacaagcaagaagtcaggaaatggagcaagtttatacccaagtctaaaaacaaagaagctatgagtgtcaacacatcccatgcgaagttcacgacaaaggcgagcaagaagcagagtatgaagtccatttctttccaagataagccaagtggaaagttgactctaaaagaaatgcaagagaaggagtacccatttatggattctgatgtgcctgtaatttttgaagagctactcgagttaaatctcattgagcttccagaaataaagcggccaaatgaagttgggaaatgaatgacccaaattactgcaaataccatctacttgtgagccaccctctggagaagtggcttgtcttcaaggacaaagttatggacttgactcgtgaaaagatgatcatgcttgaagatgagaaagcaagcttaaaccaaatttctataacctttgtctcattcaatccagatgaattatacagttttaaagaaagtaaagatgaagaattactggagaataacaaagcggaagtagaccaccatgatgatgatgatgaaggttggacgttggtgactcatcgtaggcaccataaaaggagcctacgaaaagaatcaatagaacaaccaacaaggaaaatgatgatgaaaagaccaaggagatggaatccagttaagcatttgaaaaaagcaaaagtggaggtgcatcaccctcagatgccacaacatccagtgaccttggaagagtccttgccaagttggttccgcgtgaagatttatcgtgatggtattgaggcctcttgttgcaatgttgataaaggggaagaaaagagtgatgacctaccgttggcaccatcttcagaaaagctcatcgagtctattcctcaagaagttaatgcttgcaagaaaaaagttacattcacaaatggcactcttctaccaggagacagtactcataaccgccggttgtacctggttggctatatgcgtgatgaaagggtgaatcgaattgtagttgataaaggattctcagtcaatatcttgccaatttgcattgtgaaagaacttggtactcccatgaacgaactttcagaaagtcatgtcatgattcaaggattcaactaagggggcaaagagccataggtgcgatcaggttaggaatcaccattgaagatatgcaatcaagtgtgtggctgcatgtgattgatgcaaagacttcatacaacgtcttgcttggaaagccttggatatatgagaataaagtggttccatctacctctatcaatgtttgaagtactatgagggaggaatcaagaagaagatagttgctgatgacgagccattcaccgaggctgaatcacacttcaccgatgcaaagttttacttgaagaaccacattgtgaagaagctaaaagctgatgatgtcataaatggcaagaatgatgagtccacgactaagagagctgcagtggttgccgacaaaaccaaagatgttgctgaggaggtgcaccctagctcaaataaacctcataaagggaacatcgtgtctcacagcaagaaagtaactcctgctctccactatgtcactaaaaagaagaaagaggagggtgaatcatctaatctccaaaccaacattctaagggaattaactcttccgatcaagcaaattgaggcagtaaagctatcctcaacgctacttggagggtttgtcgcctaaaatcattctcagaatgtggttctcccaatgagccgtcaaatttagggaagctcccattagaagttgatacaaggcaaccacgtgaatgtttggaatacaagaaacctccgccagttttcatctccataagaagaaaaatcaataattatatcagtgtagaagatgaatctgttgcttctaatagaccttcagtctttgatcgacttggaaagccaattgcgaggactttcgtatttgagagattggttatattaaagaatgggaacaagtttcatagaaattatcgaaatacaagaacacccatttcgcctaaaattcagaagatctctaaggatttccaaagtctggttccttctagaatgaggcgacagacgaaacttgtggtttcgtgtgatgaggtacttagggtgaagtcatacaatgtggtatacactaggtaacatgacgaagacgaagaaaatgtaggtaacatgacaaagcgagcatggcgttttatctctaatggaggatgacgagaaattcgaggatgtttcaccgtgttatcatatatccttcaatgatgggtaccctcaagaagatgaagatacaaaggatgctccgcctgaacttgaagaaggggtaaagccaatagtggacactttgaaataagtaaaccttcgcactgatgaagaaacgaagcccacgtatctaagtgctttactagcaaccgatgaagaaacaacttatatggagttactcaaggagtttaaggatggctttacttggagttacaaagaaatgcctggcttggaccctaaagtagcagtccatcaccttacagtcaagaatgatgatcgtcctgttaagcaagctcaaaggcgttttaggctagacttggttcccttgattgaaagtgaagttaacaaactcattgaagctgactttattcgtgaagttaaatacccaacatgggtcttaagtatcatccctgtaaggaagaagaatgggcaggttcgggtgtgagttgactttagagatctcaacaatgcgtgtcccaaagatgaattcctgcttcctattccagagctgatgatcgatgctactattggttatgaggcaatgtctttcatggatgttttgtcgggctataaccaaatatttatggcaccaaaatatgaagagcttaccgcatttctcacccccaaaagtatttattgttacaaggtaatgccttttggcttgaagaacgctggagctacttaccaaagggctatgcagaatatctttgatgaccttctccacaagaatgtcgaatgctatctggacgacttggtggtaaaatcaagaaagaggggcgaccatttgaaagatttgagaatggtgtttgaattgctttggaggtaccaactaggatgaatccattgaaatgcgcctttggagttacttctggaaagctttttggtttcattgtccaacatcgagggatcaatattgatcaagccaaagtgaatgccattttgaaaatgcttgggcctcgcgatattcatgaattgaaaagtatgcaaggaaagctagcataccttaggaaattcatctcaaacttagctgggaggtgccaaccattcagtcgcctcatgaagaaaggtgtccctttcaagtgggaccaagcttgcagcaatgcctttaaaagtatcagaacctacttgatgaagcctctagttttagcagcccttatacctgaaaagccgttgatactatatatttcaacacgagaaagctctattgaagcgttgttggcccaagaaaatagtgaagggaaagaaaactcgatttactacttgagcatgatgatgagtccaaatgagctgaattattcgtcaattgaaaagttgtgtttggcgttagtcttctcaattcaaaagttaaagcactagtttcaagctcatgttattcgtcttgtttctaaagcaaatcccatcaagtccgtgatgtcaaaacatgttcttagtgatcgactaacgagatggtacctccaatttcaatatttctgctacatctcgtgtttttatacgttaaagtttcatcttcaattaatcgacgtagactcggggatgagatgttcttgagattataagcattaggctatttcaaatacgtggtgagtaaattcgtgaaggaaagaatgtaagcaaataaaataaaatgagtttcgttaaaggatgtcgatttgggataaaatacagaccgagcgataatactcgatatttatggactagtaccatacaaggtaccatatgaccgtgatagtatgatgtataaagtgtattaaaataagtagaatttttaagtaatttgagacaattcctaattatgcaggtaattggttaattaccgggtagtgagatattacctaattaattaattaattaattattggataatattaaaattccaccccaccccatgtggcagcaagccactaaaccaaacaaatgactcttagtcatttttggttaagtggcaaaataatgtattaagtgcaagacacttcattcctattcttgaaaaaaaagacttaaaaagtagtgtgttatatacaaacacttcatttctcatatttggatacaaagactacagaacgctagaaattctttctagttttcaacaaggcttcttgcaaccaaataattccagcaagaattattagaaccttagcttcgtgatccaaataacgatacgtaaatgtaatattattccataagtgatcctactcttagtagttaagaatttctatgttattcattccgttaaagtgagacaaaagtgaatagaacaggatatgataattatgcttaaaggagcacataaggagggtgaatgtgatttgtgaatattctgtggcttttatataatgcaagttaatgtttttcctttatgcattaaccaccgagctacgaccggtcgggcagttacacatctaccaccgagctatggccggtcgggaagttatgtattattatttaccaccagttaggcagttatgcatttaccaccgagctatggccggtcgggcagttaccactggtcacttgggcagttaacatcataaaaatgaggtaactagaacaattatagtgtagttttatttatatatacgagatgggatttaatctatatgttacgacccttattggcaagtcagaagttataagttgactcttatctctccccgagatagtattttattattattacgtttcattgctgccttacatactcggtacattcttcgtactgatgcccctttttctggggcactatgtttcatgccacacaggtgtaggcaggtgaggtaaggaccatccactgtaggctgcctccagatatcagcttttggtttgtgagctccacattttcctggagtattgctgagtcacattctatatatgttactttgttttatgaggacgtcggggaccctgtcgcgtcttatatgttatggtcatattttcttagagattttgcagacattgtcctgtgtatagctttaggtatgacatgtcaactgccttgtcggcctctatgtatctacataaatctttttgaattagataagtgagttaagttctaatactattaattaaatatataaatgtggcctatcatggcccatgacgagtcttatagagaaaaaaaagataaggtacgtggcgctcggttgagtaggcatcgggtacccatcgttgccctctgacttgggtcgtgacagatttgagattgtgtacgttcctcaaaaggttgtaaaaggacaaacattagcagacttcttggcagatcatctgatatctgatgattgggaactaactgatgaactacttgatgaagatgcaatggtcattgaagtacaacctccatggaagatatactttgacagtgttgcacatcgcggaggagccggtgctggcatagtattgtcacttctcaaggggtggttctgccctactcctttacgttgacataactctgctccaacaatattgctgaatatcaagcactaatacttgggcttgaaatggctgtcggtatgaaatagttgcaattgcaagtctttggtgactcccaattagtgatcaaccagcttttaggaagctacgaggtcaagaaacctgaactacgcccttattataattatgctaaaaaattaatggtatgggttggtgatgtgactattcaacatgtacctaggaaagaaaacaagatgactgatactttagctgccctagctttatcgttaaccctgcctgatcaaacgcaaattactatctaccaaaaatgggtattaccgccaccaaatgagggtgaaagtgaagataatgaactcgaacatattgtcgctatttctgaagctgagaaggaagaatggcgacaacccattatcgactacttgagctatgggatgctcctagaaaatctgaagagaaagactaaaatccgtcgtcttgtgacttcctttactacaaagatactttatatagaagatcatttgagggagtacttttgcgctgtttaggagaagatgagatactccaagctttgcaaaaaacacattctgtggtatgtggatcacatcagtctggaccaaagctccacttccatataaaaaggataggctattattggccaacgatggtaaaagattgcttggactatgctcgaagatgaaaggcttgccaattccatgcaaattttatttatcagcttcctgaagtgtcacatccaactgttgcatcatgaccatttgactcttgagggctggatgttattggaccactgctaaaatcctctggtgggcacttatacatcttggctgcaactgactacttctcgaagtgggctaaagttattgctcttaaggaagtaaagaaggaaaatgttgcaagtttcatccaagtaagcataatctatcgctttggcattcctcgttacataataacggataatggcaagctattcgacaataggttggtgaacaagatttgtgatctctttggcttcaagcaatataactcttctatgtacaatgacgtcgccaatggtctagccgaggaattcaacaagactctatgcaacttgttaaagaaaatcatctctaaatccaaccgagattggcatgaccgtatagaagaagctctgtgggtgtcacacctcctttttcctacccccggaaaggaagtataagagagtttttccaatttaagtgaaaatcgaaataggattatttattcatatttcagagtcgccacttgggataaatttatggtgtcccaagtcaccggttcaaatcccgaatcgaggaaaaaattgactatgtattacagtctgcgaacacagaaattcgggtagggaattctgttaacccgggagaaggtgtcaggcatttccgagttccgtggttctagcacggtcactcaactgttataattggcctattatctgattttaatacatgttttagcatatggttcaattttaactttataacctcttttatttaaatatttttaggaagatccaacgttacataaaacgcgtcttgaaccacgtcacataaatgcacccgcggtccacgacacattttatttaacattgttgagatttggatttgggtcacataaatgcacactcgaatttaggaaaataacttaaattacgcgcctaaagcaactacgcatttttaaatttacgagggtcatggaaatttaactaaatggcacgcctcagattctaaggatttaagatcaattaaatgaggtccatgcattttgagattttatttggcacgacgcacctcaattccaatttttaaagggaattcaaaactaagcttttgaaggccataaactatatcttgcctaatatggcacgccccaaatatatttgcctaaatttattcgaaatgttgagggccataagctagtcgtgttatctactatgactcacctcaactattaacaaagagactaattaattaattaagggaaaaaaactttaaagagattataactactttaatctaaagtctaagcttaatttgcttaatcaaggaaaacgagcacacggaatctgttccgtttttattccaaagcttggcctggcttgaagcccaattgccaatggcccataacttcacaaacatgagcaccattgggctcataatgtcgtccatatcgagaaccaaagtgtagtaaaggggagagggagtttggtgcaaagggattgatattgatagcccaaattgacgctttaaccttaacaaatgatggggacactgcagtttttcataaaatctttgaacctgaaccaattctatgttgaaatatagtctcaggccttatgcaaattaggcatcatgtaacaacaaggttcagaggcctaaattcatgcaaaattccagcttcaaaccatcattcttaacaaaactaacatggccctaaactttataaagaaaaccaactgcaaatagttgaaccaaattcaaaggttctctaatctgatttcaaactcaaattccatttaaaatccttttaaaattcaaagagtctatgcatgaatagaggcaacactaagttataagctttctgaaatcaataaaccaagtttcaagctatacataagtgaatctgaacacatgatggatggaaaaatagacctagctcagattcaactgtcccaaacataaatgattcaaactaacaaggatataacccatagccacactcaaaaccaaacaacctcacaatcaagctaatgaaccaaagtcttcagttaatacacatacctaatatctttagttaatacacatacctaacatctaatatatttctgaattgaatacattcgagacaaaactcatattttatcttaagatgcacgtgtagtattggttacatgattagctacacataagaaaacttggctaggaaaaaagcataaaatacaatgcaacaaacttaaagaaaagaaattggtagagccatgaagaggtaacaaaagtccctttcttcaactggaattacatatcttcacacaatagcctaaaacagacatcatttccattcatggctcgagagaaatacctgggaacaagaggaaacaaggaggagtgaggattcagcaaacaacaacagtagatcagtacccagattcaatgaaacagtaacccagaaaaccaaacagcttcaaactaagcctttaaattcccagaatcaaaccattttttcagccaggtgcagggatttgaaatgcttcaaaactttagctaatagggaggatcagcaaacctagactaagaaggattgagctattttccacagagaaatgtgatgaatctaagtgtcaattcagagttttctcaacaaaaaaattccaaccgtttcagtttagcaggattttttctcttcctttttttttgtttttttgctagtgaagtaaggatgcctttataggtaaggtattagggcagcaatgctgaaaataattttgcactttaaaccttttgaaattttggttttagcttagatacccctagtgtaaagatcagaaattcagttaagtcctaatgacaacttctaggaagcttcctatttcagttatagagagattctctacttacaattcccatatcacccttaaaaccccttgttatttacccttcaattattaacttgagttaagctagaccacagtccaaataaaccagtctcttaactaggtcagtggtgtccatagttactatgagagacttgaatactcagaaatgattaaacaaaaccatagaaaaagaactaatccaaaactggagggcaaactcacacaattctgattttagtcttaaactaactttagctaatctaactaaaatcgaactttactaactaaagataatcagtcacaaacaacgaaaaacaaaagaaacaaataaaactgaaccaaatgaaaacagaaaggaactacaatgtataaaattagtgggagaaaggagggagaaataccaaacatggtggaatgccttgacgacatgaggcatatcaatgagagtgaacaattggctcggaacttgatgaactcgtcaaactctgacatccccggaatgaactaaaatcaatgtcgattgattgttcttgttaagaacaatcaacccgcatagactataattcaaaacgaagccagcccttgaacaaaatcagaagaagagagagattagggttgaattttctcagatttggaactagggaggtcttgttggggttttcgggaaataggcgtgtggataagctttgggatggtctgggctttaactggtatgagtttgggtgggttaaggtttgaaggtccaaacttcgatcaaatattcgacgagttccacgatgattcgaaggcaacaaatgacagattcgttaagaggggaggaagagggtgctacgatgtaaatctggtgtggattgtaggtcaaccgccgccgctggcgatttccggtaggcggcggactgtggtgagaggagggtgtgatgaagaagatgatactatgttaatgttctaaggttttcggatagtcttatgtgattagggtgaggctttgctggccgttcgatgaagagcaatgaaaggcttagattgatttgtctttaagaaactcaaaatgacgtagtattggcctgatactacgtcgtttgaattgtttaggagactgaaaggttggaccgggttggggcatggtttggtctagttttggacgggtttaagggtgcaattgtttgggcttgagagaattaaaataaaatagcccaaaatccgattcttttcttttccctttcaaaattctttttaatccctttttctttttaaaaacaaaaataaaaataaagtaaaacctaatttaattcctaacccaaattatcctaccaaattaaattaattaactctaacaattaccaaaactaattaaagactaaattaaaataagactaacaaaattcaaagctaaaaattaaacaatgcaaaataaattacttttttgtgattttttccatttttgtaaaacaaattaatttactaattaatcaagaaaaaaatgtaaaattaagttctaaatgcaaatgcaatgtattttttttatttttataaaaattaaacatgcactgataaatgcaagcaattaacgaaaaatgctacaaaaaatccgcgaaattgcaaacaatgggaaaatttattttcttgaatctatgagtgtaatttatataggggaaaaatcacgtgctcacagtgagcatataggacaactcactgcacgccaataaaatcgaccccttattcactcatttatggagtcgaagctatcttgccactcgagcgtcaaataacttcattacgattagctattcaagaagggatcaatgatgaagaaaatgctcgacttcgattagcagagttggaggctcttgatgagaagaggttggaagctccacagagtcttgaatgttatcaagctcgattttctcgcgccttcaataaaagagttcgcccgagatcctttcaagtaggagatcaagtcattgccatatgaagatccattattacttcccttaaacctatagggaagttcacttcaaaatgggatgggccatatatagtacaagaagcttattcaagtggggcttacaagctggttgatgcagatggcatgagaatcgaccctatcaatggaacattttttaataagtattatccttgaagttgcaatgctccttgacgcacgagcctaaactgcatgttccaacattcctggcccgcaagagtataaattgtttacgacccaaacaaaaagtctgctaggttgaaaacctcgaaagaggcggcctaggcaaaagttaggacataaaaaaaatcacccattctgaactacggtatgacttaatcctcttcaccgaggtacgtaggtagcttagagtttcattctaagttcaaccgcatacgcttaatagatacatagtgtctcggtcgttatccgaatgaaatacgatagaatgtaatccattcgatcagcacttgaaagtcgagctgatatactattcttcgttaaactttggatcacatttgatttaaagggggtaagccactatggtaaattggtgtcttcaataaaattgtcacgaccccaaaccacctcggccgtgatggagcctatcacattactaggcaagccgattcaacactaatacataaaggtcttttgtaaatttatttccaaatcagttatgaacacaagtctttcatttaatataacaaagtacggggaagaaaacaactacgcaaatacatccacactgcccaattctggtgtcactagtcatgagccactaagatactgtctactcaatacaagaagaaaaaaactgaagtaaataacactaaggataggaaggagaaagataggattgcgaacaccatgcagctaccttgctatctccagaaatactcagaagctgctgaaagctctctagatctgcacacaaagtgtagagagtaacgtgagtacgccaaaatttcaattttgccaatttaagcctaaatctaccatggaccttcaaaatatattctgatcactctactaagtcccaaatcacctaatgaagttatccgaaccataaaaatccaattccgagatcatttacccacaagtcaatttctggttgacttttccaactaaatggtcaacttaagagactaagtgttcatgtccctccaaaactactccaaacccgaaccaactaacacgatacgataaaatgtagttgaacaacacataaagaagcagaaatgggaaaaatgggggtgtaactcatgaaacgactggtcgggtcgttacatcctccctatcttaaaacaatcattcatcctcgaacgagtcaagaaacatacctgaagcctcaaacaggtgaggatatttgctccgcatctcccgctcggtctcccaagtagccttctccacaggccgacctctccgatgcactttcactgaagctatatcctttgatctcaacttttgaacctggcgccccaatatagccactagctctacattataattcaaatcaccatctaaatgaaccgtgctgaaatccaaaacacgagacagattgccaatatacttccggagcatagaaatatggaacaccggatgcacactcgacaagctaggtggcaaagctagctcataagccacctccccgatcctccgaagtacctcaaaaggcccaatgaatgggggactcagtttacccttcttcccaaacctcataacacccttcatggatgaaaccttcagtaaaaccttctccccaaccatgtaagacacatcatgaaccttcctaatagcataactcttctatctcgattgtgctgtacgaagccgctcctgaatcactttcaccttgtccaaggcatcctgcaccaagtctgtacccaaaatcctagcctcgcctggctcaaactaaccaactggagatctacaccgtctcccatataaagcctcatatggagccatctaaatactcaactgatacctgtcgttatatgcaaactctgccagtgatagaaaatggtcccatgaacccccaaaatcaataacacaagcgcacaacatgtcctccaatatctgaataatgcgttcggactgcccatccttctgagggtgaaaagttgtgctcaactccacctgagtacctaactctcgctgcacagctctctaaaactgcaaattaaactgagtacctctgtctgaaatgatagaaactggaatgccatgcaggcgaacaatatctcagatgtaaatctctactaaccgctctgaagaataggtagcacacacaggaatgaagtgcgtggacttggtcagccaatccacaatcacccaaatagcatcgaacttcctcaaagttcgtgggagcccaactacaaagtccatggtgattcgctcccacttccagtctggaatatctaaccgctgaagcaagccacccggtctctgatgctcatattttacctgctgacaattgagacatcgagatgcaattcccaaaatatccttcttcattctcctccaccagtaatggtatctagaatcctgatacatcttcgcggcacccggatggatggaatactgcgagctgtgggcctcctccagaatcaacttctgaagcccatctacattgggcacacatatcgggccttgcatcctcaatactccatcatcaccaatagtcacatctctggcatcatcatgatgaactctatccttgaggataataaaatgaggatcattatactagcgctctctgatgcaatcaaacaaggaagaccaagaaatcacacaagctaagacccgactggattccaaaatatccaacctcacgaaccgattggccaaggcctgaacatcaattgcaagaggtctctccccaataggaatatatgccaaactacccatactcaccaccttcatactcaaagtatcggccactacattggccttccctagatggtacaagatagtgatatcatagtcctttagcagctccaaccatctatgctgcctcaaattgagatccttctgcttgaacaagtgttggaggctacgatgatcagtaaacacctcacaacacaccatgtagataatgcctccaaatcttcaatgcgtgaacaatggcggctaactctagatcatgaacggggtaattcttctcatggggcttcaactgacgagaagcataaacaatcactctacccccatgcatcaacacacacacaatacattctcgaagcatcacaatacattgtatatgaacctgaagatgaaggcaaaactaatattggagttgtggtcaaggcagtcttgagcttctgaaagctcacctcagactcatccgaccacctgaataaagcacccgtttgagtcaatttggtcaagggtgatgtaatagatgaaaatccctgaacgaactgacggtaataacttgccaaaccaagaaagctgcgaatctctgtggctgaggacggtctagggccaactctaaactgtctctatcttcttcggatcaacttgaataccctcgctagacaccacgtgccccaagaaagccactgaactgagccaaaactcacacttggagaactttgcataaagcttctcctctctcaaccgctgcaataccactctcaaatgcttcgcgtgatcctcctgactatgtgagtacaccagaatatcataaatgaatacaatgacaaatgagtcgagataaggtcaaaacacgctattcatcaaatgcatgaatgttgttggggaattggttagcccaaaagacatcacaaggaactcataatgaccatattgggtcttgaaagttgtcttaagaatatccgagtccctgatcttcaactggtgatatcctgaccggagatcaatcttggagaacaccctcgcttcttgaagctggtcaaataaatcatcaatacgaggcaaatgatacttgttcttgattgtaactttgttcaactgcttgtaatcgatgcatatcctcatcttgccatccttcttctttacaaacagaacaggcgcaccctaaggcgacacactaggccgaataaaccctttatcaagtagttcttaaagttggtccttcaactccttcaactccgccgatgccatacgatatggtggaatagaaataggttgagtgcccgacactagatcaataccaaaatcaatatccatgttcaggggcatatccggcaggtctgcagaaaacacatcgggaaagtccctcactactggaacagaatcgatactagacatctctacactaacatccttcacaaacgctaagtatgaaaggcaacctttcccaaccatccgttgggtcttcaaaaacgaaatcaccctactggggacaaaattagttgaacctcgtcactcaatccgtggcacacccagcatagccaacatgacagtccaatatagcccgacacggagatagctaatccatgcctaatatcacatcaaagtccaccatacataacaacaaaaggtctattcgggtcttccaacacccaatagtcaccacacacgatcgatatacgcggtccataataatagtatcgcccatcgaagtagatacacaaatagactaatcaagatactcacggggcatatcccaataacgagcaaaatacgatgacacatatgaaaaggtggaaccaggatcaaataacatagaggcatctctatggcaaacagagaaaatacatgtaattatcgcatctgatgcaatgaatctggtctggctgggagggcatagaaacgggcctgaccaccgcctaatcggcctccccctctagggcgacccctagctaactgtcccctaaccttagatgcttgggcgggtggtaaagtaactggagctgaagtcgagggctgactcctctactaagatggaccctcaaaaagacaaggacactgcctcctcatatgtccaaactatccacactcgtaacaacttgttagtgcagggaacggggactgaagggaacccctagcaccggaatgaccagtagaaggacctggcatggaagagccctgaactgatggagcacgggacgaactctgggctggtagggaactaagtgatgaatggccctgatgagaactatgagaattatggctcgatgataccccacaatgaactgggcgggctcactaagcatgcctgattgagcggcctctatcgtgctgaaactgacctctcgaagtaacaccaccaaaactaccagatccccgaggcctcttagcctccctctcatctcgctcctagcgacgaactaactaaatcttgcgggcaatatcaacaacctcctcaaaagtagcacttgataccttctctatggtcatgagaatctgaagatgatatgtgatgccatcaacgaacctcatgatcctctctctatccgtaggaaccaaccaaacaacatgacgagctaacttcgagaaccttatctcatactacgtcacaggcatatcgccctgacgcaattgctcgaactgcctgcaagctactccctacaagactgtggcacatacttctctaaaaagagagcggagaactactgtcaggtaaggggcattgcaccaataggcatacgcctatcgtaagcctcctaccgagtgaaggcagctccacaaaactaaaaagtagtaaatgctaccccgctggtctccagaatacccgctgtacgaagaatcatctgactcttgtccaagaaaccctaggcatcctcgccctctgcaccattgaaagtcgaaggctgaagtttaccaaacctctccaatcaacgatgctcatcctcaggcataactggtactacaaaatcctgagcaggtgcaaccagctgggctggtggtgcctctggtgtctgcaatccctgaacaacctactcgggtgtgcgggcagtaggagtctgagtgcctttcccggcgtgagaagtggctgttatagtagaaactgcgacctcctgagcaagactagtgcacacggtcaagatttgagccaagatctcctgaagactcggaataacaataggcacaacgggtgcctgagctggccccgttagagcatcccctactggaatctaatcacgaactagggcgccggtggatctgtaggtgttgccttatttgctgtacggtctacattcctacccctgccacggcctcgaccgcgaccttggtctctagtggccccaactggtggttgtccatcctgactagtagcacgtatcctcaccatttgtgagggaatagaataacataagtttagtactagaatcaacagatttgcacgacaggaatttcaagaatgtgaagttttcctaaaggttatgcagcctctcggagataagtatagacgtttccgtaccgatccgcaaaactctaataaatcggctcataacccgtgagacctatataacctaggctctgataccaacttgtcacgaccccaaaccaccccggtcgtgatggcgcctatcacagtaataggcaagccgattcaacactaatacataaaggtcttttgtaaatttatttccaaatcagttatgaacacaagtctttcatttaatataacaaagtacgtggatgaaaacaaatacacaaatacatccacactgcccgattctggtgtcactagtcatgagccactaagatactgtccagtactgtctactcaatataaaaagaagaaaaactgaagtaaataacactaaggataggaaggagaaaggcagggctaaaaatgccatgtagctaccttgctatctctgaaaatactcagaagttgttgaaagctctcattctgatgctctggcacctggatgtgcacataaggtgcagggagtaacgtgagtacgccaaaattccaatttcgccaattcaagcctaaatctagcactgacctccaaaatacattccgatcatgctcctaagtcccaaatcacctaatgaagctataagaaccataaaaccccaattccgagatcatttacccacaagtcaacttccgattgtcttttccaactaaatggtcaacttaagagactaagtgtctcatatccctccaaaactactccaaacccaaaccaaccaatacaatacgataaaatgtagctgaacaacacataaagaagcaaaaatagggaaaataaggttgtaactcatgaaacgaccggccgggtcgttacaaaaatggttatagtcttttaggaggctacaaagtatttgcattgaagtttgggaatttgctatattttcatgttcgtgtaactttgaagcttgttggtcttcatatccacttactgccctaaaaaaggggaagataagagaggtgtcaaaaagggaacataagtataagaagaaagattgattggcacaacgtttcaaattcagtgagacttgtacccaagatatttgtgagaatggagctcctgaatttcgattgatagcaataaaaacgtcttgcaatcccgaatcttccataccaaaacataaaagtttcgatgaagtcgcgccaattcagaattgtcggtatatcaaaatctgatgttgattttgaaatactatctgaaactatccgtaagatattaaatcatacatcttgaacatgttttagattttgaagtcttgttttcaaaaaattaaacagttcataatttcaacgttcctacatcaagatgtaaaagttttggtgaagtcgcgcaatcttcaatttgttggaattttatgttgatttcgaaatattatttgaaactattcttaaggtattaaatcttgtaatttggatatgccttagatcttgaagtctagtttccaaaaaaatcaagtggttcatgattttcacatttctataccaagatacaatttttttggtgaagttgcacaaatctaaaactatcaatgtgtcagaatctaaagttaattccaaaatattatctgggatgactatgaaggttcttgattctgaaattcggatatgccttggatattgaagtctagttttcgaaaatcaagcggttcatgatttcgacgtttctacagcaagatacaattttttttggtgcagctacgcaaatgtgaaaatatcaacgtgctggaatttaaagtcagtttcaatataatatctggtacgattctaagaatgtttgatttcaaattttggatatgtcttagattttgaagtctagttttcaagatatcaaacggtttgtaatttcaatatttctacaccaagatacaatttttttgatgagattgcacaaatctaaattgatagtgtggtgcaatataaagttggtttcaaaatattgcctgggccgattttgaaggtgcttgattgcagatattggatatgtgttagattttaaagcttaattcctatgaaatcaaagggctcatatttttgacgttctcacattgagatatatactttctaccgtaaagctacaaaggtgatgaacaatattatcttcaaaaaaaaataaggatgtatcttcaaatatagagaacctcgaggcatgaatgacaacgatgtttaaaagaaagccaaattcaattacgtagacgccaatgcatcgtgctaagcaagcaactagtgataatgccaaattgtattacgtagacgtcaatgcaccgtgctaagcaagaaactattgatagtgatccccaaaaaaaggtggggggtaacatcaattaaaacgcgcaatataaagtaaaacagatggagttttcatttccaagaatagtcgctagttaaccaaaatcaagagaaaaaaacaaaaaacaagaggcaaataaaatactctatatagtctagtctaaacacaacttaaaattgaccgagtctttaagggtggcctctaagtgttgtttcttcgtccccacgtcggccaagtcatcagcagttgccaaggaaacatgagaacatctacggtactcctcttcaccagataagactctatatccaatctcttcaacctctttcttagctgcatctcggagagctcttaactatttcaccttctccttggcctctttgagagatttactggtgacagatagttactcgtccttctcccctttttcagtcaagacaagatcaagatgttccttggcttttaaaaatggcgttgatttttcaacttccacaaccttgtcagaaagagttgatcgtgcctggtcatatgaagtaacaagcttaaaaaaaacgttaataggtattttaaaggggaaatatccataccctttccatccatctcctcaagaatcacttggatctcgaattgaagaggaagcattgtctgtagtaaggttggagagtttggcatgaattttaggccaggcattcaagatgaaatccttgcgaagagtcaagccaacatttcttccgtcaaagatagacatcgctagtgctaatcgttggtaaaaattaggtctcgactttgctccaagattaggaatgaaagtctcctctaggtccgacttagatattggaagtgatttcctcgagtccgaaaatgctacagattaattactaccctgtggtttactttggtgtgacgctatcaaaatatgatcactacttggttgcatgaaaaaaagatagacggttagtgaagttacctctatattataagacaatatgaaagtttaagcattacctctttaatgaccgtcaaagtccttgaagcactgccaatactgttagtaatctcaactacacccaaattagtgtctcctagtttgtttgaatatggattcactcgcttgaagttttgatcgccatgactactatcactctcattttggaatgggcatttgttgaaggtagggacaacggtgcctaatggaaaggaaccctcattgacttgatgagcttaagaaggtcctttctttttttgagcttctttatatgaaggtcccttgatgtagcatggtgcaaccactttggatttcaaagtaggaggcttgtactcctttttattctctcgaggcatgatctctaaaggcgcagcagtgattgacccatcaaaagtcaccaaagatgctaaatgatcttcaagaaatctcccatgcactcttgtccactaggatttgtactctgacgaaaatagcttttttgccatagatatagctgggggaaaggtcgccctcgcattggtggaattatgtgacccacaaatttgccaaaatctgagtccttcttctagtgagacgttatgaaggttattttccaaaataccaggactagtctgataaaatccaaattgacggctaaatcgatatggactatatggttcaagaatgaaagagttcctatacctcaaagggagataattaaaacggatactcataaagtgatttatttcggttcagatgctttatcattgtcctcaaaatagtaaggtttggacccctccgtcgtggtagaagtccaagatgcattatccacttgataaatgcgttttcttgcatttgtatcatcccaataccttgcagcgccttctccggaatacgccaccaatagtggaacatatgttccttttggaatcccatagtgcgtcttgaagtagtgagcaagccaaccgtatacataatgaataggaaaagtgattttgatatgctcgagctgcgaggacttagagatcttgttcaaaccatagtagatattcgccagaactgggattgcaaggctgaatttccatccatattccatcatgctcaccgttttaaaggtctcgggtcgaataaaatcgccatcttgagagggaaatacgagtgcgcacaaccaacaagataagaatgtcgccagatacgtgccttctctcttttcatgtcaaacctcaagatcagcaaacatcgtctcatccgtgccacaccatgcaactacttctagtatagctcccgcgggattgtgcgttgacttcaaatgggtagattttttctccctccttgctggagcaggtttatatctcaagtctctcgtaccaatattcaatccacttgttaaacaagacctttggatcatgactctccccttcttgaagatggttaaaggcagtaaataggtatccacaagctcgaggagtaaatctttcattcttctcattaacacctgtgagttcgatagcttctggcacaacttcttcgtaaggagaacctccaattggtaaatcgccaatggcgtgtaaatcctaaagagatattgatagttctctgactgatgtaagtaaggtatttgttgtgggaaccaagcttcaagaaacacttgcaagatgtttgagtttcgatcatatgtaaataaagaagcatagacaacatcataaattcttgttctctccaaagcccattgacttctgaaaagtatgtcttcagcccattcccctagaatatgataatattcaccgtcaattctcaaagtatctctccaacgtatctccctttgaatcatacgccatcctaggcaaggaaaggtactcgcgatattgagttttctttggtaagaagtctgaagggaccacattttagttggcttttggttgtgctctgaaggccaatctaccatatggagggaattctgtagaggtggccacaaatttgcatatcgaccaactagtggagggtaagtcttcaattatgagatacttgcacttggaggatagagatgtgtagtctctgaagtgaactatctcttcaaaactgcataaacggaaaaaaagattagtaaatattaagtcaacgacaattgacaaaaggaggagaagatcctagtcctttgtgctttaggcaaatttctataggcgattaagaatattccttctatatgatgtcatgggtttaatcttctatatgttgatatggatttattcgtctatatggtgatgtgaatttgcgcgtctatatggtgatgtgaatttgtctgtctatatggtgatgtgaatttgtctgtctacatagtgatgtggatttgtctgtctgtatggtgttgtgaatttatctatctgtatattgatgtggatttatccgcctatatggtgatgtggattgtccgtctatatggtgatgaatatttgttcgtctatatgttgatatggatttatccgtctatatggcaatgtgaatttgtccgtctatgtgttgcgagggatttatccttttatatgttgtcatgaatttgatcatctatatgtcatcatggatttatccttcttgtttggcctacaaaaaggataaaagagtaaaaataaattaaaaaaaggcacaagaaaatgaagaagaaattacctttaattcttccaaacgccaaaaggcagagcaacttgaaaaccccgtaaggttaatgttcaacaaaggaagggtgtgcgcctatttataaactatggacaacggttaattgaggatgtcgctacgatgtggaataatttttaaaagttgtatcctaaaagaatttgactagcaaagtatccaagtttaaataggaaaaggagatcttctcacattagttaactgaaggagacaagaatttaaatgcaagaagaaaacaatatggtactcacggtcttctattcctaagggatattggaatatgtaatctcaccttttggctacgtgggatttttcctttaatagatatatattatgagagttacaattcataatgctggagtgaagcaaatcaaatacgatatcaaatgaagtattaaagtttggcctgcaagcattattttgtttccctatattacaacatgtaaagatgctgttagaagtaagtttcaagaggtaatataacaaaagtaaactttctccaatacatcaagactagtcttagaaaatgtacgtacctatatctcgacaagtcttgaagtagggggtatttgtaagcatataaattttattaaaattaaatccacaaaataatttggactatattttaattcgagatatattggtccaaacaaatattataggctaatataattgaattaattatataatccaatatatatggattaaataaataagtcttaatcccttgggctagcacatttcattgggctaaagagatgagcccactttattaagccaaagatgtcattttcttagaggcccaatttggtgccacgtgttaaatgacgtggagcgccacgtcaaacagaagagccaatgagatgatgccacgagtcaaaatgacaaggcatgccaagtcaaattaaaaggccaataaaatctcgccatgcgtgcaagtgacatgttctgaccaatcaaatgtggccttgtcatgcttcaatctaattggtcgaaaatagtttgttctcatcacaactttgtcacgaccctaaaactgaaccggtcgtgatggcgcctatcgcgaaactaggccaaccgacacaaacgcaaaaccaaccagaaaatcataagaagtcatttaaaaccattaattaactaaaatcccataatataagtttaaacaagcggtgcggaaatataacacaagcccgacatcggggtgtcaccagtcatgagcaactacaaactcgtctaggaacaagaaaggacaacatagtccaaaaataaaatactatgacaaactgaataagataggagggagaagcacagggatgcgaacaccaagcagctacctagtcaactccggagacctgctggaagactgatcagcactcgctatcacgtcccgacactcctgaatctgcacgtaaggtgcagggagtaatgtgagtacgccaactcagtaagtaataaaagtaaaagcagctgagcagtaagaaaacaagtaatttcacgcagtgttttaaaaggcggaggcatgaggggcgaggcgaaagtcatgagacacggggcgtaagtcccatggatcttcaattttataatttgataatttataaaataatcttaaaaatatttttatatgtgaaaattacattaaaagtatgtacataaaataaaaagcatagggaaattattataattattttataactgaactaacaaacaaaaaataaatactaactaagccacatcctgacaataaggttgtaagtgacgcctaataaaccaaacaatataaggaccaactaaaattatcatggctataatctgaatacctcatgtgcaacagtaacacaaataaatgccaactctgaagatacaaagaccacttaacacttcctttactctgctattaaacattaaataataatttggtgtaaacaaaataatttggttagagatacacaagtatcataattaagagttcaagcggtactctatcttgcaaaaaaaaatacaaatgcacaaaagttatactatatcaattctgttccaatatatcaagcacctccctaaactcctagcaagacttcatcaccagtgtttagtcatagatacagttgctctatcaatcgctatcaaaaacgagggtctcatcaatttccacatcttccagtccttcatcatcctcgactttcactgatttttttgtagatcaaaagagaaggaaaaggtaaaagtgttagtattttgacataacagatgatagcatacaactttataaaaatagtagtagaatactataacttacctgatgatttctgtttttttgttagagggacctgattcacttgtatctcttaaactcccaacatcaatgaatgattcatgtgtaagatcattctcatatggtgtaagcggcactgtgctagcaacatcaatatcaaataaattctcttcatcaagccaagaagaatcttctggaggatcttccttttcagtaatccattcatcgtcagaatcaacttcatctactagaactggatcaaacttttgcaattttctttttatgctcctttctctcagtctagtattgtacctcacataaacgagagcatttaatgtatgatgctcaagtctatttctcttcttgatatgaatctagcaaaaatcagaaaacttacattaagttaagctatcataaacaaactaacaataagaaaatatatgtaaaagtataaacgcttaccgactcaaaggtactccaatttctttcacaacccgaggagctgcaagtgagactcaagacacgaattgcaaatttagtcaactctggagttttcccgccaaagcgtatccaccaatccgtaggagatctcactttcctagaatccacagctatctgacatccaaaatcccctctcaattggtcatatgaatctaactgaacatccactttaaatctctcttcataatccaacattctttccatacattggtacaaactttgtttgacttcaaagttaatacaatctttcctcaaatcgcaattgcggattcaaatagtaccctacaacatgaagtggatgacatagttggcgagtccatctatcatcaattgttttccaaatgggagcatatttgttttcagtatatccacaattcaaggctattttttccttagccctatgtatcatatcatacaaatatcccatgcatggtttttcctctgaatctacttccctcaaaacactcactaaaagggcaacacttttcacacaataagcaatatatggccaaaaattttgatcaaacaaaacgatggctctcgttttcaccccctcgtgtttcttatcccaagcagatttattccaagcttcagaagaaaatataggtctaagagcttgtttttactttttaatgctttgaagtgtgagatatgttgtagcaaaatgagtaatagcaggacaaagaagttcatgattatttataaatgatttcattaaatctaacacccatgtatgtccataaataaatctcacaacttcttttgcttttataagtgtgtcttgatgcattttcaattttcctatatcttctaataacaggtcaatgcaatgcgctgcacatggagtccaataaatatgaggcctagtttccattattctttttccagcattaataaaattagaaccattatcagttattatctgcacaacactcttctctccaacttcatctatggtcttatttaaatgcgacgcaagcatttcaccactttttatagagtccgatgcatcaatagatctcaaaaaaagtacctgtgggactattaattagaaagttgataaaatatctactttttccatccgtccaactatcgaatataattgaacaaccatattactttcaagatttcttatgttcatataacatcttgttaatatttgtaacttcatcttttagtatccaagttcttagctcatgcattgaaagaggtacaaaacccggaccataatttgcaactccttcaaacattgacaaatagtacggatcatttgcaacattaaatggtataccacttgagaaagaaaacctaccaattcgctgacaaacttcttttctttcctctttttttccatttggagtttaaagtagcttgtcttgcttgagcactaacaaaatcatccagcagacctctagcctttggaggcaaattgctcatagttggagaagaacctgattcaccatccatgttaccacttccagttgcaacaactcgcatttcttccgaagtagcctttctcatgatttttacattttgaagctttagtaatgccttcttgcattcttcagctacttcatccggtaccttcggacaaggctctatccctttatgagtgtctgctaaatgtttcttcaatttgttaattgtgccgctaatatgttgagtacagaatttgcatcgaaagtatttctcatccggggtcatgattgaatatttccatgcaacatctgttttccttgcatttttagagccctcttcatcaattgtaacgttttagcttacctacaagaaaagtgagataagaacatttaaattagtagaaaaaatctacatacagcacaacattattgaacttcaaatttcataaaattcctttaccaagggagaacattttttgtttccaaattttgcgtttttttatctcgttatttaaattttgtacaatagataaatctgaatacttttagttctttaaaaattactgattcgagatcaagttggtacagaaagctgaagcaaacatgacaatgcccacaaattatggcaaataacattgaataggcttaagtgtactgttggattaagtatttcaaacattcaaataaagtaaagtttttacagtaaagcaccgttggattaagaattccaaacgagcaaataaagtattgttggattaaaatacaaaaagaatattaaatctcaaccagtaaaatttttttactgtaggaggctaggagcacatacaattggaagaaccacatatgaatttatgaaataccgattatacaattactatagaacaagaaaatcagattcaatgatggataatctctacttaaactatttggaaaggaagtgtagatgggcataaagcagaaagaaacaataaaaataaaaaaagtaataagaaagattaagttatacctttggagttgtggacttaatgtgaaacagagaagttaacaccgtagagtttttatttgcttatggtaagtcttgtgtgggtaaaagtgaaagggttgaaaaaaatattgggaattgtataaattgttcctaatttggctaagttccatagggcataagtcccagaagaaagcgtgcatttcgcctaggcttgcgccccagtatatagtgtgtacgtccaaaagaacttcgcctttttctatcgcccttgtgcgttttcagtgcgccccgtcccgggactcgccctgtactcgccccaataacgcctttgaaaacactgatttcacgtcatagcactacagcaaaacaatatatgtctagaacaatacagtaaatcaataatctcgtaataacaactcagtttagtaaaacctttttaaaatctctttcaatagttttaaacgagtgaagaaaatagtgagtaaaaggacagaaacataaatagcccctcgggcaaaacatgtaccacaaccgcccctcgggcaaaatatcaacaaaattagtccctcgggctacctcacaatcactcgtagtcagcccctcgggcaacaaaatgaaacaacatcagcccctcgggcaatatcacatctctcacactgggtacccacgctcactgggggtgttgagactccggaggggatcctatagcccaagcgctatcacaagccatctcgtggcataacaaatcaggccctcggcctctcatatatcacaaatcagcccgatcccataatatcctcacaacacaggccctcgacctcactcagtcataaacctctcaagccgctcgggcaatagtaaaacatgatgttcagcccaaaatatcatttaaaatatcaaagcagagcaaatacagttgagttatgaaaatagtagaatacaacatgaatgagtacatatattgagtcaaaacagttaggaatagtagtaaaaagcccctaagggtcaaaagcagttggcacgaggcccaaatatggcattcaacccaagacatggtaatactttccaaaacacaatgatatcaaagagtttccaatcaaatacgtgacttaacagtcgtataggacggaccaagtcacaatccccaatggtgcacgaccctacgctcttcatctagcatgtgtgtcatctcaaaatagcacaacgatgtgaaatctagggtttcataccctcaggacaatatttacaatcattacttaccttaatccggtccaaactctagcccctgatgcctttgcctcttgaatcgtcctccaaatctaaccaaaatcagtatcataccattaatacgcactaaagaaacaaagcccaagctaaaataatcaaattaactaaaaaatcccgatattggtcaaactcataatgaccatatcgtgccctccttcttcttcacaaatagaacaggcgcaccccaaggtgacacactaggccgaataaaccccttatcgaggagttcctgaagttgctccttcaactctgctggtgccatacgatacggtagaatagaaatgggctgagtgtccggcaccagatcaataccaaaatcaatatccttgtccggtggcatgcccgacagttctgcaggaaacacatccggaaagtccctcactactaagaccgaatcaatggtaggagcctctgcattgacatcccttacaaaagctaagtatgaaaaataaactttcccaaccatccgttgggccttcaaaaatgagatcaccctactgggaacaaaatcaagtcgaacctcgccactcaatccgtggcacacccagcatagccaacgttactgtcttagcatgacagtccagaatagcacgcagagatagccaatccatgcctaatatcacatcaaagtccaccatacaaagcaatagaaggtttactcgggtctccaaacccccaatagtcaccatacacgaccgatttacgtggtccataataataatatcacccaccggagtagatacacaaagagataaaagaagagacttatggggcgtattcaaataacgagcaaaatattatgacacatatgaaaaagtggaaccgggatcaaataacacagaggcatctctatggcaaacagagacaatacatgtaatcataacatctgaagcaatagcatcgggtctagctgggagtgcatagaaacgggcatgaccaccacctgattgacctccccctctggggcgacccttagctaactgtcctccacccctagcttgctaagtgggtggtgaagtaactggtgctgaagtcgatggctgactctctgctgagatgaacccccaagacgacgaggacattgcctccatatgtgacccaactctccatactcataataaccccccggtgttggagacggggactaaagggaacccctagcaccggaatgactagcagaagaacctagcatagaagagccctgaactgatggagcaggggacggactctgggatggaagggccctgagtgatgaatggccctgatgagaattgtgagaactatggctcgatgatgccccacgataacctaggggagctgactgagcatgcctgaatgggcggcctatgccgtgctgaaactgaccctcatgaggagtaccactgaatccaccctaaccacgaggcctcttagcctccctctcaatcctctcctgaccacgaaccatctcaatctgtcgagctatgttaacaacctaatcaaagttagtatcagacactctctctctagtcataagcaaccaaagttgaaaatcgaggccatctataaacctcatgatcctctctcgatctgtggaaaccaaccagaccgcatgatgagctaacttagagaactacatctcatactgtgtaatagatctgtcgctttgatgaagctactcgaactaccagtgcagctcctctcgacgagactcaggtataaacttctccaaaaagagaacggagaactgctgctaagaaaggggcgctgttccaactggcctatacctctcgtaagcctcccatcaactaagtgcagccccgtagaactggaaagtagtaaatgagaccccacttgtctccagaatacttgcggtccgaagcatcctctgacacttatccaagaaaccctaggtatactcgccctctgcatcactgaaagtcggaggctgaagtctaccaaacctctccaacctgcgttgctcgtcttctggcataacaggagctacataatcctgagcagctgcaaccggctgggctggaggtgccctcggtgtctaaagtccctgcacgacctgctcatgtgtgcgagcggtaggagtctgagtgcctcccccgacctgagaagtaggtgcggctgtagtaactgagaccgcctaatctaggccagtacacactgatataatctaggctagggcctcgtgaaggcctggaatcaaaatgggcacagctggtgcagctggagcgtccacaactgggacctgatcatgaactggggcggctggtggatttgcaggtgccgccctagctgttgtgcgggctacacccttgcccctactatggcctcgaccgcatcctcgacctctagtggcctcagctggtggtactggtggtcgtccgtcctggccggtagcacgtgtcctcaccatctatgagagaatagaataatagaagtctagtactagaatcaacagattcgcacgataggaattcaagaatatgaagtttttcctaaaggttctgcatcctcccgaggataagtacagacgtctccgtaccgatccgcgagactctactaaacctgctcatgattcgtgagacctatgtaacctaggctctaataccaacttatcacgaccctaaaactgactcggtcgtaatggcgcctatcgtgaaactaggccagccgacacaaacccaaaaccaactagaaaatcataagaagtcatttaacaccattaattaactaaaatcccataatataagtttaaacaagcagtgcggaaatataacacaagcccgacatcgggggtgtcactagtcatgagcaactacaaactcgtctaggaacaagaaaggaaaacatagtctgaaaataaaatattaagacaaactgaataagataggagggagaaacacaaggctgcgaacgccaagcaactacctagccaactccggagacctgctagaaaactgatcagcactcactgtcgcgtcctgagactcctggatctgcacgcaaggtgcaggaagtaatgtgagtacgccaacttagtaagtaataaaagtaaaagcagttgagcagtaagagaacaggtaatttcacatcataacactacaacaaaatagtatatgtccagaacaatacagtaaatgaataaactcataaaaacaacccagttcagtaaaacctttttaaaacatctttcaatagtttcaaacgaatgatgaaaatagtgagtaaaatgatagaaacgtaaacagcccatcgggtaaaacatgtacaacaaccgcccctcgagcaaaatatcaacagaaccagcccctcgggctacctcacaatcactcgtaatcagcccatacgacaacaacatgaaacaacatcagcccatcaggcaatatcacatctctcacactaggtacccatgctcactgggggtgttcagacaacggaggggcacctacagcccaagcgctatcacaagccatctcgtggcataacaaatcaggccctcggcctctcatatatcacaaatcagtacaacatgctatggcgcgcagcccaatcccataatatcctcacaacacaagccttcggtctcacttagtcagaaacctctcaagccgctcgggcaatagtaaaacatgatgctcagcccctaatatcatttaaaatatcaaagcggagtaaatacaactgagttataaaaacaatagaatacaacatgaatgagtaaatatattgagtcaaaacagtgagaaatagtagtaaaaatcccctaaaggtccaaagtagttagcacgaggcccaaatatggcattcagcccaaaacatagtaatactttccaaaacacaatgatatcaaatagtttttaatcaaatacgtgacttaacaattgtacaggacggaccaagtcacaatctccaaaggtgcacgaccccacgctcgtcatctagcgtgtgtgtcacctcaaagtagcacaacgatatgaaatccaggatttcatagcctcatgacaacatttacaatcattacttacctcaatccggtccaaactctaactcgcgatgcttttgcctcttgaatcggcctccaaatcgaatcaaaatcagtatcataccattaatacgcactaaaggaacaaagcccaagaaaaaataatcaaattaactcaaaaatcttgaaattggccaaacccgacccctgggcccacgtctcaaaatccgataaaaatcacatcaatagaatccttatccacccacgagtctatacataccaagaacatcaaaatcggacctcaaatggcccctcaaattcccaatcaaagctctccaattacaagccctaattccccaattttaggctttaaatcccacaaatttcacgtttaattagttagaaattaccacagaatcgagtattgagttcaaaaaccttacctccaagtgtttccttttgattccctcttcaatccctctcaaaaagcttccaagccgttcaaaaattgtgataaatgggctaaaaatcgtgaagatgagtttttatacattctgcccaggtgctcccttcatcgcgatcgtggaaactgctttgcgatcgcgaagcacaaaaatttactgccctcatttaaccttatggtatcgtgtaaacctccatgcgatcactgagtactgcctttgctaactcacatgatcgcggcctctcccacgcgatcacatagaacaacatctccactcctcaccaactccttctctcctacgcgaacgcgaccctagccacgcgttcgcgaatcacaacttcacagctaatcgcgctcgcatcctgactctgcgatcgcgcagaacaaatatcacctctgcccacccaagcctatgcgatcacgaacatttctacgagatcgcgaagaacaaatcgtctgcaacagaataccaacagaactgctaactcctcaagtccaaaatgtcccgttgagcacccgaaacacacgcgaggctcttgggacctcaatcaaacatgccaacacatcccataacatcattcaaacttgttccaaccttcggaacgctcgaaacaacatcaaaacatcaaatcaccctcggattcaagcctaagaattctagaacttctgaattccgcaaacgatcaaaaagtctatcaaaccacacccgaatgacctgaaatttttcacacaagtcaaaaatgacacagcagacctacttcaattttcgaaattccattccgaccctgatatcaaaatttccactaccgaccggaaaatgccaaatttctaattttgccaattcaagcctaaatctaccacggacctccaaaatacattctgatcacgctcctaagttccaaatcacctaacgaagctatctgaaccatcagaattcacatctgagacctttttcatataagtcaaaatccgattgactttttcaacttaagcttactcaaaagagactaagtgtctcgttcctctccaaaaccactctgaacccgaagcaaccaaatcgataccacacaatacaactgaacaacacataaagaatcaaaagtgggagaaacgaagtggtaactcatgaaacaaccggtcgggtcattacaaactcttccctcctacaactataaatattggtttttataactcagaaaaatgaccagaagttataacaagaagacacgagggagctcgtggaacaaaggacacaattctctcaaactacaagtgttcaagcattcaagcacttcaacacaaatttcaagtattcaagatcaagaatgaagtcaaatcaaatacaaggcgttcaagatcaaggctacttgttcgtgataaaattcgtggtaacaatcaaagtgttcacggaggataaatcaaattcaaattcaagatcaagctcaaaggcctttgaatttatattgggaaagaagaatcagaggaatcatagagattataacactcaaactatttgaaataaaatactatgattgttgcaatatttttcggtctcgattattttcttaacgcaattttattatctacaatattatttgcctacataaaaaatttcatacaaggtcttacaaggagcatagcagaagacggcaaccctgaattcttgctctgtggaggacctgtgcaacgtttttgagaggttagtgttctaatctctgtaattatatcactgtctagtttacatgtttgtgatatttggattatatgcttgcttccgttgcgcatgttctaacaattagtattagacatcgtcttacatctaactagataatataatacaacatgaattgagtaacattaaaaagtgttgttaaattatacatgtttgatatagttattctatgaaaacaatgatgttttttatgaaaacgtgactgttttgagtactattttagttctgaaattatgtattaacatacataagtatgaacaaatgtgttctgtttcatgaaaacaatgatatttttccatgttttattgcaatttttccatgataatagtaatttttaatataaaaatgagactgttataataatagttctgaaatcatgcattaacatatatacgtatgatatgtgatatgaacgaggcaaaataaatagaaccctaacaatgccaaaaatagattttgcaaataggtcatgaatttggaattttgaaattctgtcgaacttcgattaacctcaaatttggtaggttcatcataaatgacctagatgggtttcagggggttttagatgggtttttggccaattttctatttttggaaatatttttttaataattttttttaagaaaactgtggtggtagggttcactccctatggttttcattcatgttatacagtaatataataaatttatatgatgacatagttattcttccacatcggataaattcattatagataatcactgtagttttgcccctagttgtttgataacttgtattaactctccaattgagttacatgttgattcaatgagactagggtttataaaaatgatattacctatattaaattgatagtttgctctccatttgagtaggtcctggtttaatttatggggtaaatatcttacataattcatatattttgcatgaataattaagtttccctaacaaatctaactattcaatgagcatggttatatgtgtaatgtactattttgaattttattatcctaattgaataactaataatctatttaatgtgaatatctctcagattaatcatatcttcattcaatccacttacctcaattttgaaccaaaacaagttaagaaggaccgaattatgttgactgaaaaaggaactttgatattgtcctaactgttgaaggttacaaattcataattaccgaggagtgcccaaaaaacatgatgaagtgctaccgatgatcaggttaaggcctatgataaatgggttaatgctgatgagatgacacgatgttatattcttgctcctatggaaaatgttttgcaacatcagtatcagtctatggggtctgcttatgacatgctcaaaagtctcaaagagatgtccggtgagcaaaatcatacggctaagcagacatccatgaaagcccttttgaatatcatcggttagagaccatgttacgaagatgatgggtcgaactagaggtccttggagctatgattgataaggaatctcaagttgagatggtagtgcagactctgcctgaaagttttcaacaattttgcttgaactttaatatgaataaaatggatttgtcactagtgaaattattgaatgagcaaacgacagaatctattatcaaacagtaatctctggttgtggcactaaatattgagaaagcttcggtttctaggccgagaggtggtaagaaaaaggggaaggctcacaaggttttggcacttggaggtacgactgctggtgtgaaaaatcccaaaggaaagtgttataattgcaaacaatattgacattacaaaaagcaatgccctgcttatctagcaaagttgaataatcaaggtaattcaaatttaaatgtcattaaaacttgtttagcggttgtctctatcaaattttggtgtgtagattcaggagccactaatcatatctgaactactttgcatgggcttcaggaaacacggtggctaagtgagaatggagtttgcgtttttcaagccaatgatgagccaacaccaactttagcattaggagatattagattttcatttagtagtgatagagttttagttttaaaggatgttctctatgtatcttctatcaaaaggaatttgatttcggtttcaaaaataatggatgctagttataatatttattttgataataattgtgtagttattaagtttgataaatgttttatctacactgctgctagagtgcatgacctttttattcttgatatatctcctcgtgtactacaaccaaaagaattaaataacattaatccatcacataaaagaaaacgtatttctgaattgagccaaacttatttgtggcacttacgtctaggtcatataaatcaaaataggatttcaaggttgctttcagatggacctttgagttcgttgaaattggaggcactaccaacatacgaatcatgtttagaaggtaaaaagatcaagagatattttccctcaaaaggaaatagagctagtgataagttagaattaattcactctaacttgtgtggtcctatgaatatacaagcaagtcgtgcttttgagtattttgtgactttcatagataattactcaaaatatggatacatttatctgttgtgccgtaagtctgaatgctttgagaaattcaaagaatttaagacaaaaacggagaaacgatataaaaaaatatcaaatcattgagatctgatcatggtggtaaatacctttctatggaattcactaaatacttatcaaattgtggaattacatctcacttatctgcccctgaaataccacaacaaaatggtgtggcggaaagaagcaataggactcttatggaaaatgctagatcaatgttaagttattctgagttgccttcttctttttagggatatgctttagaaacaaaaaattatattctaaatttggttccttcaaagttagtaccttcaaccctagcaaaattgtggactgggcgcaagcccagtttacggcacatttgagtttggggttgcccagcacatgtgctgaaaaagaaagcgaataaatcggaaccgtggacagaagtgtgcatttttattggatatccaaagggaacgaaaggaggtttattttattgtcctaaggaaaagaaggtaattattacgaaaaatgccagagttttagaaaatgactatttaatgaaccatattcctagaagtaaactagtttttacaggaattaagcaatgggataactaatgactcatctatgaaacgtatcctggaagccaatattggcataccactgcattattatagtgggagaaatgtcaataggcagtagaatgcacaagagcaattgtctgacatctcactaccccaaagtagtgggagtaatgttgagcaacctcagattgttgagcaacctgcacttcaggaagaagttaatgatatcccagcaccgcaaagtatggaggataacattgaggcttcagttttaggaaatgatgtaacagttcaacatcaaaataaaaatgcacctatagtgacttgtcggggtgggagaattattaaaaaatatctccgatttgcgctcttgggagaatcatatgatataatccccaaagagcctaatacagaacctcttaattacgatgaagcactgcaggatacagacgctgataaatgagttgttgctatgaaatctgaaatggagtccatgtactccaaccaagactgggaccttgtagaaccacctactggagtcaaacccattggttgtagatggatctataagaaaagagaggaatggatgtaaaagtgcaaacttttaaagctagtcttgttgcaaaaaggtttactcaaaaagaagggatcgattatgaggaaacgttttcaccagtagccatgcttaaatccattaggattctcttatccattgctgctcattatgattatgagatttggcaaatagatgtcaaggcgcctttccttaatgaaagtcttgatgagtgtatctatatggtacaaccaattggtttcataaaaagtggcaatgagcacatgttgtgtaatttaaagaaattcatttatggattgaaataggcttctagagcatggaatacttattttgacacttcgattaaaactttcaattttgatcaatgtgaaaacgagtcttgtgtctataagaagtgggatggagataaagttacatttttggttttgtacgtagatgatatcttgctcgtaggaaataatgtaagcatgttagattcagtaaaagagtggttgtcctcgcgctttgatatgaaagacttggggcaagcggcacatatccttgggatcaaacttatgcgagatcacaagggaaaggatgttagtcttatcccaagcactttatattgatactattctcaccaagtttagcatacaagattccaagaaaggttttcttccttttaggtatggaatctctctgtcaaaagaacaatccccaaaaacaattgatgagataaaaatgatgaaaacggtcccttatgcttcagctgtagggagtctcatgtatgctatgctatgtactagatctgatatatgctttgttgttggtatggttagtagatttcagtctaatcctggacgagaacactggactgctattaaacatataatcaagtacctgaaaaagactagggattatatgttggtttatcactcaggtgatcttgtactcattggctatactgattcagatttccagttagatagtgattctagaaaatctacctcaggatatgtttttaccttaggaggtggagccataagttggaggagtatcaagcaatcatgtgttgttgattccaccatagaagccgaatatgtggctgcctcttaggcaactaaagaggttgtttggcttgggaactttctaaaagaccttaatatagttccttcagttcaagcaccaattgtactttattatgacattagtggtgcagttgcaaactcgaaggaaccaagaagccataaaaggaataagcatattgagcgtaaatatcatttaattttggatataacttagagaggtgatgcaaaagtgttgaagattgcgtcagagaacaatttggcaggctcgtttacaaagagcttgccacagaagatttttgacaaacatgtagaagggataggtattagagttgtagacgcatggttatgagtttaagtgggagattgttgggatatattattaaccatgcggtttagttatagtattatgttttattctttatggaacaattgtttatttgatttatttaattcaataaagtattattttaaataaaccatttgttacatgtgtgtcctttagttatgtagtagacaatttagtgaatgaagtcttagctcatgcacataaggttaaattatcggttctcatagttaataaattatgttcacaatcgaagatattgttgggtaaaatatcttgatgattgtagtacaagattaaagtataatttatcttggttgtgggagtgatttttctccaacttcttgtactagtatacttagtgtttattgaacggaccaagtagagaaaagatattttgtaccgaatatatatatatatatatatatatatatatatatataacatcttctctcattcattaaatgagcttatactcctaatcttgatataattattatgatcaatgtggtttgtttattattttgatttatcaaaaggtacaactctattcaaagttagtgtatggctaatagattggacaataacaaatagaatttgtataataataacaaggtgatagaatcctgtcacacctcctttttacccgcgccgcaagggcgcagagggagtttttccaattaaaggacaatcgaaatgggatttgtttatttatttcagagtcgccacttgggagatttagggtgtcccaagtcaccaatttaatcccgaatcgaggaaaagaatgactctgtattacagtccgcgaaccagaaatccggataaggaattctgttaacccgggagaaggtgttaggcattcccgagttccgtggttctaacacggtcgctcaactgtcatattcggcttgtttatctgattttatacaattatgagctcatgtgcaagttttaactctttaccgcttttattattatattttaaaaaagaatgtgaacatcgtttaaaaaacatgtctttgaattgcgtcacatgaaatgcacccgcaatccggaacacatttttattcagtgttttgggatttggatttgggtcgcatgaaatgcacacccgagcttaagaaggtaagattattaaaatgcgcgcctaaagcgattacgtattattattttgggtaaggccgtggagttcgctaagcggccgatcccgagttctaagtaattaatacatacatttgtgacggccccgcaatctatacgttttactaggctcatctcatctcattttttttatgcacaatcctaaaatgactacatttttctattaaaattagtttctaaaatagagaaagaaaatcctaattaattaggagctttcaaaaaaatttaaaaaacgtaacatactaattgctagattaagacaaatattaatggaaaggaactttactaaaaataaagaaaaaagtgaattcgaaatcataaataaaataagaaatttgacaactaatattcaaaagaaatcaaatatagctagattgaagctcgcattgttatataaaaaaaactattggaattaattattcataaccatttgaaactagatttaaccataattactaaagcttattagaaaatttattaaacttaaacattatatagtcttgtttggccttaactaaatttagctactcattcatgattaacctactgttgaccatattaaaaccttcatagctaatgaattaacccgttttgccaagctgattcactaaagaccaacttatgtcattttcctcttattccaattattaaacagtaatacatgaaatagcctaaatacaatcagtaaaagaaacgaagaaaaagcggaattaaaacttcaaagttccattcttcatatgtattcatgctttcacattttccgcttacgatatcgacaaggttacagccatgtacctggtattgaatacaagagaagaggaagatgagaatcaacagcagtattaacaattcagcacagcaacaacagtccagcaacacaggaatagaccagtaatagagtttgcaaaccggtggagtagtaacccaagaaagaagcttcaagcttcgatgaaacaatagcaattaatgctaatttcaaacaatgaaggaaagtagaagattttttttcagtttgttctctcccccctttgttcttcttcctttttcttcaagtatcaaatgagtcctcttatacccaaagcaagactaccttttcttttttacctcttttctttttccccaatattcttctactatgtataacttttaactttttattattacctatattatttctgatttttaacttaagtaaaagtagtcaacacggaccccacggtttccctctttttgaatggtcaaagaagaactcatcattatccccttttctttttactttacatcattatgtcttgtcccccactaacatatgtcttgtcccccactatattaaacaattatatcaacccaccactacctcatgtcttgtcccccaccaggtactattttaattttgttaatgcctagtggacagagcactcagattaaataattgttcaaattataattccaaaatacccctccgaccttactgaaattaccattttacccctaaaagtactgcaatttaccaatctacccacatcagctatacccaatttacttaatcaattccaaccaaaatacagcaaatataaccaattcctaaacaaattcaatcaacaaatcccatgaacacagattgaatcatacaacatcagattaatgggaataagttaaccatattgggaaccaatcctggttaacttagacaaaaaatgaatgagcaaagggacaacaatattaacaacaaaagtaaactgaaacaacatgaatcacaattaactgaatcgaaatgcaaactgaaatcatatgatgaacaacaaagagcaggaaaccaaacaatacacaaaacgaaattattcgaaccaactcaatattaacaaagatactatacattctacaactaataatcatgaatgacaaaccaatcgaactcaaattcgactaaacagatttcaaagaaattttttacaaccaagattcaactaagaacgattcaaactccttcaaccataatatttaaacagattttagcggctcttatcttactcacatatagatcataaaatgagaaagggagattagacggaccttaaaaacctttaacaatccggacctctactgcgtatgaactgtttcaacgaccccgaccaaagctcgaacaaatgagatggtggggtctcgttttggattgaaggcgacaaaaaaaggtgaagcagtagcgatgggaattggttttgaatcagatgctcgatgaggaagcagcaacacaacagaagcagatgctggacggagctaagccagcagcaacgcagtaggtgcaacttggttttgaagcagatgctcgacgaggcagtcatgggaggtgagacatttgggtctgctggaggtcgacgagttgttcgtcatcgacggctggatgtagcaggagcagtagtggcgatggagcaatggtagcggggttgggtggtgctacatggtacaagggtgagagacggtgaatgtgacatatagcttcctcctgcttttgttccgaggctgctaggttttggttttaagttgtctaggtttgttttgtgaagaagatgaggagctggtgggtcaactggttaatgtcgcgaaagtttaggggtgttcttttaggttgagatgaaagagcagcagtggctgtttagcttaggagatggacgatggtggtttgtgtgttcgagctggaggtcgtgaggatgatgaagaagatgaagcagaggggtcgttcatggtggtcgacgaagaagatgaagcagaaggcgaggtgctagggtgttgtttgtcgagggaggcagccatgggagctcgagctcgagctcgatgacgaagaaaaaaacagcctgcttggcttttggattggagctgtgtgtgtatgtgcttgtgtcgaagaagacgatgcaagggcagccatggatgggggcgtgaggaaacttggagaagatggagagaaagagagagggggggcggatgggtttaggtttagcgtttttttgtgaaaaaaaatgaaaatgaagtgaagataggaggttgggtcacttggggttatggggcgtaccgggtcgggtcgactcggtgggtctttgggttggataaggggttatttagtttgggtagaggtgttttgggcctaggttcaaaattgaggaagaggcccaatttcgatttttctttattttttgctctcttttcttttactttctaattaataaaactaaaattctaaattaagttataaactaaattaacttatcaaaaatattaactaatttctagcaacatttatcacacataattaaacactcattaaaacaaaattgcacaatttgacatttaatgctaaaaatgcaaacgacgcatatttttgtaatttccattcttgtaaaacaaacttaattactcctaattgtagaattaaatcctaaatgcaaatgcgacatatttttgtatttttattaattttaacaaaaaaacatgcatggataaaatacaaataattaccctaaaatgccgcgaaaattctcaaaattgcacacaaaggaaaatcgttttattttgaatttttgggagtaattctttcatagggcaaaaatcacgtatttacagctgcccctctttgtccgaagacacgaagagttttcgtgcaatgataaaatgagcgttttttgcccatccgagtactccgtgtgaagcatttttttgaaaaatatttaaccgaacctttgcttcaaaggtttcctacatatccctggctataagggaatcaggttaatgtagttcgagaagttttggtagctgggactaccatgggactgcaatgttactgttgttgcatactgttattactgcttgccgaccaccttattacaccatgctgaaagaaaacaagaagctagactaaactatagtctatgaattacaaaatcttatctagatcttcaatcatgctcttgtgtctcttgttgatttgatgtcttggcgactcccctggcatttctttacttctggtttgtcttgtgttctccctttgtagacatgtgatttttgaccctccccaagatcttttatatattagcgtaaaatatttaatttaggcattatatagatattttaagtaattttgactcttttactttattttaatacaagaaaacaaaaattacaaaaaataagttcattaatattttgtagtcatttttaatctaaaaaagaatatataaaaatagtatcgtatttttatttttaatataatgtttgataatacaaaaaatagatttgttttaatggttagttttgttttaataattattttaatagtagaactaattaataaatgagcgcgtatttttaatctcattcgcggcaaaagaatagagcttgggctcgagcaacccatctttaggcctaattttggacctagaccacaattgccaagcctataattcctaggcccataccccttaacctaaaaccctaccactaacctagacctatatatattaaacaaagcctaaaactaagggggagctgaaggaaaagcagcaaagctgcgcatgaagaaaaaagcttcttcatttaagaagctattacgagcagcagctagaacgagttgcgcaacacaaacgacctcccccccgaccatcatcttcttcacgacccaccatccctgcatcgtcttcttcacgacccaccacccttgcgtcgtcttcttcgagcacatggcccccaccccctccacgtctccgtcttctccaaacgcaccccactgtcgttctcttcttcttcagtaacaaccagcatctagcagctccatcgacgaccaccgttcagctcaccatcgtcgccggacctcttcacgtccaccaacgaccatcctcacgcaagcctgaaccaaacagccatcactacctttttccttcagctataacacacccaaactaccccagccaacaactactctcatgcctccaaactccatggaagcagctgaatagagctccaaaatgagctgacaactcccagtaaactcgcctgtaaaccactccgaaggagcctcgaaaaacagtccaaaatccggccaggaatcagaaataaaggagcgtctcgtttcttgcccagattcgccgaaaaatgcgcctagttcatctcattattgtttcgttcaaaatccggcagagtccgtttggttttccatctgagttcctgtttttccgttaaggtcggcgatttgtcgaggtattgtcgttggttttcggcttgagttctgtccagaggtcgtcggattcatctcttttatttcccatgtaaggttagtttctattttattgtgtcattgataataatactacattggttggtcaatatttgtcgccggagaaactccgtcgctaaggtttaaattttgttctttgggtgtcttcttggagcttttatatgaggtttcatatcatatgctttggttttgttgttgtaaatatgtggttttcaatgttagcggctaggaaggacaataatatgacgtgtttgatttgtttaaagatgtgttaattctgtttgaagttgaataagcttttcataggagatgacagtccatttgagggctaccttgggaatttattgtacttttactcttttatggtttctagtcttctttggattgtaacagtgtggtgctactagttttttttctttttctttttttggtataaataacgtactattttaaaaatgtatttggataggtttaaaagtttcatcttaaaaaagatagtaaatatagctttgggtttgggcagggtcatatttggtattgtttattactttgatcgttacttttgggtttgctcttaatacatctatcgtgattgtgtacacgctcgcgtgacataattacgattctaaatcaattcggaatatgcgtttcgcaacttcgagcaagctttcttaaattgttttaataggccgaagtgcgccatgtcgaataaaattccaaaattcatggccctcatttatttatttacttcaaatccttagaaatcgaggtgtgccatttagttgaaattccatggccctcgcaaagtgcaaacgcatagttgctttaaacgtgctcttaatagaattaccttcctaaactcgggtgcgcattgatgcgacccaaatccaaatctcgatgaagtcaaaatgtgttcacaatcacgggcgcattgattgcgacggggttcgtaacgcgttttcacgacatcgtaattcttataaaataaataatgatataaaagaggttcacaaattgagacgagcctcaccacacaaaaatgaataaatgtggggccctcaataagtggttattaaaaatgattagaatttgggatggccatttagcgaacttcacggtcttgcccaaaataatattacgttagaatctttaggtgcgattttaattaaattaccttcttaaactcgggtgcgcatcgatgcgacccaaatccaaatctcgacgaagtcgaaatgtgttgacaaccacgggtgaattgattgcgacgtggttcgaaacgagttttcacgacgttgtaatttttttttaaaataattataataaaagcggttcaaaattaaataaaaggcacataagctagcatgtattaaaattaaataaaatcaaatacaacagttaagcgaccgtgctagaactacggaacccgaaaatacctaacaccttctcccgggttaacagaattccttacccggatttctggttcgcggactgttaacagagtcatatttttcctcggttcgggattcaaccggtgacttgggacaccattaatctcccaagtggcgactctgaataattaattattaaatcccgttctgattgtcctttaaatggaaaaactcctttacgcccttgcgaatgtagtgaaaaaaggaggtgtgacagctctggcgactttgttggggactttaacccagaacatgttgttcagggttcagaattcgagcttatataaattgttgtatttgattgtatctgattttcctacatatttttatgctgaatatgctaaatgttaccgctttgatattatctgaactgtatataaattgtgccgacacccttctctcttcacctccggggatgtgcttactggttgagactccctattcggttagtgtcataccttgaaataagaaagaggccggacaagttacgaagccggatggccttttggttcccggtaagttgccccctcctcgactcgagttgttcgctcgggtacacagtctagaacactgacccaggttttgaacatagaataacgtgacttcatgccggatccctagtaggaacgcttatttgcatcacgttgcattcgacttaggggactcaacacaggggttgggtccgtctaggactagcaacctgaaatgaaaagaccatcctgatgcattctcttgtgctgtgcatttatttgttccggacctgcatgttgaccggttttcgcatctcagaaatgttggaaaatcgaggaaaaaggaaaaaaaagggaaaaggagaaataacagttagagaattaattgattatcctagaaaacccaatgcccaaacactatcgaaactctgccgaaatttttgaaaaaaggaaaatgcattatttctaaaagtctgttttactaaaagcaaaagaaaataggaaaaagagtcttttattttttgaaagtgtttgttgaaaaaggaaaggaaaaagagtcttttatttttagttttggaaaaataggttgtcttattgtctgtggaaaatgaaaaaaaaagagtctattatttttttagcttgggaaaataggttgttttatttgttgaaaagaaaaaagaaaaaagagagtcttgtttctaaaaatagtttttattcgcttatgaaatgccaaaaataaaaatggaaaagagtcatgttttaaaatagttcggttaatttgcccgaactatgcatggtttgattctcacagggcttgagatacgtaggcaaccctcatcgggtccaacctcccatttgcaaaaataacccaaaaatatcaaaattttaattttgtcataaataaaccaggtgatgccgtttttgtcaaaaatagccaaatattcccaaacggggtgccggaaggctgactttgcataaatagccatctttggtcgtatttttatttttgaccctcacagccttaaaatcttcgcccccgaggcgcaggaaggccatgtttgcaataccgggtcatttattttaatttggaaaaaacaagaaaaaaagtcagtggtcaaatgaataccgttcagattttgggtcaaaattggcatataggggaaggactgtcattttggggtttgtatttcttttgataagagtatatgggtcgtttgattttcgagtctgtatttcatcattaagttggttagttttgttgttattatgaaaagggaaaattccaaaaaatgttttattgtcgtttaccttttatttgcaagaactacgcacggtctgattcatgcggggtcatgatacgtaggcaatccccataagattcgaccacaaccaaaaaaaatgaaaaatggaaaagaagaattgaataaaaaaaatggaaaagatgttgttaataatgaggaccgactcgatacattctaacatgttttgttttgaattgtgaagaaaggtgaggtggttggtttgtggtaagctggaaacacaagatctgaggaaaaatgataattgacatcgaaactgttacgagtgctcaagagactcagggtcagagggttcaacaagagtctacggtggttgaggaaaatagaacactgaaacaacaaatgaccaaaatgcgccaagcctaggccaatggccaaggacagccttgtcacgagtcataatttgctacacaacaagaacagtaccactatcccgagtaccactcgtactcggttgatcttcctgcaaatatcgagaagtctgcccgaaagagggtacaggaagaaataacccaaagagtgaaaagattagaacaacggttgaaaaacacgcaagtaatggcaggacaaaagagtgttgccttcagagatctatgcatgttacccgatgtccacttgccgcctggcttcaagatccccaaatttgaaaagtacaatggacatggagaccccatagcccacctgaaaaggtattgcacccaattgagaggtgtgggaagaaatgaagaattatttatagcttattttggggaaagcctcacgggtgtagcatctgaatggtttttggatcaagacacatcttgctggtacgtctaggatgacatggcacgggcctttgtcaaacaatttcaatacaacatcgacatcgccccagaccgcatttccctgtctaacctaaaaaagaaaccaactgaaactttcagggaatatgccatcaaatggagagagcaggcagctagagctaagccacccatggatgaccacgagttaatcactgtctttctacaggctcaagagccaaattattttcaatacatgacatctgcagtgggtaaatccttcccggaagtaatcaaaatgggagaaatggtggagaacggttttaagacaggcagaattataagttaaacagctctcaaagctgcagctcaagctgtccaaattgaatttggtaacacgaatgagagggatgaagaaatcatggtgatatcagggtcgagaagaggtcctaggagaacatctcgaaggtatgtgcagcctcatcaggttttccatgacccccctaagcattactatacacttccgaacctctcatactcgccaccaaatcacccaaaaaagcgagcacgagtatcacaaaatctccaccagcctccgcaaaattttcaatcaccttgttacccacatccaagccaggggtatagaagggaacaaaagttgaaagatagttttacaccaataggagagtcctatgcaagcttatttgagaagttaaaacaacatgacatgattgccctcattcctccaaatcaggtggactgacgtgcgagaagctttgactcatctaaaaggtgtgaataccactccaatgctctggggcacaatgtggaaaattgtcgggatttgaaaagagaaatagaaaggatgatccaggaaaatttgattcaagacggtggcacccagaatatcgcgttgcatcccttacatgaggaggcacacttggtagggatgatgctcggtgacatggggtatgagaatactcttgggaatttgttgactgaagttgaaaatactgaagcagatagtggtcatggcaatatgggctaagatgccgtgtttttaattggaaagacgcttcattcctaagtcagctggggaagagctttggtggtctatttggctgtcatttctgttgttcggattatttgcagggttgtaatccggatattgtcttgtgttcaaaccctcctatactttcatttttgtctagcttgtttagtcgtagtggtttgtctaggattgtctaggtttgtttcagttcattctagggttgcaatccagtttgttttgtttttgttttgttattcgaactgtttcatcgtttgtctaatgcaaatttcgatctgttgttcctcccaatcattttctttgtttagttcttttctaactttttgttttgccttttgccggttctagtgacatgacatgcacgcataattctcagtctgatcttcaaaagtggcgaagcaatgagaccattttgaaaacgataaggacacttgaagaaatgagaacagattggtacattttgagattgtttgacacccgaaccatgtgaaactggggcaagtaaaacataaaaatccccgtaaaagcaagttggccaaattgacagggggtcggtcgtggtaataatagtaagagtgttgtcgaatggcacattatatctgacagatgtagaaggaaaatgtgtggaaatagccgtcaattccgatgcggtcaagagatgatgtgtatggtttctttattctgattgtacttgtttgtatttggcatattttgaagtttgaaatgatgaaagcgttttgttctgctatctaaacactttacccttttgtcaacctctttgagccttatttgttttctttcatacccctctttcggaatcaacaacacaattaaagaaatgcaagtgccggagatacgcaaatggaaaaagaaggaaaaagaaaaggaaagaaaaaaaaggaaaaggaagaaaggaaaaggagaaagaaagaaagaaaggaagaaagggaaagaagaaaaaaaaaggaaagaaaagaaaagaaaagaaaagaaaagaaagagaagaaagaaaaagaaaaatgaagaaaagaaaggaaaaagaaaaaaaagagaaaaaaaatcgcaacaacgtagtttctatgatgtgaactacgtttgacttgatcccgaaagggtacgtaggcagcctctctgaggttcagtcataccaaaacaaaaatccaaaagtccccaagcaagaaactggggcagaaattgtggttgttgtgagaagtcggattccgaaagttgtaaatttaacccattttaaaattgttttgagccttttataccctttctttctaacccatccaaaagcctacattacggtccaaaaaaagaccttctgatcagtctttgagaaatgccaagtcaagcaggtaaggtaattcatgtcaggggaaacactccggtccaaacaaggaaaatgaaaatgagagaatcttattgataaaaatcctcatgggtatcgcaaggtgatgaaagctgagagaaataaaaaaaatgagagagtcttattggtgaaaaccttcacgggcaccttaaggcgacagtaagttgagagaaagaacgaaatgagagaggtttgatggtgaaaaccgtttggggcactacaagccgaataaggaatgtgaatcaaattggataagtggagcaatgaagcccaatttcatggcaaaaaggaacaagagatgaacatcagatttgcttaagagaataggtagcaggtgcatgtcaaggtcattagagtcggtatccacatccgataggtttctactgtgtagttttcttgttaggaatcatctctttctattgtcctttactctgttacttttgttttgtttatttcccctttctgagtcttttggtcgtaacagtgaggaatgacttcaaaattggccaccagctttccaattgcacaaaatggggtcacaagtcaggaaaaataacaagagcactgagctggtaataatccacatagtttgggatctttatgaaacacaaagtttggtagatgtcggttcaggaataatgcaacagatagagggtattgggattgaacggggaaaaagggtatttcagtgacacagatgacggggaaagtggttaatcagtaaacatgcaagacattcaagaggaatcagttgtcgcagaaaacatatggggtcagataagaagactagaagtaataattgagagatagtcgtcaagaagggcgaaagttattagccaagtttcaaagatggtgagacaacgcaaagcatggaaaggagaaaaggaaagccatcccagcgggagtaccacaaccaaccaccgcacttttaaactgacagaattttctttgatttgaaacaggggcatggaaatgttattgatggcataaagatatgctacaggaggattatcaaactggggcagaaaattttctgtcgtgttgaaatttttttcgggtacccatctgaagaacatgaaggtcaatacaagtgttttaaaaaaaaaagagaaaaagagagggaagtagttttcaggaaagaaacaccagttctaagaaaagtaatttttggaggaatgaaacactagtttttagggaagtggtttttttgaaggaggacaacatcagtttttaggaaagcaattctgaaggaagataattcaagttagtgggtagataaaacaaaatttgaaggaaaatggttaaaagaaatcttagtctgttgaatttctcacctaagataaagaaatcttagtctgttgaatctttcacctaagataaaaatcttagtctgatgaatctttcacctatgataaaggcaaaagttggaaaaacgaaaggaaggcataatttaaagaagaggaaggcagaagtcggaaaaaaaaaggaaggcataatttgggaacaagaaaggaaggcagaatttgaaaagaatagatgttggaatttggaaaattaagaaagtcgacatcacacaaaaacggacctagtctgatgaattatctcctagagtcaaaatctcagtccgatgaatcttcctcctgagatcgcacaaaaatggacctagtctgatgaattatctcctagagtcacaatcttagtctgttgaatctttctcctaagatgaaaatcttagtctgatgaatttttcacctaagataaagataaaaatcttagtctgatgaatttttcacctaagataaattttaaattttaagatacatttcagtctttaaatttttaaaagttgcattttagtcttatcacaattcaagttttagttcttattagtatgtggtaacaaacacccagttttccaaactggggcagaaagtcttctttgttgtgtttgttttgtgaagtcaggagcccgcctggataacaggggaatacatttgaagtttgaagtcaggagcccgcctggagaacagaggaatacagttcaagttttgaagtcaggagcccgcctggagaacagaggcatacatttccaattttgaagtcaggagcccgcctggagaacagaggcatataatttcaagattcagaaaatcaggagcccgcctggagaacagaggcatacaatttcaagattcagaaaattaggagcccgcctgaagaacagaggaatactttcaagcgcaacagtcaggagcccgcctggagaacagaggcatacatttccaattttgaagtcaggagcccgcctgtagaacagaggcatacaatttcaagattcagaaaatcatgagctcgcctagagaacagagacattcaatttcaaattcagcaatcaggagcccgcctgaagaacagaggtggtacaattcaaattttagttttcaatcgactttttgtctttttgaagtcaggagcccgcctgaagaacagaggcatacaattcaagtttcagaagtcaggagcctgcctgtataacagaggtatttcaagtcaagttttaatcaaattcttattaatatcaagtaacatgtacccagtttccaaactggggcagaaagttttcttggttcgtttatttttatgaagttaggagcccgcctggataacagaggaatacattcagttcaagttcagtagtcaggagcccgcctgaataacagagggatacattcaatttcaagtttcggaagtcaagagtccgcctggagaatagagacatacaattcaagtttcagcaatcaggagcccgcctgaagaacagaagtgatacaattcaaatttttagttctcaattgatttctttgtctttttgaagtcaggaacccgcctgaagaacagaggcatacaattcaagtttcggaagtcaggagcccacctgaagaacagaggcatacaattcaagtttcggaagtcaggagcccgcctgaagaacagaggcatacaattcaagtttcggaagtcaggagcccgcctgtataacagaggtatttcaagtcaagttttaatcaaattcttattaatatccagtaacatgtacccagtttccaaattggggcagaaagttttctttgttttgtctatttttatgaagtcaggagcccacctggataacagaggaatacattcaaattcaaaattcagaagtcaggagcccgactgaagaacagaggaatcattcaagtttagcagtttgaagaagggaaaacatctcagtttgcaattcaaaatggaaacaatggatttcacctggggagcaagggaagacaactcaagtttcaagagaaaatggttcaaggtgccgagcaggtttgacctcgaggcacacgattcgagatggcagaaagaatgagtctcaatccaaaacaaaggaaagaagaaaaagaaaaaaaaagtgagctctaaagttcagaagcaggaaaatatgtgaactggtcaagacatggccgaggtcacaagcactacatgtccggtcctgacccaaaagcagtagaagaaggagctagcacctgcagctaacaagtgtcaaggttcaaatctaaagtctacataaagaaccattcaagactcaagatcaagcttcagaagacttatagataggaatcttgtaactcgtagtcgataggcttagctagtctttttcatcttttgatttttgatgtaataacagggaccgcagaccggaacctcgacgaaacggcacctcgaccggatctctacctcagcatacgctgtcatctcactcatctctgaactacacgtgacctgattttatagccaaggatatgtaggcagctcaaatgccagagctcggtcacatcccccttttctcttagtcttagtctctccaaataagggtcgggtcaaaaacctgtctagtcagtctttgtctgaaaactctgtacgtttccagtcaaagaggggcagctgtagacatgtgatttttgaccctccccaagatcttttatatattagcgtaaaatatttaatttaggcataatatagatattttaagtaattttgactcttttactttattttagtacaagaaaacaaaaattacaaaaaataagttcattaatattttgtagtcatttttaatctaaaaaagaatatataaaaatagtatcgtatttttatttttaatataatgtttgaaaatacaaaaaatagatttggtttaatggttagttttgttttaataattattttaatagtaggactaattaataaatgtgcgcgtatttttaatctcattcgcggcaaaagaatagagcttgggctagagcaacccatctttaggcctaattttggacctagcccacaattgccaagcccataattcctaggcccataccccttaacataaaaccctaccactaacctagacctatatatattaaacaaagcctaaaactaaggggggggggggggggggctaaaggaaaagcagcaaagctgcgcatgaagaagaaagcttattcgtttaagaagctattatgagcagcagctagaacgagttgcgcaacacaaacgacctccccccgaccatcatcttcttcacgacccaccatccctgcgtcgtcttcttcacgacccaccacccttgcgtcgtcttcttcgagcacacggcccccaccccctccacgtctccgtcttctccaaacgcacctcactgtcgttctcttcttcttcagtaacaaccagcatccagcagctccatcgacgaccactgttcagctcaccatcgtcgccggacctcttcacgtccaccaacgaccatcctcacgcaagcctgaaccaaacagccatcactacctttttccttcagctataacacacccaaactaccccagccagcaactactctcatgcctccaaactccatggaagcagctgaatagagctccaaaatgagctgacaactcccagtaaactcgcttgtaaaccactccgaaggagcctcgaaaaacagtccaaaatccggccaggaatcagaaataaaggagcgtctcgtttcttgcccagattcgccgaaaaatgcgcctagttcatctcaatattgtttcgttcaaaatccaacagagtccgtttggttttccatctgagttcctattttttcgttgaggtcggcaatttgtcgaggtactgtcgttggttttcggtttgagttctgtctagaggtcgtcggattcatctcttttatttcccatgtatggttagtttctattttattgtgtcattgataataatactacattggttggtcaatatttgtcaccggagaaactccgtcgctaaggtttaaattttgttctttgggtgtcttcttggagcttttatatgaggtttcatatcatatgatttggttttgttgttgtaaatatgtggtgttcgatgttagcggctaggaaggacaataatatgacgtgtttgatttgtttaaagatgtgttaattctgtttgaagttgaataagcttttcataggagatgacagtccatttgagggctaccttgggaatttattgtacttttactcttttatggtttctagtcttctttggattgtaacagtgtggtgctactagttttttttctttttcttttttttggtataaataacgtactattttaaaaatgtatttggataggtttaaaagtttcatcttaaaaaaatagtaaatatagctttgggtttgggcagggtcgtatttggtattgctttattattttgatcgttacttttgggcatgctcttaatacatctatcgtgattgtgtacacgctcgcgtgacataattacgattctaaatcaattcggaatatgcgtttcgcaacatcgagcaagctttcttaaattgttttaataggccgaagtgcgccatgtcgaataaaattccaaaactcatggccctcatttatttatttactttaaatccttagaaatcgaggtatgccatttagttgaaattccatggccctcgcaaagtgcaaacgcgtagttgctttaaacgcgctcttaatagaattaccttcctaaactcgggtgcgcattgatgcgacccaaatccaaatctcgatgaagttgaaatgtgttcacaatcacgggcgcattgattgtgacggggttcgaaacgcggttttacgacatcgtaattcttataaaataaataatgatagaaaagaggttcacaaattgagacgagcctcaccacacaaaaatgaataaatgtggggccctcaataaatggttattaaaaatgattagaatttgggatgaccatttagcgaacttcacggtcttgcccaaaataatattacgttagaatctttaggcgcgattttaattaaattaccttcttaaactcgggtgcgcatcgatgcgacccaaatccaaatctcgacgaagtagaaatgtgttgacaaccacgggtgaattgattgcgacgtggttcgaaacgcattttcacgacgttgcaatttttttaaaaaaataattataataaaaacggttcaaaattaaattaaagtcacataagctagcatgtattaaaattagataaaatcaaatacaacagttaagcgaccgtgctagaaccacggaaccggaaaatgcctaacaccttctcccaggttaacagaattccttacccggatttctggttcgcggactgttaacagggtcatatttttcctcggttcgaagattcaaccggtgaattgggacaccattaatctcccaagtggcgactctgaataattaataattaaatcccgttccgattgtcttttaaatggaaaaactcctttacgcctttgcgggtgtagtgaaaaaaggaggtttgacacccttgactgtcgatctcgaactgcttatgtccttctcgggagcttcgtattattcttccattgagtcttggacttccgtcctctgctggggattcttgttgtttcctgctagggatttcggctgtattcctctgctttactgacttgaaatgtattcctctgttatatgggcgggctcccaacttccaaacttgaaatttgaatcgccattctgttcttcagaggggatcctgaccgctacaaaatagacaaaacaaaggaaactttctgccccagtttgcactaggaagatttgtgaattgttagcaatattgtaaaccacttatactatatgcgatggtgagagtaaactaacgactaagccaggatgtgcatctcctatgagtaaaacccgaaactctaacaagcaaatgcgtttgctaaaaataaaacctgaatgaaccaaactaggaagtgtgtctcctacgagtaaaacttgtatgaaccaaaatcaggaagtgtgtctcctagtggtaaactctcatctttaggaagtgcgtctcctaaagcaaaaatataacccgaaagacccagactaggaagtgcgtctcctaggggtgaaacttcaatgatttaaactaggaagtgtgtctcctacgagtgaacttaaatgaaccagactaggaagtgcgtctcctaggaggaaatctcaatttaggaagtgcgtctcctaaagcaaaaaatataacttgaacgacccagactatgaaatgcgtttcctaggggtgaaacttcaatgattcaaactaggaagtgtgtctcctataaatgaacttaaatgaaccagactaggaagtgcgtctcctaaagcagaaatataacctgaacgacccagactacgaagtgcgtctcctaggggtgaaacttcaatgattcaaactaagaagtgtgtctcctatgcatgaaatcttaatttagacaatgtgtctcatatgcctgaaaataaacttaggaagtgcgtctcctaggggtaaaaataaacttaggaagtgcgtctcctatgggtaaaactttaatgattttaaactaggaagtgcatctcctattaatgaaatcttaatttaggaagtgcgtctcctatacatgaaatcttaatttaggaagtgcgtctcctatgcatgaaattaaacttaggaagtgcgtctcctaggggtaaaaataaacttaggaagtgcatctcctaggggtaaaactttaatgattttaaactaggaagtgcgtctcctattaatgaaatcttaatttaggaagtgcgtctcctatgcatgaaatcttaatttaggaagtgcgtctcctatgcataaaattaaacttaggaagtgcgtctcctaggggtaaaaataaacttaggaagtgcatctcctaggggtaaaactttaatgattttaaactaggaagtgtgtctcctattaatgaaatcttaatttaggaagtgcgtctcctatgcatgaaatcttaatttaggaagtgcgtctcctatgcatgaaattaaacttaggaagtgtgtctcctaggggtaaaaataaacttaggaagtgcgtctcccaggggtaaaactttaatgattttaaaccaggaagtgcgtctcctatgaatgaaatcttaatttaggaaatgcatctcctatgcatgaagataaacttaggaagtgcatctcctatggtaaaaataaacttagcaagtgcgtctcctatgggtaaaactttaatgattttaaattaggaagtgcgtctcctataaatgaaatcttaatttaggaagtgcatctcctatgggtaaaaacaaacttaggaagtgcgtctcctaggggtaaaactttaatgattttaaactaggaagtgcgtctcctattaatgaaatcttaatttaggaagtgcgtctcctatacatgaaatcttaatttaggaagtgcgtctcatatgcatgaaattaaacttaggaagtgcgtctcctaggggtaaaaataaacttaggaagtgcgtctcctaggggtaaaaataaacttaggaagtgcgtctcctatgggtgaaactttaatgattttaaactaggaagtgcgtctcctatgaatgaaatcttaatttagaaagtgcgtctcctatgcgtgaaccatttccttcttcctgaattaccttcttacagaactgctttccttaaaaacttgtgttgtcttccctcgaaactgctggggataacactgctggggaattatttacttacctgtcgggggataatactactggggaaatctcctttattccccttttttccaaaactacttccttcaaaacttttctctctcaacattgctggggataaaatgttatcagctggggataacgcagtcaaggataacactattgaggaattttgattccttcaaaactagtgcttcattcttctgtaggttgctgggaatgacactggccttttgttttttctgagcacaagtttcatcctttcgttctgtccgttggggaacaacttccttcattaaaacttgttatactgggggtaactctggttcaaagaccacttcccttgagactggtactatctttattcttccccaaatgggtacctgacttccagaaaattttctaaatgaaaggaaaattttctgccctagtttggtaatctctcttgtggcatgcatttccgtcatcaatgccatttcctttacctgtttcaaatcaaacaaaatttgttagtttaaaacttggtggttggttgcgatactcctctggggatggcttttccctttctccttccctgctctacgttccattacactatcaaaacttgattgggatgatattatttgctggggatgatattcctgctggtcttagaacgacttgccctgctttgcgtcgttcggctatcttgaaacttgggtgataacatccgaccttattgtcaattccttattcaccaacctctcaacgttgttttccatctgaccatgtatcttttccatgatagttgattccccttgaggattttgcaatgttttgctgataaaccacattcttttttctgctggggatatccctcttcttttgtggcatcgctcggaaactggcatttccacgaccttttagtctcatatgaatttctcaaatcatgcccattgctcttcgcgttgttctttcttgatttgtccgcgggctttggccttgaggtttataacctttgatttcggcggggatatccctcttgacactcgttcatccttttgtcaatcatcttttgctggggatatctttcttgacactggtctcgcgcttgttccttcctgacttagaccatttggatgttctaatcggatcgggtcttgcataattggaaagctgatggcagattttgaagtcatttctcacttgttctgaccaaacagactctactgggaaattttctatgaaaggaaaaagataaacaaaaaaggaaccgaataaaagacaaaggaaaaagatgtctctttaacaagagaaactataaataaaaacctatcaaacgcagataccgactctaatggtcatgacatgcacatgtggcctatcctctgtcgtcaatcgtctttcaagatcttcatttggagattccccatttgattctcaatcttattcgacttgtagtgcccgaagggttttcactatcaagcctctctcattttggtttttctcttagttttcatcgccttatggtgcccgcgaagatcttcaccgataagactctctcatttgtattactttctagctggggattgtggtgttacccataagactctctttttatttcttttctattgtggattaaagatctttctgctatgtatcagagtgttatgttcaccggtaagactctcatttgtctgacttgacatcctttgaagagtgatcagaaggtctttctttggaccgtaatgtgggattttggataggctagaaagaaagggttttaaaggctcaaaaacaaatcaatttggggttcaaaattacaaccttcggaaccatatttgtttacaacaagcgcaaatcttgccccagtttcttgcttggggattttttaattttttgttacactatgaccgagccgtgaggcgcctacgtatcctctttaaggaatcaggtcgaacgtagttcacaattcctctgtctttttcatttacctattattttcttttcttttctttctttttctcatttctcctttctcttttgtcgttttgttgttttttttcttttttttttcttttcttttctttttgtttaccttccatgcttgtgttttctagtcgttgctactggttctgaacgaggggtacgaaagaaaaaacaataaggctaaaaagggttaacgaaggataaagtgtttagatagcagaataaaatgcctttgtcgttccaatcttcaaaacatgccaggtgcaaacaacacaattaaacaaagatttgtagcctcttctgatggtgctggacttgacaattatattcacacatttgctttttcatttgtcatatctaaagcaccgttaggcaacactctcactctcgaccctcatgtcaatttggcgaatcctgcctttaacggttttctttatgttttacttgccccagttccacatgactcgatctccgaataatctcaaaccgtccttatttcttctaaatgttctgatcacctctcaatggttttatgattaccttttaaggttaggcccaaaatgtgtgcgcatgtcatgtcactagaatcgacgctaaacaaaatagtaaaagaactaaacaaaaagatgattggaattaataaaagaccggattttgcattagactaatggtgaaatggtttgaataacaaaacaaacaaaacaactggggtacaattttggaccaaacctaaaacaaatcctagacaacactaaacaaaccactatgacaaaaatggaatgataagagggtttgacacaagacaatgtccggattacaaccctgcaaataactcggacaacagaaatgacaacaaaataaaccaccaagactcctctccagctaaccaagagatgaagcgtctttccgattaccaagcacgacatcttaatcactaggttccctatcgatattgccaaaaccattaacaacttcaatatcgttaacttcagtccgcaaattcccaagaggattcacatgctccttgtcactgtcattgatcataattaccccttcttgaatcattctttctacttcccttttcaaagaacgacaatcttcaatgctatgcccttggacattagagtggtacatgcaacgtacagtaggatcaaaaccttttgcatatgggtctggagtatagccgaggagtggctcaatcaggccggaatgctttaacttttcaaacaagcttgggtaggactccccaatcggcgtgaaactatttctttgcctttgttcccctccctgcccctgttttcttgggtcgttgggtgctcgaaaacgttgtgaaggcaagaatgaattacgtagtgctggcgctcgccatagggggtgacctgatggttggacatgtgaccggacattgttcggaggatgatactgaggtggattatgtggagctcgggggcaggtttgggcataatgggcggaaaaaagtggctctgatggtgggtagtagggttgtggaaggttgtatggagtgtgtggataatttgggtgatggggtttgggatggtagtgaggggaaggacctctggatttggaccaagtacctgcttcaaccgttgcgaccttctctctcttctttccgagtgcacctcccgcgccgctctggatggcctgagtggttgctttaatcgccgaatagctcaggattttgttggatctgcgtccctcttcgataataccgcccatttttactacttcgttgaaagatttaccaactgacgtcaccaggtgaccaaagtaagtgggctccaaagtttgtaagaagtagtccaccatttcaccttccctcattggtgggtcgactcttgctgcttgttccctctaacggaatccgaattccctgaagctctctccaggctttttctcaagttttaacagtgtgagacggtccgggacgatctcaaggttatactggaagtgacccgcaaatgcttgtgctagatcgtcccaggtataccacctactaggatcttgtcttgtataccactccagtgccgacccgctcaaaactctggccaaagtaagttattagtagctcatctttgcctctcactcccctcatcttgctacaaagccccgtatatgtgccataggatcgccatgcccatcgtataaatcgaacttgggcatcttgaaccctgctggtaattggacgtcagggaaagggcatagatcattgtaagccacgctgacctggttgcctaacctgtgcatgttcctgaaggactgctccagatttttaaatctccgcatcacctcatcctgctctgggctcttagccggcttttcaatctccgccgggacctcaaagtagggattataggtatgtggctcgggtgctttgaatgtgagttcagtgggataatattgcgcattgtgagcttgaaacaatggctcactagacgatctgtgcaatgaagctggggaaggcgccacaaagacgggaacatttggtggaggaggattctgattgggtggtggagcttggggatcataggtctctcctccctgatagtagtgatggcttgggaaactcgttgaagggccggtggaggggtattccggcgtgtgtcctggtaggagagtaggagtaacgggtagttcataccccttttgggctctagctaaggctatctgcatttcattcatttccagcctcatcttttccattttttccatggcctccttcaacatctgatttgtcgtcttttctgactcaacactgttgtccgagccagtcatgctttctggtatggaccattttgatcttgtttgataatggtacggtgtcagtacgctttaacaaactaactggtatagattggaaaaacaacaaactcgtcagtgttagagtcttaatagatattgtaattgcacgttgggggatgcaatgttcttaggcagttaaccatttctaatatgcttttgctctgaccgcatgcatcatcccggcttattttatttgtgcctctttcgagtgttttagagacctctcttttcttcttctctctatcttttttttagtgatggtcgaatcttatgtggattgcctacgtatcatgtccccccatgaatcagaccgagcgtagttctgccaataaaagataaataataataaaacatttttttgcaattttcataataaaacaaacttgattataaaagtttaaaaactgaccatactaacagactttgacaaaagacaacaaacggactagaaaatcaaataactcgcacactctaatcaaagaattacaaactcaaaaacaaacagccagattccttcccctatatgccaattttaaccaaatggttatttttcagacgtggccccttatcaatttcacatgaattttaaggccgggaaggactattttacgacctttcacaaacttgttcgttcttttacgaaaatagcccttcgacgactgaaagatactctaaggctatctcggcaggaacggtttaagacatcaccgaagccgggccggcttattttaactaaaaaccaaacggtattcacttgaccactaactattttcttgttttttcaaataataaaagacctggttttgcaaacacaatctttcagcacttcggagatgaagattttaagattgtgcgggataactggtagcaacccaaaagaatgaccaaagatggtcgtttatgcaaaatcagccttccggcgtccctttcgagaacattcggctatttttgacaaaacggcgtgacccaacttatttatgactcttttcttgtttttttttcaaattagaataaaagacccggtattgcaaacacggcctttcagcgcctctgggacgaagattttaaggctgcgagggtcaaaaatcaaaacataaccaaaggtggttgtttatgcaaaatcagcctttcggcgtccctttcgggaacatttggctatgttttgacaaaacagcgacacccgacttctttatgatgaaattaaaatttgacatattttttggctattttagcaaaaggggaggttggacccgattagggctgcctacgtatctcacatccggtgagaatcaaactagcgtagttcgcccagataaactaactaaacatattttttcctttttcttttatagcaaaagaaactatttttcctttccgtttttttatttttttaaaaacaaagcaaactaaaataaaggactatttcatacacactttctgctttttgggtaaacaaattatttttaaaagtaaaatatatttttttcgtcagagttctgacagtacttggacactggtttttttctaaattaatcatctaactctctacttgctatttttctctttttctcaatttttttccaaaattttctaacattcccctagattcagaagccggtcaacatgcggtttcaaaataaataaatgcacaaagcgtaagtaggatgcatcaggatggtcttttctgtttcaggttgctattcctagacggacccagcccctgtgttgagtcccccaagtcaaaaatgcacatgatgcagataagcgttcctactagggatccggtatgaagatgagttattctaggttcagaacctgggtgtttgttttagacgtggcttacccgagcggacagctcgagcctagggggcagcgtaccgggaatacagaagctcaacccggctttgcaacttatccgaacctcgttctaaaaatgggattgactctaaacagaaaagaagtcacacgaagtgcacccttcttcatgatttagaagactcagagaggatatgggttttggcacagtttatatacagttcacaaaatatcaaagcggtaaaagcagttagttagcacattaagcacagatcatgtaacaaaatcaaataaagctaaacacaacaatttattctaagcttgatttctaccctgaaccagtggttctgggttcatatccccagcagagtcgccagagctgtcacacctcctttttacccgcgccgcaagggcgtagagggagttttttcaattaaaggataatcaaaacgggatttgtttatttatttcagagtcgccacttgggagatttaggatgtcccaagtcaccaatttaatctcaaatcgaggaaaagaatgactctgtaatacagtccgcgaacaagaaatccggataaggaattctgttaacccgggagaaggtgttaggcattcccgagttccgtggttctagcacggtcgctcaactgtcatattcggcttgtttatctgattttatacaattatgagctcatgtgcaagttttaactctttaccgtttttattattatattttaaaaaagaatgtgaacatcgtttaaaaaatatgtctttggattgtgtcacatgaaatgcacccgcaattcggaacacatttttattcagtgttttgggatttggatttgggtcgcatgaaatgcacacccgagtttaagaaggtaagattattaaaatgcgcgcctaaagcgattagcgtattattattttgggtaaggccgtggagttcgctaagcggccgatcccgagttctaagtaattaatacatacatttgtgagggccccgcaatctatatgttttactaggcgaggctcatctcatttttttttatagacaatcctaaaatgactacatttttctattaaaattagtttctaaaataaagaaagaaaatcctaattaattaggagctttcaaaaaaattaagaaaacgtaacatactaattgctagattaagacaaatattaatggaaaggaactttactaaaaataaagaaaaaaagcgaattcgaaatcataaataaaataagaaattcgacaactaatattcaaaagaaatcaaatatagctagattgaagctcgcattgttatataaaaaaaactattggaattaattattcacaaccatttgaaactagatttaaccataattactaaagcttattagaaagtttattaaacttaaacattatctagtcttgtttggccttaactaaatttagctacccattcatgattaacctactgttgaccatattaaaaccttcatagctaatgaattaacccgttttgccaagctgattcactaaagaccaatttatgtcattttcctcttattccaattattaaacagtaatacatgaaatagcctaaatacaatcagtaaaagaaacgaagaaaaagcgaaattaaaatttcaaagttccattcttcatatgtattcatgctttcacattttccgcttacaatatcgacaaggttacagccatgtacctggtattgaatacaagagaagaggaagatgagaatcggcagcagtattaacaatacaacacagcaacaacagtccagcaacacaggaatagaccagtaacagagtttgcaaaccggtggagtagtaacccaagaaagaagcttcaagcttcaatgaaacaatagcaattaatgctgatttcaaacaatgaaggaaagtagaagattttttttcagttttgttctctcccccctttgttcttcttcctttttcttcaagtgtcaaatgagtccttttatacccaaagcaagactaccttttcttttttacctcttttctttttccccaatattcttctactatgtataacttttaactttttattattacctatactatttctgatttttaacttaagtaaaagtagtcaacacggaccccacggttcccctctttttgaatggtcaaagaagacctcatcattatccccttttctttttactttacatcattatgtcttgtcccctactatattaaacaattatatcaacccaccactacctcatgtcttgtcccccaccaggtactattttaattttgttaatgcctagtggacagagcactcagattaaataattgttcaaatttacaattccaaaatacccctccaaccttactgaaattaccattttacccctgaaagtactacaatttaccaatctacccccatcagttataaccaattcacctaatcaattccaaccaaaatacaacaaatataaccaattcctaaacaaattcaatcaacaaatcccatgaacacagattgaatcatacaacatcagattaatgggaataagttaaccatattgggaaccaatcctggttaacttagacaaaaaatgaatgatcaatgagacaacaatattagcaacaaaagtaaactgaaacaacatgaatcacaattaactgaatcgaaatgcaaactgaaatcatatgatgaataacaaagagcaggaaaccaaacaatacacaaaacaaaattatccgaaccaactcaatattaacaaagatactatacattctacaactaataatcacgaatgacaaaccaatcgaactcaaattcgactaaacagaattcaaagaaattttttacaaccaagattcaactaagaacgattcaaactccttaaaccataatatttaaacagattttagcggctcttatcttactcacatatagatcataaaatgagaaagggagatgagacggaccttaaaaacctttaacaatccggacctcgactgcgtatgaactgtttcgacgaccccgaccaaagctcgaacaaacgagatggtggggtctcgttttggactgaaggcgatgaaaaaaggtgaagcagtagcgatgggaattggttttgaatcagatgctcgatgaggcagcagcaacgcagcagaagcagatgctggacggagctaaggcagcagcaacacatcaggtgcaacttggttttgaagcagacgaggcagtcgtgggaggtgagacgtttgggtctgctggaggtcgacgagctgttcgtcgtcgacggctggatgtagcaggagcagcagtggcgatggagcagtggcagcagggttgggtggtgctacatggtacaagggtgagagacggtgaaggtgacaaatagcttcctcatgcttttgttctgaggctgctaggttttggttttaagttgtctaggtttgttttgtgaagaagatgaggagctggtgggtcaactggttaatgtcgcgaaagtttaggggtgttcttttaggttgagatgaaagagcagcagaggctgtttggcttaggagatagacgatggtggtttgtgtgttcgagctggaggtcgtgaggatgatgaagaaaatgaagcagaggggtcgttcatggtggtcgacgaagaagatgaagcagaaggcgaggtgctagggtgctgttcgtcgagggaggcagccatgggagctcgagctcgagctcgacgacgaagaagaaagtagcctgcttggcttttggtttggagttgtgtgtgtgtgtgcttgtgtcgaagaagacgatgcaagggcagccatggatgggggcgtgagaaagcttggagaagatggagagaaagggagggggcagatgggtttaggtttagggttttttttgtaaaaaaaaatgaaaatgaagtgaagataggaggttgggtcatttggggttatggggcggacctggtcgggtcgattcggtgggtctttgggttggataaggggttatttagtttgggtagaggtgttttgggcctaggttcaaaattgaggaagagacccaattccgatttttctttattttttgctctcttttcttttacttctaattaataaaactaaaattctaaattaagttataaactaaattaacttatcaaaaatactaactaatttctagcaacatttatcacacataattaaacactcattaaaacaaaattgcacaatttgacattgaatgctaaaaatgcaaacgacgcatatttttgtaattttcattcttgtaaaacaaacttaattactcctaattgtagaattaaatcctaaatgcaaatgcgacatatttttgtatttttattaattttaacaaataaacatgcatggacaaaatacaaataattaccctaaaatgccgcgaaaattctcaaaattgcacacaaaggaaaatcgttttattttgaattttttgggagtaattctttcatagggcaaaaatcatgtgcttacaaatccgtgattcagttttgagtttgatgacacccctttatgtaaacttataaattttcatgtgaacctgaccggtgaattttatatccgtcacatgaaatagtttaagtgggattgtaaaggatttagttagtagattaaattaaattatcagtgatttaatttaattaactagtatttgtaatcttaacatagggagttaaaataagtgttaatgattttcgaaattcatattgaggagttcaattgcagtttttagtagcacaaaatgcgattaattatagtaagatttaattcttccgaatttcgaattaatactatatttggtagcctcttattatttttgtagtccctgctatacctagtaaaaaccttaacacacttggataaaatgtgacttgggagaaaagttatccttttggagttagagtaggattttacttgcactagtagaatcctacatgtttttgagccttttttgggcttaatttcgggtctacgaaaggaagaccagtttcacccaataactcactcttcggagttgtattatttgcccacacaaataatttcgtctgaggtcttacaaggagcatagcagaagactgcattcctggattcttgctttgtggaggacttgtgcaacgtttttgagaggttagtgtttctaatctctgtaattatatcattgtctagtttacatgtttgtgatacctgaattatatgcttgctttcgctgcgcatgtgctaacaagtacaaggagagcgaaaagatgaaaaatattttttaatataagcaaaaaaaaaaaacaagttaatttaaagtattgaaaaaaattgttgatgcacgggttcgtactattttattaattagatggagaaattatctaaagaagtgatgttgcatcttaatatttgcaagggatggtcaaggatatgtgatcgattgagttacaagcttgtttggatggttgttagctattgtatcgtatcgtattgttactttaaatacaatgtttgttttgattgttacttaaattttattgtatcgcatcgtatcgtatcgttaaatccgcctttacgtaacgatgaaatgtgccactttatgtaatgaccgatttggtgtgatcgcgtcgtttccttgtgtttttctctcaatctcaccctttattattattaaataattttattttatcatttatcctacctttttatatactgtatcataatttttctttataatattgcaagtttattcatcatattactggtgcgtgataccatgaaatgacggcaaaatcacacaatccaatccatacaatacaatacgatacgatacattatgaaacgatatgtaacaaccatccaaacaagctgttaaaagaatactgaaacatcgcattgtttaaattgattatttaattaaaaacaaaagagtaatcaacaatattatactttttttaatatacattgaacaaaatcctaatgtggctgtaactttagtctttaggggtattaacaagtgatattgaaaccttgcataatacttctttatttatttagttattcgatatgtgaggtgagattttcaaatgctaagtccctgaaattcattactaatatttttaatataatatattatgtatatcattatatctatattatattaaaagcacgaaggcccttaacaaaatatcgtttgccttttttaccctttaaaaatagagttcatactggacaagatagtcatttgagtattttaatgatatttatgactttaaaatcaaatcaaatttttcctaaatttttggacttaaaaacaattaagattttatactatataaagtttccttacttaacataactctaacctaatacgttttctttgcttgatttattattgaatcttaataaaatcctactttaggttagaaaaccatcaataaaagaatcctaagaatgaacgaaaagttgagttctgccacaactcacaaatctattgcttatcagattagactctcaattatgttgctttaccgactttaaccgggtctgattctccgcttaatatcaaactaacttgggatatttaacgttttagtttataaatttgattatgcattgtttgttgcgattcatgtggggtttcaaggatttatgttacctattggtatacctcatggttttagtggatctatgtttctataattttcttatgtttctatattcttgagagctcaatggcgctttgtgtgtcattgctttgaaagaaaaatgcattagtatgtttcttacttgcgtacaactttagttggtagttggtactactttaatgctagggatatgtagttatgcaccactcttagtttttgataatttttatatccatagattgtatgttagtacattcagtcatgtcactctaacgacacttcatgtagaatcataattccaatatatgcattaagtgagtgttaatttgtactaaggaaaagaaacgaaactgaaaatcattcaaccttaattctactcacatagaaaaagttatcctagatctctaagtacaaagatttaaaaattaagaagaactcatattgataatcattatgcaagacgcaatcccaaaaatattactgcaagagttttaacttatattgtaagtgtaatattcatctttaagttttatagcaaattatagatcttactttttttatgaatgattatttgtagatttttgttggatgacctaatagtataaatatattttctaaactattggtatattcaagttatactcgtgttcaactaaaattcttttatctccaatttagttctatgttattgctgtttttttttttagaaatttgtgattcctttccgacatgcttctgatcaactttattagttgaatattatctatttgatgctttcttacattgtttgttagagaaaatatataacagagatgaaataaataagagccattcctaatgtgcgaaatagcttttaagatctcattcattgttcgtctaataactactagcattaaatcaggctaatgctgctagaagtatattttatacgtgaaagattaataatctctcaaatttcatattgatgtgtttattcgcttatcctcatgtttattattcgagctaattgataattttttggcaactctttttgataaaacgcaaaattttttaaggtatattaaaaatgtggccatgataaaataatgtaaatgttgttgtcatgataaaataatgtaaatgttgttgttatgataaaatacgtaaacaatagaaaggaaaggaaccagtaaactaaattaatctattggtcatgtgttgttcacaagcaatttgagttgaagtgctaggtcggtattacattgatgtttcacaccatgttctattttcaacggtaattgatcacatacttaattaaattatttttctcaaataaatggtcttagaatgtatgtggtgtgaatttatttcgttatataagtttcataattgtaacatcgatttattttgttaatattatctaatgataatatttgaattcaatataaagtctacttgattatggtaagccttacggtcttaccgtaatcatacgaacatatttagctttttgttgagctaaaacatacttggttcgttataactaaagttaaagtctacatattagaacaattttataaaagctaatcttagttaattttaaagtcttgcatattaggattttatgtatagttaaaataaggaaagatctaataaaaagattatagttgacataaaaatttaaatactaaaaaaatagttaaatgataattttgtccagtataaaatatatttttaacaggtaaaaaaatttgtcagtatcttaattttgggcgttcggtaaaaaaataagaaagatttgtcagttagttgatcctattttatatcttctataattaacatatgaatatatagtttttcaaaaaaaaatcttaatcttcaaggatatgtgtactaataataaaaaggagcatgataaccttagaaattaagtaataaaattataaaactaaaataaattttaagttaaatatattgattaatacaattgatcgacttatgcagggataaatttcttacattattgagttacctaaatatgatcaacaatcatcatttttaaaaatttaaattttttcgttaacttctaccttatacatatctcagacacaaattttaaatataacatttatgtgatattttaaaattttaacttattaagataatgtacacgcacaaatataacatttatttttttaattatttctttcatttatacattaaataactcaaagaatcaccgtagaaatacatgtgcaacgcatactagtattagaaaaaaggtgggatcacaacgtcataacacaatctattgtgaatgggaaagtaataacgagtaactctaagagcggaggcccaaattcgcaaattctatcccgttttcaaagccgctgcaactctcaaaactttggcgaaaggatggtgaaaccacttgccgattcgcgcagcaacagagccgccgttcaggccaccaacgacgacgcttccgccagcaaactgtacgtacgcctttttattcaactgtacagtaactcttcaattttcttcagttaatttcctagatgtaatttagagatatacagttgtataatagaatgcttcagagaccatctatgaatatatcattttcactgcaaattattggaaattgagctgaaatttaaacctaattatcctcaaattccgtcttatatgattactgttttttatattttgtgtgatgtgaaggtcatgcgtgaaaaagggatacatgaaagatgattatgtcaatctgtttgttaaaaaacccctgaggcgatctcccattattaatcgtggtatgatatctctttttttgcttcttaatccatggtggtgatgtgcttagtgtttattttttggggttgtttaatagatgtgtaacttaattataaggttattttgctcgctgggctgctcttcggaagatgctctatcaatttcttgattgcaacccaaatgctgatggaagtggcaatattaagaagcagatattgtcgcttggagctggcttcgacacaatgttttttcagctgcaggtgcttcagtttctatgggttgttttaatatcttccatgatgattgaaaatttcacataaaggatcccaaggcacattttgtacttttttcacaaaaaaaggattttctttttgtagccaatccaatgccctgattccaactagtttgggagttggaactaaggcaaagctgacagtatgctattgcagttctggagctttagtatggtcttgtttacagtgtctattcatgtatcaattttcctccatcttgatcttggcgacccttaaatgaagttgtcaagagaaaatggaggttaagagcaaaacgatccctcaaatgggttactgtacgtggaaatttgagcatctggttcaggctacctgcaatttttgttgaactaggctgacagtttgtgatagtagaattttgctttatgttaagatttttcttatattgcttgatgctgcttcatgtagttttccaatacaatagatacacgcttgcacgtttactgtaatttccatccttcagaaagaagattaatagctatatttgtctttggcaggatgaaggaaaagcacctcatctttacgtggaactggatttcattgaggtgggattttcaaatgctaagtccccgaattatgtcatagcataaacgaggcaatattttttgcattttggcaaatccattttactttcttggctcaaagagctcagctctagatgtttgtctcacaggtgacaagcaagaaggcagctcttattgaaacctatagtcagttaagggataaagttggtgaaatagcatcaatctcatcaggtaatgagcatgttcaccgcttgcaaatatgcaaatactcttctcttgtgaactgccaacttggtgatccctgcctttcatttatcttgggcaaatatatgatttcatttccttgacaagataccatgttgttgagcgcgaggtggatacatcaagcatttaatctctgtcatctaactttctgaaccatgtcattttttaatacaatatttgttcaattttatcttcttagtataggttgaatcagtatgaaggaaaaacgttagcttttaaagcatcttctgtgacagaagggtgttccttttgtgcaaagcggaatctagcttttattcacgactacacgatgtttctttgataagtcaaaatttctctactaaacaccaagttggatgtcaaaggaatgtacaagtaaattatcattttaactaactcgaatgtggtcatccacggtcatctaacaagtacgccagttatctttattgactttacaacaccgtattttctcgacaccagaaatccaagtgaaatatgatgccttttacatcatatttcacttatttgaagcaattttctactattaatttttcgccataagcacaaaaaaagagacagtggtgatgtttccctcttttcgctgaactctccagcttgttgttgcttcctttacttttcttggtatcactcataatatttgaacaatgaaatacaagggtccacatttgtgaagccaatatgcaatgcaacaaaagatgattagcattgtttttagtttttttttggtcacatgcaatgctggctcctaccttcaccgggtaggaataaggtctgcgtacacactaccctcccctcccagaccccacttgtgggattaactgggtttgttgttgttgttgttgttggctcacaagtcacaagtatcatcattctctttctcaagttatccgctataggatagcatccttttctgaacctactcttcatgtcctctatctgacaactccacataaaaaggtttggttgtaaaatatcttactcggtctccctccatactatcttatttccccactcaccccacccccacttctcctacagaggcatcgtatattttgtgaaatttccttaatgtcatacttataacattcatagacatggatcaccttcttaaaacatatattccatataacgccttgagcattctttctcaaataatcaattacttctgcatctttctcgtttattagaccatatacctgttaatatgtattctccaaggatattcaccgggcatctttccaaaaccttaccctacaaccctcactcacctagtaagcaatacattaaagtgaattttcctgctccttactacacttttacagtgttactccataagatcttgtctagtctctccattgttctaatatctatacttactacttagtagaaattatctgtctacataaaaggtctgctcttgagtgaatccccacaaccgttttctaagagtactatattgaatacggacaatctcctgattcccaatcccctttgcttatggaaaccaatattttcatccataattccattccacttaatgaaatgttttctccccatccattccttcttactgagaatctcacagcattttctccgaccaatttgcgccacttgcgtgcatacaaaccatagacataataagtggtgtattagcgaggtagactttcataatgttattttccctcccttacacagatattttcctattattctcccccgtcttttctcaaatttctcaaccacaggctgctacagattttaatctaattttttcctccgatcggtaaactaaagataccttgtaggtagtgtaatcaattttggtctacagatttgttgtaatctaatgatgttttgtacctcccctactggtaccaactggagtttcaaatatctacacatgatcctggcacaactttaaaccataccaaatttctgaacaagtatcgaatatgtctaatctggggttcacaagaaattaaagtatcttctgcgagtagttgatagatatggttacattatttgtcctatcaccgcctacctcgatacccttgatgacacctcattcccccgccctatgaataagtttgctaagtacctccctcacaagtagagttaacaatagaggcaaatgatccccttgtttaatgatccccttgtttcatgcagaaaagggagaagtccatagtgatcattacaaattgcttcctgtagatttgcgcaacatagacaatttaaatgatgttatagcccgtgcaaatttagaccccaggtttgtcgttgcttcattgctatattttcttaacatttttttctttaatctccacgaatgaagcacaagttatgttgaaggattttaatgtattaggtcttcctttgtcaagctcagtgagttgtgcctaaccgcctctaaatttattgctactataatggtaagtgtaatatgacaagctctgtttacatctatgtcttgactatattacaatcctggtggaacaaaattacttgatgtgaaagatgtggaagtactacaagtaatctaaattgaccagttttagattttttttttgagactggtaacaatatattaaaaaaaagaaggcactaaggcagtgcaaagccatatgtacgtgggggggatgtgaaaactgatccaccagacttacaaaaaacctaacatgacaaccagggactccgtattctttacatgcctttctttacaccaaaaataaaacaaaagaatacaattcatcttaacattctgaagagtattgtatctgtcttcaaaaactcttgagttcctctctgtccacactgtcccccatacacaagcaggtatcagtctccaccatgtcttctgactgactacacctccaatgttattccaggactttagaagctctagagtagttgcaggcattgtccatctgaggcccacaatgttaaggaacaattgccacaatttactagtgataggacaatgcagaaacagatgactgttgatctccagatctctgccacataacaaacatctcgagcataacagaaatccctttctttgtaggctttcttgggttaaacaagcttctcttgctaccagccatgagaaacaaaccaccttaaagggagcttttgctttccatatgttcttccaaggccatcccactgtatgctgatctgcatttgtaagcatgaaataggtggatttgacaatgtataccctgtttttgcaacagtgtcagaataaggtgtcctcattttcattgagccctttgaacccttccaaaaccttaaaaaatagcaattctccccatttcccaatcattcagaccccttctgaaagtgatattccaaccatgctgaccccaagctgcttccattaaaatatcaggcatgtttgcaatactgtaaaattctgggaacatctctttaagtggaccatgcccaagccaattatcattccaaaatagtgtcttcctaccattacccacccttgtgcaagtgttaaccaacacagagctccatagttgtctgatagattccaaacacctaccccataggaactgttaacaggactagtgcaccactgctcagtttgaccacatttctcccttataacctttctccacaaagcattagtgcctgagttgtatctccacacccacttcataagtaaattttggttgtgtgccttgaggtccctgagtcccagacccccctgccttttgctggtgataagtgagctccaatttaccaaatgtatggctctcaattacatcaattcctcctaagtgcatcaattacatcaggtacatcttttgggttataggcgagtacagagcacaaaggcattgtattgattttggggcatcatgagatcttaaccctgtaaaaacagtagagctgacaaaaaagagcaaggttatatagttcttttttttccccaataatggtggtgtccaggccagtttgcacgtgcctcgacgattctgcctggtacctgctacctgctacctcccactaacataggtgccggtaactattgccacataggcttagttagtggcagagaggtgttgtgacttgtgtccaaagaatcatgtctcttagcatgtaaagacttgtaacttgaaagccatgatgagctattaaactaaaaagttgggttactgctaattgtggttgcttatagttaaagattagggactacaccaggaatcttgtagttaatagtcatttgttggacaactgaaaggcatatagggtataggatatttggatacagaacaactttttcctggttgcgcttaacttgattaattggctgttaggttcttttgcagtttacagattctacgctactattcattgtattggttctcattttcttccttcatttctccacttttcaaatttataactgtccttattaaaaagaaacttttagaatttagatctatcttgtctcctttctgattcccatgttctgaaaagacttatcattgtacatgtccaagatcatacctgttaactgcacattctgatgttattatcagtttgccaacatttataatcgcagaatgcgttctgatatatttggatcctgattcgagccgtacaattgttggatgggcttcaagaaccttttccacggcaatatttttcttgtatgaacaggttgttgaagctattaagttaaatcttggattctttcctgagcctgatccatcccttggtcctattaacttgagttctactgctctactttcctaagctactgtgaatgtcctgctgatgtattataatgacttatttgtatataatttggcttattacagatccacccagacgatgcttttggccagcaaatgattcgtaacttggaggtacttttggctgattacttttttgatgattgagcatatctgctccctcaccctaactcgtttttataaactcaacaccaatgttgaccttgaaatagactttattcttcaatgtatgtgtaacaacattataattcctttttcactttccagagccgaggctgtggactactaggaatttatgctacaccaactttacaagagaaagaaaatcttttccttgatcaaggatggcaggtatttccaaagtgcaaatctgcttcttaattttgacattaagaatcaccatacctttctgtcaaaaatttaatatatctaagatgttaatagcctggattaggcctatgacttgttcctccattccaggtgtaggaggcttatttagtttttatacagacttgcagtatttccaaccatttgccttgtcatcccatctcctgtaatcaaggatggtagaagatttaattttcagctgaaactgcctttctgattgagggtcttaaaccttaaacatgatctagaagagaattattgattagcttcattgtaaaccaggaatactatccaatatgataaataaggctaataaatcatctccttaaccactaactatttaggtatagcaggttagataaaagcacatgcattagttgcttcgaacttgcattagttgtaagctcaatcttttccaattactgattaatttgaacagttacatattgctaaatactaacagtggtttagctctagctaattcattaactctatcaaagaacacatgtatttataatcaatggtttgtcttttattgattgcagaaagcagtagcttgggacatgctacgagtttatagtgattttattgaagctcaagaaagacgcaggttagtatgagttttgattgtgcttgtacattaatttataaacatgggaatgatatgaaatgatatgattcatctgaaggtgatgatttggtgctgcaatctagaggcatattactggctttaatgaccatactaagctacccaagatattccaggtttagtcagagccttagaggtctgtaagtctattttaccttcctgtctctcacccacacaaagggggagggggggggggggaggggggagggtcttcacatgcatattgtcagggtaaatgcttaattgttgttgcatgcacaaggctctaggtaacatgtttgggcacttgatctatctatacacagtctggttgttatttggtctcatcgttgtttttgtagaagtttatctttcaatcgtataggtttcttcctattcgcacagtactcttgtagctccccatttcaatatcatattaatttgtttattaactctttgtctatgtctatcatgtcttcatataatttttcaagaaaaaactgcatatagatgcttcaattgtccacaattagataccatagtgccattttatctcacttcagcgtaattcttcttatgggtgcggttgacccccgtgcagttttgtcagttaacacaatgtcatctgcaaatagtaggcatggaaccttatctttcaaggcaaatcctaagtttaaacctattgtcatgggaaactcctctcctatgtatctcctctgattattcacacttgtgttggctccttcgtacatttcttttatatgacgcttagcctggtttaagtctattgtgtgccagtctttctctctcatttttgctagtcatgcatctctttccctctcctgcatccctaactattgatagaagtcatctggggttttacctcaagcttaatagccttttttagcttctagtcgagtcttatgctcttcgaaggtttcactatctcctgcttttggtaatttcctataccactctttttttgctttaataactctttgcacctcctcattccacaatatgattcttctatttgagatctgagacttgtacacatacctaaatcttcacttttatgcaacttgtcatttttccactgaatatatgcatccctgctccctccaattgtttgtccttagtgtcactaccaaattcttgataatgcaactcttctcctcccttgctccactcttttgcttcagatcagtaggagttcttctagtataaccttgtagtttttacatgtaatgatgctttctagaagtatgaactctgttttgctatggttatctcttaccttatgttatcaagtgcgattctctttttctaaagtatgtatcagttaaactactgcataagttaagaaactctaaaatagtcttcactcctaaaacctatctcctgcagttgaagttgtctctgtctaccaacatgtctattcagatcgtcttcagtaaaatatgttggtcatttgggatccttggaccaaagtatccatatttctccgcggaatattggcactaatgatgttgaaagttttctttctccgctgactagacaatccgtcactatttcttatttactcctataactttatccttaggcactggttgtacaacgatcccggttttcattcctgttcttatctatttcatagtaatacattttataacttgtgtcgtaactctagcactttcttgattcacctactctcttgtagacacacctcatctggcctaaaagaaaggaaaaaggtagatttagtacatcatcctttgggacattgtagaggatagaaatcagagatgttttaaggagttcatacttcatagtcctactcaaaatttgaagttcaaatcttagtatctcagtctctggcattttggtgtaggtttgaatttgtaaattatgcagcagatgattagatgaagtacgtagagcgatgcaactacttatatattgtaatttccactttgtcgttcttgattcttcactgataacaagtgattaccttgtcgcaagaaaaaaaattcaatatttgagaaaaataagagacacattctagagaagatcaaatactagagatctgatgctaagattttggtctcatatatgattgtgtgtttattctttttatctgtaacaatcaaaatgctttatttccctatgaaacaaaattgaagttctcttattttttagaaactttttatgctacgaagctactatggttttcatgaaatttattcgtgccttttttaggttctgatatatctttttcccaggataaagctgattccctatttttcttttgccccttttcacttatcttatgttgcgcttggagaactcacaacttttgcagtctcaaatatacttgtatgtgattgtctggacaggattgaaagattggaaatatttgacgaatttgaagagtggtatatgatgcaggtaagtttttatcaccccttctgcatttgactgcaaaaattattcagtgtgtttgcttggaatggtgtgaccttatccataccactgtgaaagtagagcactttgttccagattcgtagatgggttggctatctttcaccttgcaaaacgaatttctggcctgtaaattttgtatctggcatcatattattctacaatctgtaactgctggataattaacctgtaagatgtcattatacaacttggaagttggaaacgatgagaaagtatatccaagttaaaaattacaaaatgcaggcttctttactttggtcaattggcgtattcagacttgccttttcttgaccttatgttttggaggagcaagatgctgctctttcttttattttttacatacgaatttattttagggtccattgatgctttacctatacatgtcagctgttttagtcgaaagacaacctttctgtatgatgttatttgaatgatgatgttagtgatgtagtatctgaatcttcctctgccaatcaaaataagtcattgatgtagtagaaaagaaaaaaatctaagttaggtgtactgtttcttatgtcatgtgctcacatgccttttgatcaggggactttggctgtttaaaagttcttaatctgttacaacaatacatttgcattatgtaacttgggatcttgtaaactattagtgcttaatgtcaacagaatttgggaatgaatacataaaatttgatactcccctcatcatgtagaccctgttagactaagtggaatttaaaaatgaagaagaaaaacaaattgaaatagaatatttcagtatactggattaatttacagaactgctaaagtttcggaaaatggattgtttgatgaaaacgtcttgtaccaaagctaaaggcaatataaagtagtaatatggtggtaacttgaaatctacgatctggcaaactttcagcatctaggagaagaggtgaagtaaattgaaatggacgaaaaagatagtaagacttgaggaagtatttgaaagacccaaaaagaaaaaataccagaggggaaataattacaccaaatggctgcagtttctttaagtgacagccgaggtagatttaatataatcttgcttttgaatcttgtcacatctttcaaatattgcttctactggaaattcaaattagatttactaatgtgtgaaactttatttcggtcaggatgatattcttaagcttcaaatatatccatgatatgactatgtcacccccccccccccaaaaaaaaaaaaaaaaaagatccatgagatgaagatatttatcatgtaagaagaccctacatagtgaaggttgaaaactttatgaagatgatgatcaggtatcagaacctaagagaaaagttgactcatagcaataagtggtacgtttctcaagcattgatgtgtgatacagttcacattaacaaagtacgcaaagtttaatttgtggtccaaattgctagtccatcctttgccagtttatgctcgaaggggaagttcatgttagtctattcagtatttttcttcttgcaactgtgtctgttaatgaaagattgcatagttatacgtctgtgatccagtttgctggtccatctcttttcagatcatgctcggggagaaagcttgttttatttcactactttatttatcttgtataatgttcctcttcattcagaaattaatctattttcttctgaaatcccaattgcaggagcactattgtgttacatatgcaatcaacgatgctatggtatgcttatatctcttctccattaaactatctaattcattctagacttccaggagtacttcactaatcgtgtccatctttaatgtgatctatattacagtgtctgttcaaggaatttggtttccccaatacacagcctatgacagacacctccattgcaacatccacatgaaaatagaacctgatcttgactatcattttccttcatctctggtggtaaccagaatatgaatggaggcttgttcctagttgtcaacttggcagggccagaaggtttttcatgtactgaaaaggtctctaccagttctgggtcctagttaggtgtattaagggatggtcatttgtgtgaatgcatctatacatatatttgtttgacgtgaaggggaagatcctctgcagatactttttatttattttgttttatgttggactgaaatgagcttgaatggactgacatgggccgtaagagttcatatagcctatcctaacttggtttggattgagggtgttagtgtatgaagggggagatcctctttgctagctgtttggcaaagaaaaacgtggtagggccctttcagaacggaattgtgttgttttgcccttgttgagtggggaaacacttgcatggttgtctcctcttttttattagatactcttttctctttctttacttatctactatttgcatcatccttttgttcttttgtatttaattgactattgtaccaccgaattggtagatacgaaaaatcaatgtgcttcatcataacaacttttgtacctcaaataggattcatagctgtggaaaataaaagtatttcttttttgtgatcctgcattttttaggttatcatatatgtgcagattgggttcgcggactctatacatctggcacaactgacgtttatgaaaaacacaattaagtaaaaatagcacgtactagtcatttttcgaactggtcattcaaaaatagctagcatttgcaaagttattgaaaaatagtcactattttgctgcactagggaccagttcagcataatataatggagatcggtgcacctgtgtatgaacttctaacatattatactggaactctaacacgcagaaagttccagcataatatactggagatttgagcacctgtgtatgaacttccagcatattatgctggaactccattaaaatatgctggagttccattatacttatgctggaactccagtatattatgttgaaattgtaacaccccagactatagacaaagtcctatatcggcaaaacacaagagggatgctgggtatataagttaacaagccttagctcctagtgacgtattttaaatccgtgagggcctaggcccagagcggacaatatcactagcgggttgggttgttataggagtatttttcggattttgaacagtgttttcgttcagatttatctttacatgaaaagtggctaaaattcgattacttttgaaattgtgattatttttgaatgaccatttgtaaatctggctatttttgaatttctccccacaattaagggtgtgtacatttacttagtgaactctatccatgcatcatgtaccttacctatagcaaaaataactatttgctctaattaaaatcttgactaagttgtctagtgattgcaattttatcctccctccttattcaagagaaagatttaggaaaaagaaagggtagtactgggcggaatccttgggagaacttttagcagtgagatgcctcactatattttgtgtaaaaatttacagaccatgtttacaccaatttaatgaatatatgagatgtatctttatatgtacctgttatcacaaaattatctataattaatgaatgatttattttaccttacttttatagttaaccatagtaaaccctgagtataagtaggtttttttatatgtttggataaagcaagccatagtcatcaatgcattgaaatatggatggaggggatcaggggccaaagcaagaaaaagtggttgcaccaagtggaggttggaataatgtaatcctgacaaatagatttaagagaagcgggtgggggccaagggggaaaaaaagggtccccctttgtgttcacctttttaggagggaatagtattatggttccatgattttctatggattgcagccctatcagtgtctcacactgtctttgctcgtacttatttctagtttctaggctctattctgttcctgctaagtgctaaaaaatccatttttaaggatataattataataatcttgcttgcagctttaagagacgtccttgtttgcttcttagctaaggctgcatgatgaaaccttggaggcttcttctgtaatttcctgttcctaaacagttttaagaccgttagaaaatgtatttataaagtaaaaagtgtttttttcaaaagtacttttggtgagaagcagtttgtgtttgactaattagtttgaaaagtacttctgagcagcaattagtatttgaccaagctttaaaaaactgcttctaagtgtattcttctcaaaagtgcttctcaaaaaagtgtttttggagagaaactattttttttttgcttctccaaaactgcttctgtttctcctcaaaaacactttttttccttccaaaagcttggccaaacacctcaaattgaggccaaaagtggttttggcaaaaaaaaagcacttttgaccaaaaataagcttggccaaacaggctattaatctgacggccgctcgactggaagttaatttagacccttccgctgcacactttctttacccaaatagccggcctagttaactgttttaccttttctagcagtatgtataaattattatacatatatcatatatttgtcggctatttttagtttaagtggttagataatcggctatttagaatacttcttctaatctaagatcgattaaaatatgggttctaaattggaaagtacttccgtctttcttttgtccagtatgtatcgtatgatatacaagtcaaattaacattcttaaatgatgctcccttagcttcaaacgaatgacggaagcttaattggatacacgtatatgttttgtttgctctttccttttccaacttccccttctccctcgcgtcttccctccgttgttatgttattgcttcctttatctagtgtcgtgacgagaggtggaggcaggattttaagtttgtgggtttgaggttctaatctttttaagttattgagttctaaattaataatttatatacgtttaataaaatttttaagacaaatacattatttgaaccaaagttactggattctgccgaaaccgtaacaaatgttgttgctcagcctcttgccatgatgcatttgctcccttagtggtcaacgattgcagttagttgcagttggacagatagtgatatgtagtatcatgtatgatatgatcacacatactagcaccttcgttagtacgtgacaagttgatattgatgagacttattatgatgtcgtgattaagataatgttctcgccatatgctgtttatgtaaagaatcctgaaacaatgctctttgctagtttgaactgctgttagtactctactcctccaattttgataattttctgaagagcttgcgtggcgcttacaagtgaaattgctaaaaaatagtggcaatgtgctgtggaaatatcaatttagtcacctttcttttacgatttcttctgcttttttttcttttctccctttgtgtggtgcctaaaaagcatctgaattttttggaatacataagaaaaggaaaaagagaaaaagagaagcatgtgagatgatacgatgtcattgtctagtgaagactgttggagaagagactggttttttttttaaaagaaaaaaaaaagaataagaagaatccctttcactattttcaaacttttcaccgctctctccctttccccgatgtctttttcctctttaaataatattcacacttcaatagatcaataactgttttattctctcttcttttgatctcttgtttccattttttccccattaatattttaaaaagttatctgccattaacataaagttttggttaagaactaatcgcaaaaacaaagatttacctttttactctaatatttttggaaatagttctattaacaattgccaaaaatcaaattaaaatgacataaggctgacatgtcgaggactttgtttgggttgattttaaattttagaaaatatggcaatgtttagtttagttccatatttaagaaaaaatggaaccaaccaaccaactatatatatgtatattaaattaatttataaattcgtaggaacataaagttggataaagatattcatggtgcttgagttttttactcttatatggagttatttaggagaataatgataggtaagactgaaaacatatatggatgtaagcttttttgtttgaattatgaaaatgattaattgtcatatcttccaatgaaatttctctcacatagatatttcaataaataatagatcaatcaatttgttagattcttgctaaacgaatacgaacatatgagatggattgaatacattaaatttgcgctttgtgtggaaaaaaatgagactattactgaaatggtcactcaactattccaaagtatcttctaaagtcacttttattttatttgtaacaacaaagtcactgaactatgcctattacactcaaaaggtcacccaactagatttttcaaattttggattgtcaaatacctattttactctctaaattataaatatttatcttttttgtttattttttaaactttttagtaacaacaaaaattcaaaatttatttacataattcagaataaaagaaaataaaaattgaaaaaaatatatatttcatacacgtaatataaaataattacttaaataaatgtatttttatagtatacattatatattcttaacaattgtggtaaattatattattatgtttctaccacctttcctacgacacaaagttatgtcaccgaaaagtagggaggctatctgtatagggtaaaatatgctatgttaagtcgtgcatggaaaatatataatataattgagcatagtttaaatatctttattaaaataattatttttatattacgtgcatgaaatatatattttataacctttattttctttcattctgaattgtataaaataatatttaatttttttaatactaaaattattattactaacaaattattctaattaattttttttactatgctcattattttgttattccagtattatatatgcttaaatactttttattttttaaatttataaataatatttattattctataggtaagtccataatgtaaattaaaaagggaaaaattataatattaaaagtttaaaaaaataaaaataaaataaatatttataatttagagggtaaaataggtatttggctatccaaaatttgaaaaatttaattgagtgaccttagtgcaatagacatagtttagtgactttgttgttataaaccaaaaaaaatgactttaggagataatttcggatagttgagtgactatttgagtgatcaacaaaattagattaaaaaattgacttttttgttttgatttgatttgtatgtttaataaatcaataataatttgttttttttttagataaaaatcgaactaaataaaccatgaataccctagtattaaatttgtaagatcgtgattttatatttgataaagttgaaaatgaaatgagaaataacaagcatgggtaatgtaatttgttgtgagttttcatggcgcacttccccttaaaacactaaaatgttatctttttgaccaaataaatgtgagaatatgctcttgtgctctctttttggaaaagagaaataaagtttcgaaacctcccaaccaatactctaaaaagaagtttccttttcttgccctaattagagtttaaccctaccctaaccaaaatctcccttttcacacttaaaaagaaaaaagttgaatgtctcgataccattcctagtagccaatcacattggacattataattgtttttttacactttgccaaaatgatcaatcaacaatccttaggttttaatcttttgcattttgtcttaatgaatgattgcaatttaataatgtcccttctcccgataaattatcattttgcccctcattttagctatccttcctatttaaccgttatctagtcattttttgatgaggcgaaagcttagtgcatcggactgccatttaggttcacgcatcagcatcaatcaaatttcatcgcaccttttaaacgctcataaaaatataataagcaaatgaatacggtctttcgacacgtgcaagggagtcttatttgtgaaagttgcaataatgtccatctaatatacttacccaagttgttgagtgaaatagaaggattttgttcagcattgaagcgaaaactcattgaaaacgactatcataaattacggaataagctcgcaagttaattgaattggttaggtgagtgatttctcacataacagagattttatgcatcaacaacctcctcattaagagctcgtacaacgggcttgtctagttcggttcatatcttttatgtgatatgcgaactattgcgcaataaacgaattactcgctatgcaccataaagataatgactgcgaattttccggatttttttccccatatatcacggaccaaaaataagagacaatgggtagaataggaatataatcccaactttttccaatagatttgagaagaaacatggcaatttactctgcctatcggcattatgagcggtattattgatgtctttagctactaatttggttggtgatgtgtctttcttcaagcgtttccttttaattacctatatagataagtcaacacaagtttcgagattgtccttgcatattttttggaaaaccttagatgagatgataccagtaaacattctgggtttttacgttattattatcagacacggactaataacctgcttaagtacttactaaatacaacaacaaaccacgagtggctacccagtttaattttacaagtgaggtttaaagacggtaatacatacacaaacattactcctacctttaagaaaacaaatatactgtttctgataaactatcaacttaaaaaaggtaaaagaaagggcaataacaagcacaccaatcaaaaaactaaaacaaaaatataaattaagtactgcaattaaaaatccgcaacaaaaacaataagaagtaataacaaaagttgagaaatacacaaataacattaagtcctgtactaaagctgctaatagtatttaaataagttatcaaaagtttgattcgcaaaaaagaagagtggcaaacattaaagaaaaaaaattacgaaattaattaatatagtagaattaagataagaatcaaccaaaaaaaaaacattctaaaatatggcaattgaaaatctcaattctgtattgaatgacagtgggctctatgcctcaatctaagatccaaagcagctacctcctactagtcctttaccttccaccacccctaacccctaggccctaccctactctttcttgttgctttttgccagctgccacccatatccatgcaaaatacaaaaagcagcctttttctgttctaacaacacttttattaataaatcagtaaaaattatactattttaatccttttaaggaaattcatctcctttttccgaaagcgacccatgtatattaaacattccaacacaatcaaatttaattgaaaaacttggagtccgtttggtcatgagatttttttttttactttttccaatgtttggccataaaatttttaatttttgtttgaagatgaattgtagaattttttaaaaatttaaaaacttcaaaaaactattttcaaaattctcacttacatcaatcacaaaatttaaaaacaatccaaaaatatattgatgttgaaacataactctaatttttcaaatatcattttcacttgaattttttttttcaatttcattcggaattgtacaattcttatgtccaaacgcccgcttactctcttttattaaaaaaagattctcggagtaaagagaattttaatacatctataattaagactacaaaattcttaactacttataaatatttatttagaagtgcataagattatttagaacttatagtttttgtaaaaattattgtggaaaaatgattttttttaaatttcttaaatggttaatcgtgattttcttttggaatagagtagtaaaatagcttcaaaacttttaaattctgaaaaagaaatagaaaaacagagccagtcatttttaaagtggaagactttttgagtgagtggagtaggaaagtgtaagagtaaagtgtagtagtcagtcagtgtgtgtctatgtactgtgtgtctgtgtgtaaaaaaactctctcaatggcacttcttcttcaccttctccgcccatttccgtcgctccttctttaactccacaatacacagcgctgtcccttctgccaccatcaccaccgtaagcggcggagaccgcacctcatttatttacagatgggttgcacggcgtcgaagctagataacgaggacactgtccggaggtgtaaagaacgccggcgattgatgaaagaagctgtttacgctcgtcatcatttagcttcagctcattccgattactgccgttcactccgtatcaccggttctgctctttccaccttcgccgccggtgaacctctttccgtttccgatcatacccccgccgtcctcctccgtacaccctctactactaccaccaccattaaaaccccagctccaccacctcctgttcgtatcccatccccctcaccttcactccacccaccaccaccgccgccggcattttctccgtctccgtcaccgacgatagcttcatcaaagctacctcacatactttcttcctcctctgtttcctcccaccacaaccaccaccaccgtcagcctcagccgttacaacaacggaaaaaacccgtaaaacttccacacattctttcgggatcaagcttgagttcatacaatgaggaggattatacgtacgatgcgaaagcgaattcgacgtattcgagtactccttcacaaacttcctctgtttggaactgggaaaacttttaccctccttcccctcctagctcagattactttgaacgcctccgtaaagtggacacaatggatgctgacgatgagcatgatgatgataaagcttcaaactttacatcttattcacactactctcagcatcagcatcctactactgaccaatcatcacttagtgggaaatcgcacaagcaaaagtttgattttttcgatagtcatagtgttgatgatgagaagttgactaatgggtctgttaggaatcacaaaatggtgggtgaaaacaagagaggtcaccatttgaataataatagcaagtgggaggatagtgaagctgagagagaagaggtacagtgcagtgaatgggaccatgatcattatagtactacgagttcatcttctgatgatgatgaagaggaagaaaaggatgagataagatctgggtttgggccaacccggtctaattttgggtcaatgaagagtgaggaagcttctaagattggtgatgtcaatttgaggatgaagagttattcagggaggaaatcggataaggtatcgtcggaggatggagggtcgtcttcgatgagttgggggaatgggaataatgggaaagtggtggaggagatggtatctgataataggagtatagtggtgaggcacaaggatctagctgagattgttgctgccattagggactactttgataaagctgcttctgctggtgaccaggtctctgagatgttggagactggccgagctcagcttgatcgcagctttaagcagttaaagagtgagtctttttggattcttgatttatgtggaatgcataatgatttttttattttccatgccttttgatgatttgatcttggcatagcaattagatggtattgtaattttctggaattgcatttgcaagctcacccatctgagcttcggttagccagtttagagtctggataaaggaggggaggggtgtggtaggttagtgtttggggtaaaatttgtcaaattatgatgaatccagatgattcataccattggctacaactagtttgggattgagattagttgattgacattgatttatctttcccctgagatccagttgggaaaattttgttgaaaattttggattcattgtttggaatttaattattgttttttttgttcattgcagaaacagtgtatcattccagtggagtatttagtaccataagctccacttggtcttcaaaacctccactggccgtcaagtatcgttttgaacctagttccattgatgaaccaggttcccaaaagagtctttgttccaccttggagcgactcttggcatgggaaaagaaactatatcaggaagtgaaggtgctcttctcaatcccgccttagtcttcactgcattcttttcactttctcggtgttccttaccaattggtcttttatgaatcatgatctcagttggttaactggttgtctgcaaagatagaaaagctgtagtgaaatctactctgattcaatcaagaataggttaaaatatactcaataatcgtaattgggtatttgtactttagtcgagtgacagaagccgggttttcggctgggaatcatatgcatgttattgtagtcagaggtgtcaaaattggacggatcatgcttatcatccaaacttcttcagattattcagcttgtgtaatctaacttgtttgcactccatttagtcaataatggcgtaatgactagagtatccaaggtaactgcatgacttgacaaggacaacttggagctattatgagatatattaatttagatgcaggtggccctgccttgtactaagttagctctaaattgatatggacttcattttgaaagacttactccttcttccttttgtggttattactgtggaaaagagtagtataagtagtgtgtttgagcagttttaaaataccttcaactccttatagacaggaaactgcttcttgacatgatctaaaattattcatggatatatgcgtgtctctgcatatatgtaagtacatcttaagtaagtacatcaatgtgttctttttatttggttattttgatgagactgagtacaaaaggaactattcaaaagaatagaaaaagacaaggaaaaaaagtaggaaaaaggaagaggaaaaggtttgccaacttgagcaactgcttctttgcacgtgtctttagccctacacatttgttaatccaagtactgtaaatgcaggcaagggaaggagttaaaattgagcatgaaaagaagttggcaacattacagagtcaagaatgcagaggtgatgaggaagccaagttggacaaaaccaaggcctcaataaagaggttgcagtcgctgatggtggtcacatcgcaggctgtttcgactacgtcctctgccattattggtctaagagactctgaccttgtcccacagcttgttgaactttgtcatgggtaagtccttatgtttggtgcatacttgatttggaatttattgactgcaaatcttattcagattatttgctgtcggacacatgcatgaattatgggttcaaatgagatatggttagtacttacgtcgcgatactgctctgaagcaacatcaactacccttaagagattaaagaagtttggttacatccttaccgaaatttcttccaagctttattttagaacctaaatcaccgagccatctcaagacttatttccttaaaattgaattgataacctgaacttctcctacctaaaattggcatcttctatagtcatgctctcaaagcatgttggtgttgctactggcctgtttcagtgggtagttggaaaattatttatcttttaatgtgccttgcttttgtcttcctgagcccctaagcttgtccacgttgcatctttctatagtctaacagcctctccaggacaggttgtggtcatgatggaaccactatttctggaaattgggaacgtctactgtgctttgacatgtgtaattgatggctaaatatggtggtgcttcttaggctgatcattattgttgccttgataagcttaatctaaaaagaaaaaagtagtgttcttcatggtagttacaactgagccaggtcaagtcaattacagtactaagctaaagtgttatggtcttggatttgaaggctaaagactcagtttctttgacccctggaattttgacaattactataatgattgctgtggacatgtgtgctcttctactaggaagaaagttttaaaagattgtctatgtttatgttttgaacttgaatggcagcttatgataaagtgtttactgttttctaagttttgcccctgactagtcctcaactgatattggtataaacgggtgcagattcatgtacatgtggagatccatgaaccagttccatgaagttcagaatgacattgtgcagcaggtgcgaggtctcatcaatagagcaactaaaggtctatcaacgtctgacctacacaggcaggcgacacgtgatcttgagtctgctgtatctgcatggcactcgagtttttgtcgcctcataaaatttcaaagggactttatccgctcccttcatggttggttcaagctcactcttgtatctgtcaatattgagccaactaattgcaacagagaaccttcagattcatttatgttttgcgatgaatggaagctagcccttgaccgtattcctgacactgttgcatcagaagctatcaaaagcttcataaacgttgtccattcgatatttgtgaaacaaacggaggagttgaagatcaaaaaacgaactgaatctgcatcaaaggagcttgagaaaaaggcttcgagtgttaggagcattgagaggaagtattacaactcttactccatggttggcattggacttcctgagatgggacctgataatggtagtgttttagatacacgagaccctcttgctgagaaaaaggctgagcttgcagctagccaacggcgtgtggaagatgagatgctgaagcactccaaggcagtggacgtaaccagagcgatgactctcaacaacattcagacagggttgccgggagttttccaggccatgaccagcttttcttccttgatgacagaggcccttgaggctgtatgcactcattcttatgctattaagtaggaaacaacttgcagaaaactgaatactagtagtactacttttcttttttgggctattttttccgcggttctgggcaaggatggaagagaaagggctggcatttttggtcatgggctcttttcagctagttggctttttcccttgatattttgctatgttgtagatatgtggaattttgcaattttgtacttttatgtagtggtgggaaaaaggaatgttctctgtatagcaaaattatttgcattactgcattgaggtcaacatgttcagcagatgaataaatgtattctcttatgttatgtcaaagtgtaaaaatttgcttcaaccaaacatttcctgctgtactgaatttttcatgacctaaacttcatgctttgttgtactcgttagagtgagcatgtcacaccaagtatagagcattagacaaggttctttagtgctcttatgtgaaccatagcagttcaaatctaagttctggttgaacactgcttgtgaagcagcagttcaaatataatgtgcttttgccacttttctgtagcattgagacagtgacctctatcttttgttccaaaaggaccaaaaatcagggatatagaatgagtttaccaaaagtgtaagtcatagctttattttctccccttgtgggactatttatcttatctttgaagcttgaggaaaggacaagaaaggctggagcttttgctgatttgtgtccccatgagatctttcataattctgctcaatcatgaaataatagacttatgtttgtgagcacgtgatttttgcttcacacgacaatcgctccaaaaaaaaataaaaaaaatatatatataattggccccgctgtacaatttcggatttctgtgcggcaccttgtggatttatttgtgattttggcccattcttatttatttactttattaaaataaaattcaaaaaaatatatatgtgtcctgcgtaattcaaaccgtaattcggtcgttaaatagaaaatcgtgaataggcattttcgtccgtgattttatttggtttgactttaccggttttgaaatattttagtatgtgtgcaaataattgtatttgagtgtgtatttaattttaatttgattttttggcttagctttgttttaaaataaataagaaaagaagaaaaaaaaataaaaaaaaaaataaagaaaagaccccttccggacttgggccaattttaacaaaattggcccaaacaaacagcccaagacccaggcctgcccagcccaggtcacctgatgcccaggacgtccaaacgacgtcgtttgagtcgtgcctgatctgggccgttgatctcagagtgatcgacggccaagatcaatccccataacccatcaacaaacccgacccgtttacacccggaccaaacccaaaccctcaacatttgaaacgacaccgtttcacttaagaccatcagatccaaaccgtagatctagattgatctaacggttgagatcgacccacccactaactatataagcccaaatccttaccctaccccccctatccaataccccggcctcgtcgtcttcacccaaacccatccccttcaaaccctagccgcccctgcacactttcaccagaaacccagcggcctgaacgccggtgaccttccccttaacaccctagaacccccttgccatcctgaacatggatctgctaaccatgtagttcgaatcatcccctaggtcctcgaatcttcatttgaagattcgagttaaaactcggcttacaccaaccaaccccagcttcacaccagacactccccagacccccctcgtgaccaaaccatacttggtttggtccgaatctaaccagggaaacatgaatcccggatctgagttttggaactttgtagttcctcgtcactagttcatacccgttcgagccaaaaaaattaaggtccaagggaccttaatcgaagtgtttctcatctgagaaacacttcgattaaagtccgttcagccttaagaaagtctgtccaagtccggttcaaggtttccgatttttcaagatttgaggtgagtctgccttcttcccttatttgtttggtccatgtgagggattagatgtctgttcatgttttgtgtcaatttgtgttttgaatttttaccaacttccgtttgtccaccttgtttgaaccactatgtttgtttgaacccctcatattctgataagacatatgtattgggttgtattccaaatttgtactgattatttgactcctcgagggtatttctgtttagtcagtataattcaaaccatgtgtcccatactttaaatgtctgatttttggcttcgattgtgtatgttaatgctaatatagtcgagtcgacatatgtcgtcaattagtttcagctacccgaacaaagttaaatcaatttgcttctgatgaacatttgcctgaaacaattaagaaccaagtccagttacttatagctgttaatatgatttcagaaacctaaggcttggtctgttaattgaaatctgagttgatggcatgtgcacttgtgcacagcatgtgcattgtgcacagcctgtttccttcataaaaggggcttttaaatttaaaatgtgttgacagcatatgctgtcagatagattctactgcccataccttgctttaagtttaaaaaaagtattaaaccttttaaaagctaaatctgccagggaatgttgatggaggttaatacttaaataactaatgggaatctgaaatggaaatgcacatgggaggggcatggtgatattctgaaaacaggctgttaaaaggttgagtttgagacttataaaaggggggataggaggaccatctgaggataaagatacacagagagagcatagatagaggggagttgaagttctggagatacagacagaattagagacaggattgagagatagaaatacatacacacacacacaaaaggatagacattgaaccttaagagctgaataggaaaaacacaaacagagatagagagaggttaagggatagaagctatacaaccaacaatcagaaaccttcttcctcctattgttattgggttttcagttgtttcaatttgttcaagccaattttgatcctttgaaatctcagttgtgtctattagttgagtgctttcattggtctactactatctggagtttctgattctactccactgggtgttgctgttatttggctattgctttctattggctatatttgcatctctgcactcgagctgggttcttgctgtattgctttgtctgctgctatttctgccctgctgctactgatagtgctgtgattgctgctgcattttgttgtcattatattctgctgactccccctttccttcaattgtcaaatatttccaggtacacaacctctgaaactttgtattgttgaaagtttgaagttgaaataaagaaaagaacagctgttcatgttataacattggtgttaaaaataggtcgaatgttagtgggattgtattttactgcaaactgcaaacactttgtataaaactagcatacattctgctgagatggactgttagatagcgctgttcaatagcaataacaatatgatagacagcatgtttgatttgggatacgttcagttcagtataatactgtttggtttagttacgactgtataacatagagtcagggcaaacacttgtatgtatttctgcctagaccactgaatcgacaaatctgtggtattaggtctgggatagatgtatcccaaacaaactctcatgcagtcatattaaaagtctggctatgaatgccattttcgcttgtcagtttatttgttccaatgccggtttgatatcaggtttcggtacagattcttcgtttcgaaatgatgtaatgattgttgagaaaaactaataatcatttttgagttcaattagtagtaatttttcctaataatacatccgatttctttatcaatttcaaataggttagagtgttaagaatagaacttggaggtcgttaaaacataactcaatatatgttgttagtttgtttgcaatctcacttagcgaattaataagcatattcacttgttgaagacaaagaatgccgtagctttcacctcatgaacaatcaatcaggtaatcaaacaagtttaggttcggcaaacataataaggattcagtccgtatttgtctaaaccagcaaaatacggcatcatccttccctttaaagataaatgtagtaaaaatgtagtccttgtagggtacccttctaaaataatgagacgagcctcgccgaatcaaaggcaaattgcggggccctcaataattggtcataataaatacttagaatttgggacgggctgtttagtgaattccactcccctccccgaagacaataacgcgttagattctttaggcgcgacttaatcaaattacattcctaaattcgggtgcgcatttatgtgacccaatttcaaatctcaatggagtcgaaatgtgttaacaattacgggtgcattgattgtgatgtggttcgagatacgttttcacgacgttgcaattctataaaaataaatgataataataaaagcggttaaaacttaataaaagcacataagtcacaacatgtatttaaatcagatatttagccattataacaatttaagcgaccgtgctagaaccacgggattcgagggtgcttaacaccttccctcgggtcaacagaattccttacttagaatttctggttcgcagacttcatttggaaaagtcgaaaatttcctcgatttgggattcaagataaaccggtgacttgggacaccaaaagccaaacctttcccaagtggcgactctgaattaaataaataatcccatttcgaatattgtcacttaaattggaaaaactccacccgcgcatttctaacccttcggggcgggcgcgcaaaaaggaggtgtgacagctctggcgactccgctggggattaaaaaacccagaaccactggttcagggttcaagaattcgagcttagagtaattgttatatctggcttattatctgatctttattacatgttttgcataaaagtgctaaatgttgtcttttaccgcttctgatattatctgaactgtatataaactgtgccgaaacccttcttttcttacctccggggagaagctcgctggtcgagactccctattctgttagtgtcaatacctaaaataagaaagaggacgaacaagttacaaagccggacgatctcgcgggtccccggtacgtagccccctcctcgactcgagttgtccgctcgggtacacagtctagaacaaataccaaggtttaaacctagtataacgaaacttcatgccggatccctagtaggaacgcttatttgcatcacattgcatttgacttaggggactcaacacaggggttgggtccgtctaggacatgcaacctgaaatggaaaagaccatcatgctgcattcctatctgtgttgtgcatttatttgcttcgatttcgcatgtcgaccggttcctaaaaaaaaaaaagaaaggaaaatagcagcgtaggggagataattacttaattttggaaaataaaaccaatgtccaagaagtgtcaaaaccttgccgaaattttcctaaaaaaaaaaactgtcttgtttattgagagtcattaaaaaaaatatatatataaaattttcttttatcactttcaaagataaaaaaagggggtatttattttaagagtaaaaaaaaaagaaaaaaaatcgaaaattcataattcaaaaaaatgagttgtttctttcgtaataccccttttatgaattcagactaatagtccaaattttccttaaaaaaatataataataatatataaaaaaaaaatataaatatatagtttctttaatctttatctcttttcaaaaaaaaatgcaaaaaaaaatacgcattcctgatttctaggtttattcgattttttttcctatgttacgacaccccgaactacgccggtttgattctcaccggatgtgagatacgtaggcaaccctcgtcgggttcaacccccattttgctaacatagccaaaatcaaaaaatatatgtttcaaatttttaaagagtcataaataagtcaggggatgctgttttgacatgaatagccgaatgttcccgaaaagggacgccggaaggctgactttgcataaatagccacttttgggttttccttagcatgtttagacccacacagccttaaaatcttcttccccggagtgcttaaaggccgtgttcaaagcttggtcccctctgtaaaatattttgagtcagtcatttttgttaaaatcaccttaataaatgtgcaggatgagcacgatgcaaaatgaacatctttcaataatgaccaaaatccctatcaagttacggctatggtggaatgatctaggtgttgaagggcaaaatgaggttaagaaaaatctgaaaggtcttgtgggtctgttggaaatccagcctcggggagatatcataagagctttggttacctattgggacccggcgcacaatgttttccatttctctgattttgagctcaccccaactttagaagaaatggccggatacatcgggaatactgaacttccgctgagggaaaaatacttggtcgccccaagagtcgtcacggtacatcggttcctggattcattgaaaatacctagaacagtccacaacccggatctagcagccggattctgtactccatgcttcatatatgatagatacggtcacgaggggggattcaataatccaatcaacaaactgtgcagcaaaggagttcttcagaagtgggacgagcacagacgggtggcgttcatgataacgtttctgggtcttctggtatttcccaggaaagatggaaacattgatttgaagatatcgggggtcgtcagcactttactcacgcaaagtgacagtactctcgcgcctatggtggtatccgacatctttcgagctctcacagcttgtaaagctgggggaaatttcttcgaaggttgtaacttgctcctgcagatgtggatgatcgagcacctttgccatcattccgagattttgagccatggatcaccggaaaagacccgcatagaagaatcttacgcgagagccaaagagatcagtttgcccgaaggagtcctggcttggaccttgttctttcaagctcttactgccagccaaatacaatggaagttgggatggttgcccgttgatgaggtcttatatatgtcagcggctaaaactcatttcttgctgatggggcttaagagcattcaaccttacgcacccggccgagttttaagacagttcggaaaatgccagacagtacctcatgaggaagatctaagcactcaagcaattgagataagtcctaacgggcagttcccagaagcaaagattcgccaaatctggaatgagggtcaatatttgaaatcagatacttgcgtgcgggatcaagccaaaggagaaacggcgccaggttaccttgcatggtacagaagggaactcgagcatgaaaggccaactaagagaccccacatccggaatttcaccgaatcatcacaaaagcagtgggattggttagcgaaagaaagaggctattgcaccgaaatcagcaggttaaagcaacaagtggaaaaattgaaatatgaacacaacgtgcaagttgctatcgatctgggagagcggaacaggttgattcaagaaaatgaaatgctcaaagcccagatcaaacagataaagttggatgcagatagacaaccaaggcgtcgatcggacgagcagctgataaaagggttaaaaggtgaaatcagggaatggcgagatggtttggagaaatctgaaaacatcatagcagagctcaaagcacagtgggatacaagaacggataagcatcgcaggtacctgaatcgattggaaagcgaccatgagaagactgttgctaaaataaagagagagatggctgcacttaagatcaaagcagttaatcaggccaaggatttccaaattgagagcagatactggtatgactcaatagcccagatgaagttggaagtacgacgactgaagcatcagcatgtacaagatgctcaagttttcaagatatgcagcgatcagacaaaacgcctgctcgtggagaagaagcaaaccagagataggatcaaggccattgcccatgccatcaccagacgatgcctacgatgtgagaacatgtccagcgctaccgtcctctcggcagtaatgggttatgtcaagcagactatgcacgagctggagcaacttgagagggatctcacgcctaggaccgcggcaaggccgaacgatgccccgcggaaaccgatttttaaaaccataatgcattcataggtcaaatctgtattttagcatcttctgcctgtttttttcatcaaggtgattttcagtctattttgagtctaggttcattttccaagtttgttttttcttttgcagaatgtagcttgtaatagaacatttcaacaatgaagaggttgattcttttacgtccatttgtgtttttcgaactacgtaatgatctgattcacgtgagtatcgtgatacgtaggcaatcctaatcggatccgatcgcattttattttgctacaaaaaaaaaatataaaagaaaaataaatgaaaataaaataaaaaaaaaaaggaaaaaaaggaaaaataccggaatgacgcatgctctcgtagcagacatatagtaatccacttaactgtataggtgcatcatgccctacgtgagactaactatctgttatttgctgcaaattaaccgtgcgtttgtcattgagcatttccagggtttttgaaaagacggttggtttggtgaaagtctggcctcgcattcatacttcacgagatcaaggagaggtgttcaactacctgttgttaggactagaagcaatactcacacttacttcaccaggtcaaaaggaagtgtggaaatgtcttcggaaattccattgcaaacagtccccgtctctgaggagagctcaatctcagccatcctcacgcctgaatccgcaactgcggaagaaatagaatcctacggctccgcatgttggaaatgctggatgactggaacaatgggaaagagccgccaagtgtcgtccccggattccctgaattattctccaggtcaggtgggacttctaatgtccccgtaaattaccctgctaccccattcgggtacccagccaactccgctctctccgcaggatcaccttctgagcctcatccccgaatgtcggccactgatgcaagcatgaacatctttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaaacatcaagaagattttgaggaaaacaatacaaaattcccgacagtggcatgagcagttgccttttgcattattggggtatcgcactacggtgcgcacatcggtgggagcgaccccttatcttttggtttacggaaccgaggccgtaataccggcagaggtagagattccttcacttcgaatcattgtcgaagcagaaatcgaggacagcgagtgggttaagactcgactggagcaattgacgttgattgatgaaaagcggatggctgcagtttgtcatggacagttataccagcgaaggatggcccgcgcctacaacaagaaagtccgcccccggaatttcgaagtagggcaattggtactgaggcgtattctgccgcatcatgaagaagcaaaaggaaagtttgccccaaattggaaaggcccatacatcgtaaggaaaatattgccaagaggagcattgtatttaggtgatatcggaggaaatgaccctgacacagcggtgaatgcagatgcagtcaagaggtactacgtctagatcatactccaagtggtcctgacacgttgaaaagggcgaaggtgtttattccccactactccccaaacactacccaattctcgctaccaccttttgagccgttaaaaaaaaaaacaaaacaaaacattgattgaggcctgaactacgtttgacttgattccgaaaggatacgtaggcagcctctccctgaggttcagtcacaccaacaacaaaatcccattcaccctgaaattgaaaaccggggcatgtcggacacttgagaagtttagtatcagctacctctctttaccaggtacaagccttcaagtcaattaccaaagatagtgggaaaccgataagcatcacaaatggaaaccggcacaccccgagttgagagaaataaaatgagagagtctcggcggtgaaaaccttcgggcaccacgaggcgacgggagtagagaaaccaaaatgagagagcttgtttagtaaaaactcgcaaagagtgctatcaagcgatgacaggaagaggaatgagagaggtcagccagtgaaaacccgcaaagggcgctgttggccgaaaaggaatgacgccaccccaagaaggtctcggcaaagttccaccagttttggaatcacagatctgttctggtttaggaaaacgcaagttcatggaaggtcgaacgtccagtccaaagagcatgtcatgtcatttaaagccagcgttatcttcctcagataagtctttctcgtcccgaaaagggtattccttttctgatttgttttcccctgctttgtttcttttcgaatccctttttgcattttaacccagagttcaggacgcaccggaaagagtaggtggcatggtttgtttgcacggaatcccgtctcatgaaggaaagcacctcatctcgttgatatgattacccaagcatgatggatcatgacgtttgatggtgtgccggagtaaaggaaaaagagagaaatcttgaaatcttccccagcaagtccaccttcggacaaatccccacagagtctccccctgtacaaatcccaacagagtcttgtacaatctcccacagaatctcctcaatataaaaaaaaaaaaaaagaagaaaaaaaaaaaaaaagaaagaaaatggaatctcctcagcacatcccagcaagtccttttgtaaatattccccaacaagcttaccccaacaaatcctagaaatcccactttgaaataaatccccagcatgcccattgtacaaaattccccacaaagaatcgactttgtaaatattccccacaaagcttcccttttgtacaaatccccacaaaatacctccaataaaatccccgttgagaacctccaagcaaaacgggacacaaaaaaaagagagccttacgaggcaaatcatcacagaatctggaaatacaagcctgagcggtctaaagggtttcggcatatgaatcaaatcaatggcgggacttcacaacagaaatgaagacgcaacaaagcaaccgggaacgatcgaggtcaccaaaccgaccgtcatttccgaactaacaattgtcctttgctgaaaagttgaaacaggtatgatccaagacaaccgtgcaaggagcaggtgtcgcccaaagaagaaggtacatgggtacaagaaatattttggcaataaggaattcactcgaaaggtaagtttccacgaaactcccttgtatcttatactaaaacaagaaagttcaaaaaaaaaaaaaaaaaaaaagaggtcgtttagtattctcgaacttttccttttagccagcattagagttttaaactctaaactgagcttttccatgcaatcagcattagggttttaaaccctaaactgaattttcctttagtcagcattagggttttaaaccctaaactgaactttttccttttagccagcattagggttttaaactctaaactgagcttttccccatgcaatcagcattagggttttaaaccctaaactgaattttcctttagtcagcattagggttttaaaccctaaactgaacttttccttttagccagcattagagttttaaactctaaactgagcttttccatgcaatcagcattagggttttaaaccctaaactgaattctcctttagtcagcattagggttttaaaccctaaactgaacttttccttttagtcggcattagagttttaaactctaaactgagcttttccatgcaatcagcattagagttttaaactctaaactgagcttttccatgcaatcagcattagggttttaaaccctaaactgaattttccttttagtcagcattagggttttaaaccctaaactgagctttttccttttcagccagcattagagttctaaactctaaactgagcttttccagccaatcagcattagggttttaaaccctaaactgaattttccttttagtcagcattagggttttaaacccctaaactgaattttttttttccttttagtcagcattagggttttaaaccctaaactgaattcttcctttgtttggcgtaagggttttaaaccctacactgaacctttccccagctagtcgatattagggctccaaccctgaactgagcacgcatatcctctttcatcaattttatgaacttcctggtgaataagtaacgaaattttcctagtgaaactggggcagaaaatttcgtttgtttgtttcttttctcccgcaggtctgacctcgagccacatggatcgaaatgacccacgagataaatcccagttcggaatcaaagaagaaaaagacaaaaaaagagatatcccgagatatcagagtaaagggaaagcaaatcgactccaacatttgactaaggtcctgacctctgccggtcacattttattcggtatcccggagattaaaaaaacaagtcgccgcaactcgcaagcatcaagattcagatcagagtctacaagcagaatcagctaagacccaagatcaagtcgtaaaagaatcatagataggaatcttgtaactagcagttgacatgcataaaagtagttagttcagtttccaattttcgcttggttgtaataaggcggtcagtgacgtagcagtgacaacagcagcagcagtagcggcaagcattgcagtcccatggtagccccagctaccaaaacttctcgaactacattgacctgattcctgtttagcccaggatatgtaggaaatctttgaagcaagattcggtcagatctttcaaaaaatgcttcatacggagtggtctataggcaaaaatcgctcatacacgctcacttgatctttgcacgaaaacccttcgtgtttccgaacaaagaggggcagctgtgagcacgtgatttttgcttcacacgacaatcgctccaaaaagaaataaaaaaaatatatatataattggccccgctgtacaatttcggatttctgtgcggcaccttgtggatttatttgtgattttggcccattcttatttatttactttattaaaataaaattcaaaaaaatatatatgtgtcctgcgtaattcaaaccgtaattcggtcgttaaatagaaaatcgtgaataggcattttcgtccgtgattttatttggtttgactttaccggttttgaaatattttagtatgtgtgcaaataattgtatttgagtgtgtatttaattttaatttgattttttggcttagctttgttttaaaataaataagaaaagaagaaaaaaaataaaaaaaaaataaagaaaagaccccttccggacttgggccaattttaacaaaattggcccaaacaaacagcccaagacccaggcctgcccagcccaggtcacctgatgcccaggacgtccaaacgacgtcgtttgagtcgtgcctgatctgggccgttgatctcagagtgatcgacggccaagatcaatccccataacccatcaacaaacccgacccgtttacacccggaccaaacccaaaccctcaacatttgaaacgacaccgtttcacttaagaccatcagatccaaaccgtagatctagattgatctaacggttgagatcgacccacccactaactatataagcccaaatccttaccctaccccccctatccaataccccggcctcgtcgtcttcacccaaacccatccccttcaaaccctagccgcccctgcacactttcaccagaaacccggcggcctgaacgccggtgaccttccccttaacaccctagaacccccttgccatcctgaacatggatttgctaaccatgtagttcgaatcatcccctaggtcctcgaatcttcatttgaagattcgagttaaaactcggcttacaccaaccaaccccagcttcacaccagacactccccagacccccctcgtgaccaaaccatacttggtttggtccgaatctaaccagggaaacatgaatcccggatctgagttttggaactttgtagttcctcgtcactagttcatacccgttcgagccaaagaaattaaggtccaagggaccttaatcgaagtgtttctcatctgagaaacacttcgattaaagtccgttcagccttaagaaagtctgtccaagtccggttcaaggtttccgatttttcaagatttgaggtgagtctgccttcttcccttatttgtttggtccatgtgagggattagatgtctgttcatgttttgtgtcaatttgtgttttgaatttttaccaacttccgtttgtccaccttgtttgaaccactatgtttgtttgaacccctcatattctgataagacatatgtattgggttgtattccaaatttgtactgattatttaactcctcgagggtatttctgtttagtcagtataattcaaaccatgtgtcccatactttaaatgtctgatttttggcttcgattgtgtatgttaatgctaatatagtcgagtcgacatatgtcgtcaattagtttcagctacccgaacaaagttaaatcaatttgcttctgatgaacatttgcctgaaacaattaagaaccaagtccagttacttatagctgttaatatgatttcagaaacctaaggcttggtctgttaattgaaatctgagttgatggcatatgcacttgtgcacagcatgtgcattgtgcacagcctgtttccttcataaaaggggcttttaaatttaaaatgtgttgacagcatatgctgtcagatagattctactgcccataccttgctttaagtttaaaaaaaagtattaaaccttttaaaagctaaatctgccagggaatgttgatggaggttaatacttaaataactaatgggaatctgaaatggaaatgcacatgggaggggcatggtgatattctgaaaacaggctgttaaaaggttgagtttgagacttataaaaggggggataggaggaccatctgaggatagagatacacagagagagcatagatagaggggagttgaagttctggagatacagacagaattagagacaggattgagagatagaaatacatacacacacacacacaaaaggatagacattgaaccttaagagctgaataggaaaaacacaaacagagatagagagaggttaaaggatagaagctatacaaccaacaatcagaaaccttcttcctcctattgttattgggttttcagttgtttcaatttgttcaagccaattttgatcctttgaaatctcagttgtgtctattagttgagtgctttcattggtctactactatctggagtttctgattctactccactgggtgttgctgttatttggctattgctttctattggctatatttgcatctctgcactcgagctgggttcttgctgtattgctttgtctgctgctatttctgccctgctgctactgatagtgctgtgattgctgctgcattttgttgtcattatattctgctgactccccctttccttcaattgtcaaatatttccaggtacacaacctctgaaactttgtattgttgaaagtttgaagttgaaataaagaaaagaacagctgttcatgttataacattggtgttaaaaataggtcgaatattagtgggattgtattttactgcaaactgcaaacactttgtataaaactagcatacattctgctgagatggactgttagatagcgctgttcaatagcaataacaatatgatagacagcatgtttgatttgggatacgttcagttcagtataatactgtttggtttagttacgactgtataacatagagtcagggcaaacacttgtatgtatttctgcctagaccactgaatcgacaaatctgtggtattaggtctgggatagatgtatcccaaacaaactctcatgcagtcatattaaaagtctggctatgaatgccattttcgcttgtcagtttatttgttccaatgccggtttgatatcaggtttcggtacagattcttcgtttcgaaatgatgtaatgattgttgagaaaaactaataatcatttttgagttcaattagtagtaatttttcctaataatacatccgatttctttatcaatttcaaataggttagagtgttaagaatagaacttggaggtcgttaaaacataactcaatatatgttgttagtttgtttgcaatctcacttagcgaattaataagcatattcacttgttgaagacaaagaatgtcgtagctttcacctcatgaacaatcaatcaggtaatcaaacaagtttaggttcggcaaacataataaggattcagtccgtatttgtctaaaccagcaaaatacggcatcatccttccctttaaagataaatgtagtaaaaatgtagtccttgtagggtacccttctaaaataatgagacgagcctcgccgaatcaaaggcaaattgcggggccctcaataattggtcataataaatacttagaatttgggacgggctgtttagtgaattccactcccctccccgaagacaataacgcgttagattctttaggcgcgacttaatcaaattacattcctaaattcgggtgcgcatttatgtgacccaatttcaaatctcaatggagtcgaaatgtgttaacaattacgggtgcattgattgtgacgtggttcgagatacgttttcacgacgttgcaattctataaaaataaatgataataataaaagcggttaaaacttaataaaagcacataagtcacaacatgtatttaaatcagatatttagccattataacaatttaagcgaccgtgctagaaccacgggattcgagggtgcttaacaccttccctcgggtcaacagaattccttacttagaatttctggttcgcagacttcatttggaaaagtcgaaaatttcctcgatttgggattcaagataaaccggtgacttgggacaccaaaagccaaacctttcccaagtggcgactctgaattaaataaataatctcatttcgaatattgtcacttaaattggaaaaactacacccgcgcatttctaacccttcggggcgggcgcgcaaaaaggaggtgtgacaatgttctttctcccctttagtcattattaggccgtaaaaaatgacttcaagtggctattaagtttttcaagtaaacactcgttactgacgtggcatatgcatgtttggtaacaaagtgttcggcgcgtgaatgtcatttttcaattgtcaaatccaagaaaaaattaattaattacaagaaaattcaaaaaagataagaaaattttgcttgggtgcttcttatgcatctttggtcttcattatctggcattaaaattctgaattgatctaaatataatccttgccattgctctacaattcaagtttggaaagaagtatacgaaacacatcacaactctcaaatttggaaagaagtcttcgaaacccatcacaactcttgaaatttgagttcgtgttccatcattcttcattgtccaacactgtggaagaagctgggtttttcgatctgaaaattggaggtcgaaattgattgggtgtttaaaacctttgttgaaaacttctttgtgaaacagaatatacagatttaggtcgattggagttgattctattggctttggttcgaaatttttgaagtctattcgaagaagacatgtgggtcttttgatttttttgttgcttgtaaaaattgggtattgtggtttgatatcggtgttgattagagttcttatttcaagtttggactcatttggtgaaataacaattgagattggattgaaaaatttgagcaagtcggaagatggccgaagaaaactgctatattcttcaactcttgtgttcttcaatttttgaaattgggcttaaagtagcgtagcttaagcatttagtcagtagctacgtttaatttgttgggagttaggatgcaggtttaatttggagaaatggaatgagggaaagttgatggatgaaagaaagaagatgaaaaggtgtgtgtgtgtgcggggggggggggggctgtcagcgctggcttggttaattaaaagtaaggaaaaaataatttttttttactttaaatgtattctcttttttttgttaattcaaattacacgtgtcgtgttctaattggttcattagacacatcattagcaagtgtaactcacacatatagttgctgcgctcgagtgtttacttgaaatacttaataaccacttaaagtgtctaaatggtaaatgagtcacttaagatgtttagctagttgttgaggacaacttcaatgagccgtttatgtattttgccttatttgttccattttacatgcggatacaaaggtaaaactggatcaattacgacgtaatgcaaaaaaatgatctccccccgtgtccttgcatgtgcatgcaggtaaagcaaacactaagatatatatatgaggaagcagcttgcaagtatgactaacctactttacaaattacaattacaccacactggctcttctgttggtgggtatggggtcatggaaggaaagagacaaagggaaagtcggttgaattgttattagttactcagagtagtatctgtaaacactggtcgatggggcggatttggggcggaagggggtttgtgccaaaattataccatttatataaggtaaaatttattttttaactctatatattatatttgaattttctagacataggtctaagacatatctcattaattaagaggattcaaaacttatatgaaattactagttcgttggtcgattaattcagattcatgtccggccaactataggagaaggttctctagtttttcattctcaaggtttgaatccgagaattaagaacaaagagatttcgtttattattattattgaaaagtatttgtaagatattatgaggtgtcagataggcatatgatgtaattgggtgtcgcccttgaagaccgcctactaagttggtaatccaaacaaaagtactgtcaacgtatgtgtcttatttggtcataaattttgtcatcttgttcaaacttgaattgcctcccactctctaatgtctcttgttttcttttacttcatttttataatgggggtggagttctattattattctcatattttcctgagaattatttcttggatctggtgcctctgatgcacatttctgttgtatactgaactgaactgaagatctcggtacaaattacaaaaaccaatgaacccactggacacattttaaatattaaataaagatatcaactttaaaatacagtactagttttcaatgggctaaatgctgggatgactaatgtttggtaaacaaatttaatgctttgatgagacactgtagttagcaccaataaaaggaggggattttttcattcatatacaatatttgaaacttatttactaaaattgttctagttttatatattactagccataaataaggattacttaaataattatatacaattcattattagtgccttaaattaggaaatttaatagttgcgactaaggggctgagtttgctggattggttgtgcagtctgagtcgaggtttcatgggttccagatccgaggtagcaaaaggcaaagagaagtgggtgggtcgggtacaaatggagcaattttgatctgttgaactggaggaggaagagggaaaatcccactgattcgggggataggtccataaacaagaggttaggaaaaaatcgaaaagacgcgaatctgtcaagtcggatccggatggactacttggactcataccagaagaaaagttggtactaggacctacactaaacaatcttttcaaaggttgtcaaggagtttcaaagcttaaatctttaaacatggaacaacacttacgtttaagagtagagttccagtggttcccatgataggggtggcaaaatggttcaaacaaaacagttaaccattcatattatccattaaaaaatgagttggataatgaactatttaaaaatgggtcatatatggataaaaagcatattatccatttagaaaatgaataaccaatgagtctaacttttacatttgtaaagcctcaaattgggagttcctcgagttagggagcctaagaattctcccaaaaatgatcatatgtaagaagtcatggataatatggttatccatattatccgccggttaacccattttttatccgtattaaatatgggtcgggtcgggtaatttacccgtttttcattgtctgttttttacccgaaccatatccgacccgacacgtccgtttgccgctcctacctgatgatagtttcatcctcttcagaagtgaatgcacgatgcttcacttgaggggaaagctggttacaccatcggagccggtaggatacagatttgataaaattttatatttataataatatataaactaagaatgaattttatacaactaattatatagtatacaacttatctacaattttcatacactatttttttcccagtaaaagacatctaaaatatcatacaacttaaatacaatttttatataatattgttcaactttcatacgatacttaaataaataaaatatatataaaaataacataatacaatttttctagaattttactacaatttctgcagtataatgtatgtcatgtcttcttcttcttcttcttcttcttagagtttcaatctgaaattcagccaaaatcaggtctaatcttcaccaaaataccctcaaagttgagatataaacttcgaaccatattctcaattgtttgcaacaacacccaatccaaacaaataatgatttttgaaaacctaaattcgaattcaaagcttcaaagctttttaatggctgtcaatggtggaattgctgctctctttttctttgttttacattactggaattagggattgagagatagagagagacgtagagagaattcccaattatttgcaacaacatccaattcaaacaagtaatattttttgaaaacccaaattcgaattcaaagcttcaaagctttttaatggctatcaatggtggaactgctgctctcttgtgcaagatacgtgggggtggggggtgggatgtggagagagaaacgtgaggggggagtgagataaagagagagaaatgtggggggagggggggagtgattgtagaaattgattaattatccttaaatcctaaaaatgtatataattggtaattttgtatataggaggtaattaaagtgaaacttgagtagggagggtaataaagtttctaatactatatatgtatgtaaaaatctctaaaaggaaacggttccaagtgggcgcgtggtaattattgtgtgaaaatagcacgggctagtcaattttcagactcgtaattgaaaaatagtcagtgtttgcaaagttattgaaaaataacgactattttgttgtaacacaaaaaattctagcataatatactggaaagttcacatgtaaaaaattcgaactctagtatattatgctgaaatattttttggattttgaacagtatttttgttcagatttatctttacatgaaaagtggttaaatttcgattatttttgaaactgtggttatttttcaattttcacttgtaaatttggctatttttgaatttcacccaattatttttgagcgatttgcacaataggatacttcgggtgccacacttgattttttttaccccgcttatcctttgaatagaactttaagtttaacaattgttatctcttgtttgtctgatgagctaacacttttgacttttgattttaaatgtttgcccattgggcaagggaaggtcaaaaaattaagaccatacatttttaaagttatcgggcgtagttttcttaatttttttccctctctttttatctttcaattttgcatagttgggaggtggggttggggcctaaggtaaagttgaagttgagctggaaggggaccaaataataaatggagaaatggacccaataaaaagcaactgtggccgtggggctcaaaggaagaaaatttgctttcttttgcccctcctttctttattctttttttctaaacattttggttaattttttccttggataggtatcaagaaatacacctatcaaaattattattatttttaaaaagtactattccctctgtttcaatttatgtgaactcatttgattgggcacgaagtttaaaaaaaaagagaagacttttgaacttgtggtgtaaaatgaatcacatatattttgtgtggctataaatcattgcataaaggtaaattgtttccaaatagggaaagatgtcattctttttggcacagactaaaaaagaaataggttcacataaattgaaacggagggagtattaattaagatatgatagaagaacacatttcctttatgtaggaagtactagagaatgctttaaatcacgaggcttgggattgtcaacaaacaatttaacccactacaaaaaaaaggaggaaaaaaaagatgaagaaaagaagcaaatatagggggttaagtaaaaactcaatggtagagtaaaatttctttatattatcagtaacttattgtttacctcgaaaaatggggtaataattaaatgtgatttgtaattttaaagatatataatttattctaatactagtgaatatacaaataatattaagcttaaatatgaagaactgatgaaccaaactagtgtcgctataacaatgaggaccccaagctcgactttcttgggggcctcgaggtcagctaagaacaatgaagtatgaataataaagtaaaagtaataaaggtgaagaacacttgttgagcacgttaaacaagaaaagtagagtagaatattctattgcagtgaataatttgcgatgatccttacaaaataattggggtcccctttatataggagaagaaaattccaatatagtacattcctaattgtagtaaagaattatattggtacagctgtataacaacctagcacgaacctgtactatttcgtacatatcttatcctataatttatgccttgaaccatgtgtccttgaaacattctcgctctttcttgagtgccctcgagattgcactgccctcgatatcggtcgtgccaggccttcgattcgctttctcgaggtgtgtgtccctcagtcgggtccaacccctacctcgagtcgcccaaactcgaactcatagcccaattcatgacttcgaaatcgggctccttgattttgactgtatacagatagtcctcgcgttccttagagtaagatgataagaaacgatttgaacctcgaccttcccgaccctctcgtgataacgttatgcttgtgacataggaacttgaagtgatcagaaatgtcatgtcagcatgcttccccaaaacatcaaatacatttcagcttttgtcgcccacttgcgccgccggttccgttgtcggctttttataaataaggggttacttggctgaacaaaaactacacccatttccttgctttatctcttcctctaatcacctatttctatggttcaaatctgtgaccacagggccacatggcagcaactttaccagctattccaaggcttcctttttcaaagttttggctcgagacaacgagagaaaggcaccaaatccttcccgtatcagagaataatgtgaactttgcaccgctgctcatctctcttaacttcaacctagtgtggcgcttcattccttttgatttccatggaatgaggtggcactatcatctactaacttttgcatcccacaccggaacagagttccgaggatgaacattcttggattgttgttcgtgcatcttgcaaccccttttgttttttccttttgcttgttctttcttaatatattatggcccaaaatttcaatggaatgctcaatctcggctaccagagatataattgcatttatcgagggccatctgccaatcgtttccaaaatcggaaatggtgcctccgagaagagcatttccggagacgctactctcgaggtcgtggccttataagtaaattaagatctttggcttttgttttcttcttctttgttcatgtgtaagtatcctttgtgggtgccatagttatactttttaatcattttttggaactataaaaggatccttttgtatccttttctgtcacgccccgagcctggggcgagaccggcacttggtgcctcacctatccttgcgtaccacttgcgactaaaagactctgaacagttaatgtcatactttggccatcggccatattgcaaaacaactgtgaatgctgactaaatatcaatataaagctgggccgacaaggccgtcataattattgcagctgacagacagaccaaatatatatacagggcctacaagatcaacatattgcactaactgacagaatatgtctacaagcctctactagtggatatactgtgatcagaatagctcccccgacctactcataccatatatatacatatatacataagatgtacataaagctctagacccggcaactccgaaaggcatgaagcttaccgatcaagctgaactagggcaacacttaataaagaggcctacccgtctgtctgtctgaacctgcacgcatgaaatgtagcacctctaaaaaaggaacgccagtacgaaataatgtatcgagtacgtaaggcaatatactgaaagttgaaactgaactgaactgataatataattactgcaagtagctggaaatcaaaaataatctgaagatttgctcacctgctgatactgacttaactctctcaatatagtaagtaaaatagttgtccggccctataaggctcggtatatatatgtaactgctctgccgtagtaggctctctcataggcgctcggccacactaggttttgtatcttggctaactgggctcgctcataggcgcttggccacagtaggctcggtatataacttactatctgatctaaggtttcccaataggggcctgcccatcgattatagctcgatggtaataaaaataatttaatattgtatgtataaactctctactctcttgactagaagaagaaaatacgcaattaaatatgaagtcccgataagcagaatattgtaacttacaaaactagaaaaatatacgtaatttgtgagactagcaaaatatacgtaaattccgggatatgaatttttctttatgcctcattatcaaacttgtgtaatgacgagatcatgcaaaatgaaggaagaccttagtcttaacatacctggggtagggaaaaatccatatgatattcttggaaaaggttgcaccgtactcccttagaattgcaaaatcccgttgttattactccgtgtaatttcgtatgaatttctttaccaacctaagaattgtcgttgcttattgtaatatgaaaatctgatatgaactttgaaatcatcttcaaaatggaattttgatgctaaaatgagcataatggtagcctgggggcgagaccggcacttggtgcctcacctatccttgcgtactacttgcgactaagagactctgaacatataatctcgtactttggacatcggccacattgcaagacaactgcaaatgctgactaaatatcaatataaagctgggtcgacaaggccgtcataattattgcagctaacaaatagaccaaatatacatacagggcctataagcccaacatattgcactaactgacaggatatgtctacaagccgctactggtggatatactgtgatcggaacagctcccctgacctactcataccatatataaatatatacacaagatgtacataaagctttagagccaacaactccaaaaggcatggagcttaccgatcaagctgaactagggcaacacttaatgaggaggcatatccatctgcctgtctgtctgaacctgcacgcatgaaatgcaacacccccaaaaaagggacgtcagtacgaaataatgtaccgagtatgtaaggcaatataccgaaagctgaaagtgaactgaactgataatataattactgcaagtagctggaagtaaaagataatctgaagatatgctcacctactgatactgactcaactctctcaatatagtaagtaaaatagttgtccggccctataagactcggtatatatatgtaactgctatgtcgtagtaggatcgctcataggcacttggccattctaggttctgtatctcggccaactgggctcgctcataggcgttcggccacaataggctcagtatataacttaccatctgatcagaggttgccaaataggggtctgcccatcgattatagctcgatggtaataaaaataatttaatattgtatgtataaactctctgctctcttgactggaagaagaaaatacgcaattaaatatgaagtcccgataaggagaatattgtaacttacaaaactagaaaaatatatgtaatttgcgagactagcaaaatatacgtaaattcctggatctgaatttttctttatgcctcgttatcaaacttgtgtaatgacgagatcatgcaaaatgaaggaagaacttagccttaacatacctggagtagggtaaaatccatatgatattcttggaaatgattgcaccgtactcccttagaattgcaaaattccgttattgttacgccatataattttgcatgaatttctttaccaacctaagaattgtcgttgcttattgtaatatgaaaatctaatatgaacttttgaaatcatcttcaaaatagtattttgatgccaaaatgagcataatggtatatatcatgtatgacatttatttgttcttttccttgtactaatttatatctttatttccatcatttatttatttcctattatgaggtagtgcagcctacctttcatgaaatctaggtgtggggattcagatgttatattaaaaaaaaacaatgggtaaagatgactaatatctcaaattacttaaaattctacttatttttaatacactttatacattctactatcatggtcatatggtactagtccgtaaatatcgggtattaacgctcggccagtattttatcccaacatgccaaacttggacgaaaatttattttctttgacttgtttcacctctcaccttcacgaatttactcatcacttgtttgaaatatcatccttataatctccaaataaccttttccttggactgatgtcaattaccttacgacaaattcagcgtacaatactacaaggtgcaccattgtcgtaatttaatattgcgaagcgtaaaatcatcgtaatatagtactgcaaggcgtaacatcatcgtaatataataccgcagaacgaaatatcaacgtaatattgcgaggtataacactttcagcccatgctgaattttattctatctttattcgtaaaagactcgattttatgattttaatgcctatccaaaatattgagattaggacataataaacccttaggtttttaattgatcaatatgatacacctcgaggtttttgctaaccctctagttgagcctgaatatgaactctgaacgtcgggattctcgagctcgagttaggtgagagcaagatctcgagatgaaataaatccttagatttccttgcagtccccgggtgggaaacttctccacctcgggtagcccttaggcttttacggtcgagcgggcatatgctcgaacttgtaataaggatagcccttaggccttttcaccgtcttcaagtgagtgattcctcaaactcggatagcccttgggcttagtgatcgaatggatgccctactcgaactcaattcacaggttgccctttgatatttgacgaattaatccttgatgccttggtcctaatgcaaatatcataacatcagcggttgaaatgactgaaaagttgctttttgtacgattcccaaaatcattaattggaggtggctgacggtcggccttttggcttcctcagcacgcttaaatgacctttataaatagacagattccacaaccttacaaactttattcccatattgttttcaaagtttcattacccttttttcaatctccttgagctctctcttctcttcactaccatcttcttcattttcttggatctttcgtattgcaatggctaaaacctctaaaccagtttcccaaaaggaaaaagcttcatcatcttctcgatcgaccaagggtaaaccggaagtgcctcctcgtatcgaggagtgtattcccccgccatgtgaaataacatctgattttaaaatcaagaaacctatttcaacactaggccgatgcgagcccatgtctcgatatgtttgtctggtgaccaaggtcgagatcaagaaagtaaaggaggattgtaaatgggacaataaagaaatagtgattccatcctccgaggaggacatcaccacgtataaagtggggtacctgagcgtatacacctacccatttacgttgggacctgtaattccggctaagggtcccatagatccaattattcttgacttttgccaatgataccgagtgacactcggccagatctacccctccttctagcgaatcgtttgcttaatcaggttcttttcgagccaaatcgaggggatgtcctttacccttgatcatctgatcagactgtacagttccgacttcatcgtggcggcttgataaaattgcaatgccgatcattaaaatctttcttcgctagtatcgatgaggacaacgatcatgggtggattagcctgtttgtccaagtcaggacctccgatcttatccctgccgattggatgccgttcctcaatgagtggaacatgaaacatgagtatgcaaccggtttataccctgcgatcttttcttttccctggctttatatttttcattggtctaacctctttacgatggtgcaactgctgcttggtttctcggtggggtcccgggcctcgagggctgggtccgaaagtttggcctccgtctcctcttactcgaagcgctgctggcgatattgggctaagggtcgatgggaggccaaaaaccatggtgagctcttttgtttgttttcttgtgcttctactatgggatactgatcttagttttatgtaggccttggagacgccgttgatttgcggtcgaccccagttgatgaagtggaggttctgaagccttccaaagaacggaaaagaagaaaagagacatccgataatctctcgaagccaaagaagagcgtggattgaatgccaaaggacgatacaatgaccttatctccggaaatggcccaacaccttcgggagcaggaggaataagaagatgatgactacctgctagtaacccgcgaaaaaagaaaaatgttgatgctccaaagcccatcgacccggtggcggttgatatggctcaatccagagccgaagaaatttcttaggggagttcaaacatagtccccgaaccatcatccagaaagaaagcacctcgcctaggagatcatttggagggcgaggccgaacgacctgaccctgagcctcttcagataagagaaaatgccccgagtggatcacttggggtgatcaacgtggatgattcgcctcctggcctcgatttctctgagggacaaatccgaaatgcccataatatgaggttttctaaagtggaagcaagccatgaagggcatgacatctttcgagaatgtctcgcagggcttgaggatggtcccgaccccgatgcctttttcatttttgatgaggctcgtagtctctttaaacaagtgaatttatgcctgcacctttgttacttcctgttctgaatctatcttttttcctttttcatgaaggttgtggtactccataaaagggcattttccacgtcccaagttgatcttgctcgatgcgaggctaagcttaagatgactttggaggagagggacatcgtcaaagccctctatgctaaaaaagagatggagatcttcgagttgagctaaggtaggcatgccaaggtcgagccgagtatgttgagaaggtaacacaactcttgaaggtctgttacatacctgtttattttagcgactgacgcttttaattttgcagtttcattagaaggccgacttggaggtgcagcttcgggagcagcttaagatgagagaagctgagaccctagggtagaggcaaggcatggacaatctcgcctctgagaaggaaactctaagagagcagttggcttcgctcgaacaccagcttcaaggtgtgaaggaagaaagcctaaatcggggcctcgaaatcgaggagcttaaagccagatctgctgctgagttggccaaggccaattctgatgttgcgacaattatgtcttcgtatcgagctggtgtcgaagctgctaatgctcgggcaagggagatttcttctacggtggaggctaagttatcaagtgcccttgaccatgctaggcgacaaccccggaggatgaccctcgaggagatacatgctcgcggcttcgatctttcagccgatattgaagcggagaagattttgaaagaagaggcggccgctctgattttcgatgaagatgatccagctagtgtttctgagcgtgaaagatatggggatgaggttcccgaggatgaggctccccaagatgcgactcatgaagatgcagctgctgaggatgtgaccccgaagtagctttatgtcactttattttgttttcttgtaagcctcccttgtataaatatttcctgtaatcaccttttggaaatacgatggaaactttttatctcgtctttggttagtgttggatttaacattgcctttatttatggaagacttcgattgaatgattagttcgaggatcggtttggggttcggggtattacaaaccctgagatctttatcgatagtataataattttttagctgagtttaaatcgatccgttatgagctcgggatattgtgaacctcgagtctatatcgaaatgaaagtagagtctcgaactgtaagtttttggccgttaagcctttcgagattggcccttaggctcttatatatcggtccttaggcttttttttaagctgccccttaggctcttgcatatcggcccttaggatattttaagctggcccttaggctctttatattaggccgtttcggcctctaaaatggctatataattttttcctcatttcggttaaaagactctagtgaaatttagttatgacatagcatgtatttttgtacccgttcggttttctgaaggctcgacgtattgggaccttttagtcatttcgtttgtgtaggcataatcaaatgcctcttgaggtattttcgaaggctgaatttatcaaacccctttatattttgcttttgccgatggtagcctgatttaatcggtttttacaaagtgtttgaatgcctttaatttatagcggaagtcggacgtctccgagccgcattatctccgactttataccaccgtagtctttagtatggccatagcctttatttgaccgtagtctttagtatggtcatagccttcgggaacgtcacttggacttgtttcccgataactttccaaacttattcgagaagttagtccccgagaatattggacttggcctttgtttcgagggggtgcctctttgaggtcttattaatccaaatttttgatgacagtccccgagtattcggggtgttgctatgctttgactcttaagttgttcccgtgggatgtagagttcatgtaatggtagacgtctttgaaacactaagtgttttttatattaacaaaattggtacatttgtacatactttgttgtgggggcttgactgatatatggacattattcatctgaccgtttggcttattacaaagttttcctatcgaggttttcttaagcatgaagtattttccttgaaaatataacctccgagagtgatgccccccccagtattcggggttgattaaaaaaaaacctggatattgtcgagttttccttaggcgacgcatagttgttgcctcgttaaaaccttgccggtaaaacccatttgggaaaaaatccgagccaaggaaaaaaagtgcaacgcatgctttaaagcctatggtcttcgtgtagaaatgggtgtcttcgagatcgcgggtctttgaaagcttctatcatgccgagcttgtaagatcctttaccaacggctccgaggtctcgctattcatgatcatagtatcttccagagccttgacctgctcggggatgattcttaatgccatgatttgacaccatgagcccgagaaactcactcttgccaactctgaaggcacatttctctaggttgagcttcgtgccgcgttgccccgaaacgttggttgtttcctgcaaatgaattaaaatggtcctctgctcacagggacctaaccagtcatatcatgaatataagctttcgttattttacctgtttgttcttcgtacatccggttgactggatattgatacgaagtttttcgaactaggggcctccctttttgctttactggtttgaacctggggctgttgctcagtctatgcgtggtgatttaaggctaaatccctgtcatatctgaacagggccaagcaatgcaatctatatcatcaataataaacaaaatgagttcctcgagcattttcataatagcggggtcagtccccgagtcattttcatcaggcctcgtaggttctgcatgccgagtgttcactagttcggttgtgttaagagttctgttctaactctgaagctgagcgatggcaacttgctaagtttgcagcatctcgtatatcacttggaggctgactcctccttcttccatctctcatgcttcttggcctcctgctcggacttccctgtgtgtgttccttgcggggtctgtgcctgcgtccgtatttagagcgttgtgcgaactgatatcaactggctccacattcagcactcccttagcctgaaatcaacgaatctttgacaagaaaaagtatgaagaataatgtgtgttatcagaaaactagcactaaaataatcactattatctttagccccacggtgggcgctaaactatttacctcgaatatgggggtaacaataaaatgtgatttgtgattttaaagatatgtgatttgttctaatactaatgaatatacaactaatattaagtttaaatatgaagaattgatgaactaaaccaatgttgctataacaatgaggaccccgagcttgactttcttggggggctcgaggtcagctaagagcaatgcagtatggataataaagtaaaagcaataaagctgaagaacagttgttgagtgcgttaaacaagaaaagcagagtagaatattctattgcagtgaataatgtaagatgatccttacaaaataattggggtcccctttatataggaggagaaaaccccaatgtagtacattcctaattttagtaaataattatattggtacagctgtataacaacctagtacggacctgtactatttcgtacagatcttatcctataatttatgccctgacccacgtgtccttgagaaattcccgatctttcttgagtgccctcgagattgccctgccctcgatattggtcgtgtcaggccttcgatacgcttcctcgaggtgtgtgtccctcagacgggtccgaccgctacctccagccgcccgaactctaactcatagcccaattcaagacttcgaaatcgggctccttgattttgaccgtatacacttatactcttaatatacactcagaatgctctcctttccgaatttcccaattttttttaaatggttacttagttaaagataaatatgtgagtgctatattacgttagctgacatttctataggagaagttcacgtacacttacttatggagccactattgaaattatactcgcatttcaaaattatccgccagaatttgaatttcttctatcttttcaatgcaattttagaataagatctaaagttcttttattttttaagtgcaacttcaaaaactgaatctcaagtacttctatcattccaatgcaacttcaaaaaaaaatcaaatcttaaatatttcaacctcttcaatgcaactttagaaaccaaatcttgttctgaaacataaagttgttattcgaatttcaataattcaacatatgattcaatgtccaaatctgctccaaataaactcaaatttgaaacataactttcacatatcattaaaatcaaagtccaatcatcaaattattaaaacaacaacaaatctaactaacttaagcacaacctacaatagtgttttgcaactacgaaaaagaagaaaaaaccaaacaactcctagatacaagggacatgaagtcatgaatacaaaaagaaaaagatagtattgaatacatgaaacatgaatatacagaagatgcaagcatgaccacataggatgtcccatgaaatttttacgatttctacgaggcagtagcgcatagatttctcaaaaaaatatacttatcattttgctgagcatgtttagcgatgaaacttatttcacttttttcgaaatcagtgttttaccataaaattttcaacttttacttgaagatggattttggaatttttctaaaatttgaaaaactccaaaaagctatttttcaaaattttcactcagatcactcacaaaattcaaaaaacaacccaaaattatattcatgtccaaacacagctctaattttcaaatatcattttcacttgaattttttttcttcactttcttttaaattttacaattcttatgtccaaacgcccatgttgtgtcggtggaagtcgggagaaattcaaagatagccagatttataagtggtcattcaaaaattgccatagtttcaaaagtaatcgaaatttagcctcttttcatgtaaagataaaatctaaatgaaaacactgttcaaaatccagaagatactccagcataatatattggaattccagcataatatactggagttccagcataagtatatactggagttccagtataatatactggacttccagcataatatactggagttccaatataatatatcggtccagtataatatgctggaagttcatacacatgtgttccaatctccaatatattatgctggaactttctgcgtgttggtgttccagcataatatgctggaagttcatacacaggtgcaccgatctccagtttattatgctggaactttccgtgttgcagcaaaatagtgactatttttcaatgatttacaaactctggctatttttgaatgatcagtccaaaattagcttttactggggcatttgcatctatatccgctttttgggtcacgttttaacttgtgcccgctttgcaaaaaaaattgaaagcgtacctacttttttgcgtaacttcagcatactgggctgaagtagtaaaggcaatcacgcaaaacttcagcattctagtagacgggccagaagtagcaagtgtgttgaaccaagtgtgctgaagtttttatttataattgctgaacttaagcatagtagctgaagttttgttatatatttgctaaagtttttgtttgtaattgcactaataagctgaagtttttttgtccttgattcattagttttgtcattaagctttttcaaaaacttcaacagaagatgctgaagttatttagttcatttataaaacttcagcactagataagctgaagttatttttgtcctggataagctttttcaaaaacttcagcagaagatgctgaagttatttagttcttttataaaaacttcagcactaaataagctgaagtttttttgtcctggatcattagttttgtcataaaggtttttcaaaaattttagcagaagatgctgaagttatttagttcatttgtaaaaacttcaccactatataagctgaagttttttgaaaaatctttctagcatactagataaataatcagattgccaacaacatctaaatcataatttccgaaacaataaatgtgaaaagaacagaattatcatgaaaagaatcactaagtgtgaccttaaattttccgtacgtgaaaatattcacaaattattgtctactaacttacgtaattatttataatttatttttaaataatctgataaacatacttatggcaatcatcccatgaactaaagttttatagcagcaccaacagcagcagcagaagaagaagaagaagaaaacgacggaggagaaaaggagttgaagttgtttaaaaagtgggtacaaattaaaactttaaaaaaatgggtataggttaaatgggagcgaccaaataggatgccccgtgcaatttttaaatttttacttggaagtccccctcggagcccaacaaatctttgccttttgggcggcccattttagttcacaatctggcccaacgtttgtggcctgctgctcttctttttctctacattgttctttttagttccttcctcactttatcttacctacaagccaaaagttgagctctcaactaagtggctactaaagtgaaagcgtgaaaactgaaaagcatttaaggtttatgttgaataaggaaaagaaaaaatgcactaaaagtggctgtttccgtttaacaagtgtttgaatctaaatctctcaaggtgttaagtgcatttctgttttattgttttacaaccacttaatgagagctagatcaatcagaacagtggcggacgcacgtggtggcaagcgggttcaattgaacccgagttgaacccccttcttcaaaaaacaatactgtgtatatgtataaattacaattaaagctgcataaattttgtataaagatgttatttgaacccacttgacaactactattttacaacttatgtacttctaagattgaacccgcataaaaaaaaacttgggttcgccactgatcaaaagaacaaggattcaaatagcaattggaagtgatattcatagcaaaaggctctttacaataagattttatctaatataatattataactatcaaaaagttaacatttctaattgttagataaagataaattatatatattcatatgtttgattcaaatattttaatcttaaaataacaaattataacaaacgggtccctagctttgatcctgggcaccactaacaagatgatgcaagttgggccaagccaacaacatgctttaaatcacaaagaaaattaatttagggaaaatgatattgtatatccgctcttaaaataatattcgaaaaatatatatttatgtatatatattcatttctgtatgttatatataaaaatttaagaatttatctgggtagcacgtgtatgtatgctgcattggatccataattattgtcacgcatggtctcatcaatataatctttatgctcctttaggctatttcattcccagttttcgagcacaactccacgcagcatctggctctatttacaaaaaggaccccttaacatactttgcaactaattttcaatatatgaaaaagaaactgcaatcataaaataagagaaaaatatttttactactcaaatcaattgtgaatacaattctatttctccttgattcttctctcctgattatctccgtgattcgagagctgaagccgtgtatttctcgaatgtaggatgatacagaccacctgggaatgtatttgatctccagcttcttgaactatttgattgttaaaagcatccggccatattttgatctctttgtgaatattccaatagtttatgggattttgagacaccttgtatccctttatataggtgtgagttagggtttagggtagagtaacttccaagaaacctaatatactcttaggatttcaagagtcctgtagtatctttaatttaggatttggcttgattccttcaaatttcgatatctacaaataccctctacttcaaggtttatcagggtgtaggcttgccgaaactttaagacgagacttgaagtactctaccgtcgcaacaaatagttttgaaacttggagttttcgatttacaggaggaagagatgaagggcagaactggtccaactgggcgtgccaatttgtttgcaacaaatttatgcagagaaaaataaaactgcaatcacaaacaactataaagaaaaaagaattttattgataaacattgtaggttacaactctgtttatcccttgattcttccctctgatttattatccataattccggccatattttgatctctttgtgaatatcccaagagtttatgggattttgagacacctcttcaagggaatacatatccctttatataggtgtgagttaggatttagggtagagtaatctccaagaaaccctaatagattcctaggatttcaagagtcacgtagtatctttaatttaggatttggcttgattccttaaaaatcgatgtctacatataccacgtgtgatcgaggttgtttggttgggaaacaagctatttcataattaattatttcgagattagttatctcatcaccccataaggataaagaaacactacattcccgggataactaatcccgaaattagttataccacaattttatcccaaccaaacataggataaactcatctcaaatttaatcctaggattaattatccctcgtaccaaacaagccccttaggctcttagctagctcctatggcatggaaataacaaggcattttttctcttggatcatgtagtataacactaattttagagcaacattcaacggtaaagaaaattaagatagatgtgaggacaaattaaatcaaaacagtgcaactgactcatatcattggcgagtgattttcacagctacaagtttagtaaagccccagttcttctgtattgcagttcagttgaatgcataataacaactagaagcaaacaattgcagaaggatcaactaatacaatcctagacaagaattctatatcctaaactaaaagaactcaaagtcaagatatttacccccaggttttgcatctgttcccaccactcttttactcgtattgccaaccccaagagggttcacttgcccaaactttgcaggaagctccgcctcaatgggtcttggcacttcgggtggcgtactgcaacgtatcagagcccaattaacgccttcaaagaaaggatgctgcttgatctcagttgctcctcttttcaccccaagtcggttttgaggctctttaacaagcaagccacgtatcagatcacggctggcataactggttgcaggagactctggaaacctgagctgttggcctactacattgaaaagagttgccctgtttcctgatcccttgaatggggtcttaccatatagtagttcatgcaggaaaataccaaatgtccaccaatcaactgcactgccgtggccttctcccttgataatctcgggggccaagtattcatgagtcccaacaaatgacatagagcgtgccgaagtaggttctgcgactagctcaggcagtgcattagctggaggcccagtctcggctcgaggcttaggtgatcttttcttgcttttttgattaaatatacggggaaggaagcatgctggttgaatgcatacagatgtgggctcaatacatgctggctgcacacagaatgcggctccttttttagaaggatcgccagacgatgtccttatgagcgtgggtgaaactgcacatcttagggataggtcaaaatctgaaagcataatgtggccatcgtcacgcacaagaacattttcaggttttaagtctctgtacacaacaccaagcatgtgtagatattcaagcgccagtagaacttctgctgcataaaacctgtggcagaaacgcggggtttgttaaagtttgattaaggaactcaacagcttaaacagaaatgtgagggtaaagattctaaaatctcccaaatgaagaaaatgtggaagattgttagcacgaaaagccctttaataatattagttaaccagactttaataatatcaatagacatgtcattacatatttaccaccttctcttcttaagacccaatgactggaaaaaacttccaagtaggatcaaactatttggtatgggaggatcccaaatatggattgagtgggacaaacatcaaaatccaagagtgataaatatctaatttggtctgagttgatatgacatgggaaacaatcacttttttttttggcaagtaaaggtgcaattaatggcagataaagaaattctttttgtggacgagagttaataaaaaaagtcatattagtaaccatatcctctacaggggagagctttttgtttgtcagggtaccaggctcgaactcttgaccgcatgaagaggactctctcctctacaggggagagcttacatgttcagaagtcagaacgatggtgcaagagaaatggatgtgataaatcataacatctaaggaatgccaaaataagcagaggcttatgcttatgtcaggactacatgtgaaaggggaggataatttttatgctgcatattctagttctagatagaatgataaaagcataccttgcagcatattccgaaaaatgcttcccaggttgtcgctgtcgtagagtatgtaaatctcctccaggacaatattccatgaccaaacatgagaagcgatcggtctcaaaatgagtgtacaaggttggcaagaatggatggtctaataactgcaggatttctctttctgtctgagcacgagtcagtttcttcctgctcgcaagtgaagccttatccatcactttcattgcaaaatagcagcgagtcccgctaagctcagaaagataaacactgccaatgtctccacaaccaagtcttttgagtaacctaaagtgactcattcctaaaataccatcacgtgcccgaatcgcgagaatagccttccatctaggatcatttcctttgtgaggcttattggcactgccagtaatgttactccaattactatcatcactaagcccactgctgtcacttgctctgctaaggctagttttaccgctttcaagtgaatccccacgaatgctcccttttgtgctctcatagtttctgtccacactaagcatgccatcgctcatgatcacatcactcctatacgtgcttgtgcaactgttgacaatgctcatagatctcaccacaccagtactatcaatgctactaagtgggcttacattgccacttggaggcagcgatgcatcccaaatacattctttctcttcggagtcaggaggcagacttgcttctgtgttttgagatggacgaggaattgtaaacggagaggagattacactcagatcatttggctcttcaaccaagctctctgcaggtgaaagaagagatgggctcggtttcacattaggaacccggattgaaagatcatctaggaaaggacccttcaaagacatgcttttcactaagcatttcccatctgcttttttctgaccaatgggtacgtacactggtctcattaggtctgtatcaacaggttccggaggatgactcgctccatgaaatgaagtagagccactgtcttcaagtgaatcatcactgcgcttgactgaaccagcatctatcatgagttcctcttcctcctgatacgaggtctttcctttccatgtttgtctcagaacagacaagtcaaaatctcggaagtcctgcacattgcatttaacaccgatctccttcctggaagttgaaaaggcatgtgtcaccttagcctctaaagggaattgcctcggtggttgttttacttcatgtatcctttccatctccggttactattaacatcacaggtacctcaccagaagaaagctctgaagaaagcgcaaaaatcagtaaaacattatccacacatgattgtactacaaatcaaatctactaggaccatttcaattacaagtattacagcacatgaaagatttctttttcactaaaaaggtcttcatcctctatgaacacattagagtaaacacaaccacattacaaaatcttcaaatttcagaattttaacgcgcagttttactatgtgatgtggtaagtaataaagatattttgtagtaagagacatccaattaggcaaatattattatttttacaatcaccaaaatattccataattttaacaagttccattaattacacaatgagataaccctcaagaagctctcatagaaaaccttaagtccccaagtgacgtgacaatcaacttctaagaaaaccatagcccccctaaaaaaaaaaggaaaatagtgctaaattaactgtgtttctcacatttcacagtaacactcaatgaagcatcagcagatctagctttcggctcgattatataaaagtgaaaaaagaaatttaaaatgtgaatacataataaacgtgcccactgcccactttaataccactgtctctatattgggtggaaatttttgccctaaacagcggaactacttcaaaatactagaaccaaaaaaagagactcaaaaatgacactcccattaaataaattaaagaaagcagaaatttaccagtacaataggagatctgtaaaatcctcaactggttctttattttcaagctagagctcctactatacttctttctctgtgtttgttactctctcaaacagagcatttgatttttttggcagaaaattgatttattgttagccaaacgttgatgctatatggctctacaggcgaaaacagaaacgatttggcttcagtggtgaagattttggtgatttggttgcctttagctaggtgttgttgtatttggtaaggctttagtcatgtgttcactgtcatatgaaaactgatgataacacaaaagtgaaagtgtgtgctttatttatttatatttattttaaagaagaagaaaaagagggagaggttgcagttatgaacttgggtattgggatgcacacatacacaaaaattgctatttccccactttaactactctctctggtccactcttaattacgtactagtattcatatccgcatgttatgcgaaaaatgttatatataatttttcattagaaaatattatttaaaaaatataatatacacaaataaacatgtaatgatattattttatgaacatgtaaatgcaatcgatatccattgttttgcttcttctataatttatttattttttaaaattggaagttctcatcatattcttgtttggtatagatagattttgcttgtttaaaattgaaaattttctgatcatcctctccttgttttgcctctcatattatacaagatatatttttttaaacaaaattagaatttttttttttggtgatgcacttattatccgatcattgttttgcctctcctattatatataaataaaaaatatagattttattttcaatataaagttttaatttttatattttttactatgttgattgtgatcatttcattattatatcttttattttgtgtgaattgataattgtttgactcaaaagatattgaaacttttttgaataaatcaatcaaagaggaagtggtaaatcgtagtcaaacttaattgattccagaccaagagatttcataataataaatgtgtatgggatgacgaaaatatcgacaatctcattaagattcaatattgccttcttcctcagtccctgaggaaagaatattacaattgtttttttatgtacaagatacaagaatgaagctttgttcttattttccttctgtggaaaaaatggagagaagccttccccttgaaagccttcctgggttatatatatataattgaaatccattcaccctcaccatgaattgacgcgctcgggccagtggtgcgttctggtcgtgattccaggcgttgctcttttcgatttgtcggatattgtggaggagaaatgaagtggactctattgacttcattacccgattgctaaaaagggggtcgtgggcaacctggtcgaggtggtcatattttgaccaatacaattagtctctccatctgtcggggccatcctttatcgggctcgacagatggatcatgtttgcaacgtagtcgagaggaatctgacccccaactttctgttccttagtcgtgttttgtggactttttggcggagtggaggttttgtttcgatactcgtggaccgttgcgatgatttcgaaattgaaacgtcggttggcaatgaagcgttagttcgtggatgccaccattatgacacacatacctgggaaattgaaacgtaccgtgccctatcggattcaaatggtgactcttgggtttcgtgctcggggaatttatgtctcttataaataggggaacttgtcatttgagtaattcacttcatcattcgtttgaaagagttcttcagatatcactttttcttataccctgaattcttgcttaccttcttgctcactacaacttttaatcttttcttcgtatcacttttttcggagagttttctgctaaaaatggctggcaattcttctcgtgataattttcctgtcgttgatccggtaacagagagctctgttcaggccaccggagaagtgaatgtggtagaggatgaagagattccctcggtagataaaattctgcctcgcctagggagggacgcgactgacttcagtttcggcgatagagcagagctggaacacgtcgcttccgttgtgagggaaaggggaattgtaaagttgagggaacggtggggaatctccagtttcgtcgagatttggctggcggagggggacgatagaattcacttcgaccgccccggatattgtgtgttctacgcctaccccttcattgtagggtactcacttcctctccccatgttggtggtagatttctatcgctactacgaggtgtgccctgcccatctttctccttttttgtacaagttgtttcttatgctactcaaatatgcggaacttgccggtcgtgaggtcactttgagcaatatgcttagaatttttgctccacaactgattcgaggtacgatgattcatgcgcgtcctcggggatcaaagggtctagtggtgaagatggacgatagaactaatcgtcgtttctatgaaaattacttttatatgtggaccgagcatattgtggcggacccgactggattcctcgagagatggaactttgcgcgtaagtttgcgtctttaattaatgaaatgttcgaccattttccgcgaatgctaaattgctttgtttttctgcagctgagagattgcccctgccgcctgttgaagggattcgcaaatgggtggaggccattcttcccacacagtgggagttcgtacctggttgactttccatgagaggtttggacgcaagcctcttacaggtgagatgatgtccttatctactatttcctccctttttttgttatttagcctcttatgcatcgttcgtcattgtcagggagggtgcggagagcaagggcccctcagctagcctttcgccagccggccgcatttgctcgtcttgtcctgtacttgctgcacgcccttcgtcgaaggctgcttcggttgaatctgcggccttggttactctagcgagggccacttctcaggacgaggtcccgactagtgtcgtccgtcctacgaacgagtcaccgtcgactggggaagaggaagggccatcgaagagacaaagagtagagtttgagatggcgcctccgacagtgattcacctggatgattctccactgacgggcttaggagaaggtgttgttgcggcgtcttccctagaggcaaagcggattgttgaaattggtgctggcggtcaatgctcggaaactccggctgtcgccatggctcagccagaagtccttgctgttactggcgatcaacgccttgtcgtggtagagaaccagacctctggcgccgttgttgtgatttctgacgtgccctcctcttctgcagcggatcgtgctcctcctttaacagcagaaaggggaaaaggcatgatggttgacgagtatgagtccgagtcatacctggatcctgataatgtcaggatgttcgaggagggccttactcattcggtggttcacgcgggtggatcggctcacattcttcagatcccttctagcgttaacctcttggcggagggggaggatctggtgccgtaatttagccttttatgtttagaagctgagaatgagtcccttcgagatttccccgatgctgagttgagggatgaggtagccgtcatgggcttgagggtacgttacattttgtttttgctttaggcttttcccctattcgaaagtattagtttaacctcgtccttatgattttcagacatacatggtagaggtagaaaacatttgcagggccaacgtccggacaaggactttcttaaagatgctggagaagtatcgtcgctaccgcgacagatgtcacgatatgcatgagcggctgaggacggatccccgtaatcaggttctcgataaggagttcaaaaaaagggaccaggaattgatgcaaacgatccgtagtaagtgcgaactcgaggagcagcttcgcatcaaggacgaggagctcgagttgggcaaggggatcgcggcggagtatgagcatttgcagggtaggttgaggtcaatgcagtcagagatagaccagaacttggtcaaggttgaggcgatgtgtacagagtggatgaggaagttgaccgcgatggagagcaaagtcgtcggtttggagaacattgagagtgcttggtctgaggctttggcgacggcatcggccttggaggacaccatccacgtactccaatctgaacaggagtcggagagagtgacagctacccttagggaggcaaggctcgaggaacgcattggaacgattgatcaggaggcgtcgattctaggagatcgagtcacggccttggaggcgaaaaatgcatgactacaggcccaggttgcgtcatcctccgctgtcgttcctcgccaagtgcatgagctctgggtttatgctgaagcccagcgggacatctataagagtttgtaggaggcgggcaccgtggctgaggctgcttacgaggaagcgcgagtgaaggctcacgaggctcgcatcaactgtggatacgatgcggcgacacccgaagccaataggggtgcggatgatgataatgatgagcctcgtggagatggtgacgatagtggcgatgatgatagcggtgatgacgccgaatgaagagtgatgtcctttgtttttatttttattttatttgttgattgtcgtctgttcgttccgtcttctttttctcttcttctttcctctttttttttattggttggcctgggccatatgtaagcggcgatagcccgcactatgacattgcttaaataaaagtttccttcttcgctatttgccttgtacttcactttttattctgattgttcatggccttagagcgagatagaggctcgcccaacgagtcccggtttttcttttcctctggtggtggtcaaactcttttcctttttggtgaaggctcttggccttaaagggagttatttcgaacttatcgaaataacagcccgtcgttgttcgagcaaggttgagccttccttttttctttaacggcgaaggctcttggccttaaagggtattatattgaactcatcgaaataatagtttgttgatgttcgagcaaggtcgaacctttccttttctttgatagcgaagccccttggccttgaagggtgttatttcgaactcatcgaaataacagcccgtcgacgttcgaacaaagtcgatcttttcccatttctttgatggcgaaggcccttggccttaatggctgttatttttaactcatcgaaataacatcccatcgacgttcgagcgaggtcgaaccctttctttcgtttgatggtgaaggtccttgtccttaaagggtgttatttcgaacttatcgaaataacgtcccgtcgatgttcgagcgaggtcgaacctttcctttttctatggtggcgaaggcccttggccttgaagggtgttatttcgaacttatcgaaataacaacctgtcgatgttcgagcgagatcgaacctttcctttttctttgatggcgaaggcccttggccttgaagggtgttatttcgaacttatcaaaataacagaccgtcgaagttcgagcgaggtcgaacctttcctttttctttgatggcgaaggccattggacttaaagagtattattccgaactcatcaaaataacagcccgtcgacgttcgagcgaggtcgaaccccttctttcgtttgatggcgaagcccttggccttaaagggtgttatttcgaactcatcgaaataacagcatgtcgatgttcgagcgaggtcaaacccttcctttttctttgatggcgaaggcccttgtccttaaagggtgttatttcgaactcatcgaaataacaactcgccgacgttcaagcgaggtcaaaccccttctttcgtttgatagcgaaggcccttggccttaaatggtgttatttcaaactcatcgaaataatagcctatcgacgttcgagcgaggtcgaacgccttattttgtttgatggtgaaggccctaggccttaaagggtgttatttcgaactcttcgaaataatggcccgtcgatgttcgagcgaggtcgaaccccttctttcgtttgatggagaaggcccttggccttaaagggtgttatttcgaactcatcgaaataatggcccgtcaatgttcgagcgaggttgaacctttcctttttctttgatggcgaaggcccttggccttaaagggtgttatttcgatctcatcaaaataacagcccgtcgacgttcgagcgaggtcgaaccccttctttcatttgatggcgaaggcccttggccttaaaaggtgttatttcgaactcatcgaaatgacaacccatcgatgttcgagcgaggtcgatcgcttcctttttctttgatggcaaaggcccttggccttaaagggtgttatttcgaacttatcgaaataacagcccgtcaatgttcgagcgaggtcaaaccccttcttttgtttgatggcgaaggcccttggacttaaagggtgttttttcgaacacatctaaataacggcccgtcgatgttcgagcgaggtcaaaccctttctttttctttgatggcgaaggcccttggccttaaaatgtgttatttcgaactcatcgaaataacagcccgtcgacgttcgagcgaggtcgacgttcgagcgaggtcgaacccttctttcgtttgatggcgaaggctttcgccttaaagggtgttatttcgaactcatcgaaataacggcccatcgatgtttaagcgaggtcgaacccttcctttttctttgatggcgaaggcccttgaccttaaagggtattatttcgaactcatcgaaataacggtctatcgatgttcgatcaaggtcgaacccttcctttttctttgatggcgaaggcccttggccttaaagggtgttatttcaaactcattgaaataacagcccatcgacgttcgagcgaggtcgaaccccttctttcgttttatggcgaaggccctaggccttaaagcgtgtcatttcgaactcatcgaaataacggcccatccatgttcgagcgaggttgaacccttcctttttttttgatggcgaaggcccttggccttaaagggtgttatttcaaactcatcaaaataacagcccgtcaaccttcgagcgaggtcgaaccccttctttcgtttgatggtgaaggcccttggccttaaagggagttatttagaactcatcgaaataacggcccgtcgatgttcgagcgaggtcgaacctttcctttttctttgatggcgaaggcccttagccttaaagggtgttatttcgaactcatcaaaataacagcccgtcaacgttcgtgcgaggtcgaaccctttctttcgtttgatagcgaaggcccttggccttaaaaaatgttatttcgaactcatcgaaataacagcccgttgacttccgagcgaggttgaaccccttctttcatttgatggcgaaggcccttggccttaaagggtgttattttgaactcattgaaataacgacccatcgatgttcgagcgaggtcgaacctttcctttttctttgatggcgaaggcccttggccttaaagggtattatttcgaactcatcgaaatatcagcccgtcgacattcgagcaaggtcgaaccccttcattcatttgatggcgacgacccttggccttaaagggtattatttcgaactcatcgaaataacggtctatttatgttcgtgcgatgtcgaacctttcctttttctttgatggcgaaggcccttggccttaaatggtgttatttcgaactcatcaaaataacagcccgtcgacgttcgagtgaggtcgaacctcttctttcgtttgatggcaaaggcccttggccttaaagggtgttatttcgaactcatcgaaataacggcccatcgatgttcgagcaatgtcgaacccttccttttttctttgatgtcgaaggcccttggccttaaagggtgttatttcgaacttatcaaaataacagcccattgacgttcgagcgaggtcagacctttctagtttatagagggtctggcatcctctgtggaagtcccagtttgtttggtatagcttgcatcagttggttcaacactggtggacacgaggcgtcaacgtttcgcataggcttgcgctttgcgcgcattatacttttcctgtcttactccggtcgttcagctcggagatgctgccggtagggagggcttcggctgcatcgaagtgatttttgttcttcaatctagatgtccttgcgtacattcgtccacgcggatcttatgtgcttaatttgacgaagtgtgagaggtgagggtgagatgttctttgctcccgtccagtggtccggtgggggaggggggttggattgcaacatcgtttgccttgtttaggatattcgcagctgatggggcgaggaattccaggtttcatgaattcatttgtttctccttccctcaacgcgctattcccatgtctcgcgtgagttagattctcctttcgtgcttctcttggtgaatgattgtgtttctcggctttgatctgggaaaaactaggagttttcactaggaaatctccacagacggcgccaaattattttactcaaaagatattgaaacttttttgaacaaatccatcaaagatgaaggggtaaatcgtagtcaaacttaattgattccagaccaagagatttcataataataaatgtgtaggagatgacgaaaatatcgacaatctcattaagattcaatattgtcttcttcctcagtccctaaggaaagaatattacaattgcttttttctgtacaagatacaagaatgaattcttcttattttccttctgtgtaaaaaatggagagaagtcttccccttgaaagcctttctgggctatatatatacaattgaaatctcttcaccctcagcgtgacttgacgcactcgggccagcagtgctttctggtcgtgattccaggcgttgctcttttcaatttgtcggatattgtggaggaaaaatgaagtggactttattgactttcattacccgattgctaaaaagggggtcgtaggcaacctggtcggggtggtcagattttgaccaatacaataatgacatgtgaaatcaaaataaatagggaaagagaggagaatgtattttattttttaaattaattaaatctataatatatgtataaattagatatgtcataaaatttagttaaattttacatttgaagtgcaaagtagaatgttctatatatatcacttggcttgaactaagaatgactatataattacttcaaacctagaggtgatgctgacgtacttgtctgtctatctatatgttcaaacgccattactaatgtcaccatttttttttttggaaacttaattttagggttgtggaaaattaatgcatagacgcagcagagaagaaatacttcaaaaatatgtgaaaccaaaggaagaatatgttacctttagttttcaaaattgttatatcctctgtgaatagccatattttgcaaaagcggtatgttacaaccaaaatccaaaatgatgtttagccataaatgatgtaatgacggccaacgtcggttggtatcacagccaaaatcaaagttgtgggtatgaagtttctatgcaaacctctcttgagtttgcaaatgattaccgagtaatggaagtggatgtcatgggtttcaatcgtgatacgctggaggttagatagtttagaaaaattttaggttatggagagaaaatttaggaaataaagtcaacttttatttttctttagagaaaaaaaaacgcgttctttaattgtgccatgtaaaatcagttattgtttaaaaacttaaaattcaggagaaaaaaatgtgtcctttacttcttctttttttaaataaatttgaaactccaacaaagttggagaattgtccaaaaaaattacatgtttcaatttaatattatgccacttgtcttaatattgtgcttttgcctctcctattatagataaatagatatttggtaatttaaacacctacatgttttttatatataaaggtaatttaaacacctccataattagtgaaattgtacaaaaattaaagcatataaagtatcttgaaatcttccatgtaggtgattccctcgttaatacgtatagtacgcgagggaatctcaataaaattaatagtaaatacacttgcgatgatttcacataaggtatgactaaaatataaaaagtcgattgtttttatcttttctcaaataaaaagagcaccaaatgcttgtaataaatgaataaataattcaaaaattcagaaatatattttcacaaactatctatctccctagcaaaaggtcttgctggactcaaagcataaagattatggttaaacatctaagttttatactaaattgaattgtgttttttaaactttttaaaatgagattacatatttagaaacacattaaaacattatataccataatctaggtatagcttaaaatatcgaaagaaatttacaattaaaacggtaggtgacacattgttttttgttttattagaaaaaacaaaaaagtttttggggtttaaggaggggaaatagcaaaatgggggatggcagcaagaaaacgacggccggaaagagaattgatggcgtgatgaaaaggaagagaaactagaaaaggtgggcccctaactaaagtttcttcaacgttggagtagggcctataagtggggtccacctctgttccttctttagagtacacgtcttttcaaaggaggaagtagaattgaaagccaataactcattctttctattctctgtcatgtccaactctccatccttttcaattaatttttctcaactctgattttaatccctccttaatattagtaaggatcactgtcaattgcattattatatagtagtatatttttatttattaagataaagccctaaatttaaacaagtttttaggaataaaagagattaattaggggggtccgggggatatggaccccatccccattgataaacaatgcattaattaatctcatgactctcaagtctcaccactagctctcatgtcatgtggtactaaaaagggttttctggtgggaaatcccaaggtctagttgtgtttttcaaccacctaaataattgaatagataattgttcaaattacaaagcatcttcttttttaacttttgaaatgttgttgcggttcgttaagagagacatttgaagtcaaagcaaaccaaaccagcttgagggagttgacaacactgcgaggttgtgttttcttgatcgagaacaataaaagtatttatgttcatatgtaagaaataagaaaaacataaacaataagaaaagtgcagatatataatttgtgtgaaggatttattatttgagaactttgcaataacgaacttcacagatttactgaagttaagtgtatgctaatcagagcgttgattttcagtttctaaggggggaaaatctatattgattcaataacatgtccatacacattctccaattgttgtcttattcgaatgttgtgggtgatttaatttgagtcgtcaatagtggagcctagagattcaaagtgctgctgtataatattaatattacttttgagagctaaatatatatgtgtttgcgactgaatattttatgagatgtgtgtgtgtgcgcgcttctattattgttgttcatcccctccctttggctagtttgagctatcatttgcagtctacaaccagcaatattaaacctattttgatcttagggtcttagcttgcctgactcaatctttgacttgttgcggctgaatgctaattagggatacctcaaattcctaaaatgctcccctagtccccgagcttggtaaataagaccgtgggaaattgttttcttccggccttgtttttatagaggggagttactcttgcgttctctctcttgggtaggtcagtttcgctctcttgtttgtaagtatatccttcttttccagctatatcaaactgtttcacctcaaaaataggttaatcagttaatcagctatacctcaatatcaaactatatggaattagtcatgtgatacaggggcggatgtagagtttgaccgtcgggttcatctgaactcaatacttccaatatgaagcataaatttatatatatatatatgaattcaataaaattacaacaaatgataggtctgaacccacaactttaaaaatataatggatttaatgctaaaaaccttaaaagttatactcataaaatttaaatcctagattctcttgtctgaagtgatactcggtgattcataagagatatttcttgcgctacttgtctctgagaagaatcgaatgtttaacttggtttacaagttggaatttgcttgcaagttagttacaattggcattgagtacatatctattattaaggggtcgtttggtagagcgtataagaataatattaaataaggtgcattaataatgtaggggttagtaatgtaggggttagtaatgcatgagttagtaatacaagcattagttatacagagattatttcttatgcattgtttggtgtggtgtattaaaaattaaaatgcattgtataatatttaagaaatttaattgtttacaaaaatgtcctccatattctttaacttaagggactttaaggataattttgtctttaatcatgctaatgtatgcattaatagcctttgtatagctaatgtcatgattttctatgcattagctatacataggataataccaaatagagtgtataactaatgcttgtattagttatacataggttgaaaaagtgtaccaaaaaagcattactaatacacaaagctaacgcatgtttgtattaactaacgcattactaacacactctaccaaacgacctctaattctcttgaaatggactatgtcatcttgttagtactaattattaacgctgttttgaggttcaagtacctgtggttaaattcttcttacttaaattaagagtaccataagaggaggggagtaggacgaagtaacagcaataaagagaacaaaagaaaacagacaagagggttaagagacagaggtgaagaagaaaaagacgtgtgagcatgcatgctcaatcactgctgtctgtctagaggcaagtccatgttcggacgaaaggaatgcctgagtctttttgctttgcaattgtagacaaaatatagtcagtggttgcatgcctagcatcctattctttattttgtacctatttgggacatttacacaagtatgtacatcaattaagtcttttccccatgcatgtggctctactccctccaataaaatccagaggcatccaaagatctatgagaacaagccaccttttaatcttgaaatgtttattagaacttcacttgtgattaaaaggtcataattaaaatttcagtgtcgcgagtttaagttttactaacgtcaagaggctatattttattttagatgttttatgtatttttcatgattggataatacgaataatgttttttttttttcgctgcaaaagaagttatgaatattgttttagtgtgtactttgactttactgttaagcaatgtaaattgctaactacgtcacattctccaacgcaaagaactaaataggtgattatgaagctttaaaatgttataaatatattatattatggatgtttatttagtatttcgttataaataagcttcttgaagaaatttattcatatgggactccgccgtaaatatgtttatctatttaatactctattggaaataagccttctaaagaagcttagcatttcggtactccgtaatgggctattaatgaaaaaccatgaaacccgacctactggttcttgtctattccctgaagtgaatgagacgaacttccaccaagctaagggtggaagaggtcgtggtcatggctgtggtcggggaagaaactctaatcatggtaataataatgcaccaaagatctctcttcaccaccagcagtggaaaaggaaggaacaaaagtatgaagcggtgcaagcaacaaatgtagaaaatgcatgatatagatgtggaggaaaatggcactggtcaaagcacctggttgagctttatcaagcctccctgaagaagacaaagaaaaatgttgaagcacattttatttctgaagataatttagaattcatgcatttggatgtagctgattacttagcactcccagaaggagaaacaagttatgtgatcggtaatgaatttatagaaacgtaaatatttaatttttgttgtttgtaatagatagtatggttatgtaattattgtacataaataaaaattatgctttgataatgatgtttactataatatattttgtttatgtcattttgaagaatatggataattttcaaattatgtttagatcaaagatcaatcatgaagatatttgtataattgatagtggaacaactcacgccatatacaaagatgagaaatatttttcttatttgcatagggaaaaaagaaaatatttttacaatttctggtaatataagtttgatagaaggctccggaagagccattatatttctatctaagggaacaaaacttagtatagacagtgcattgttctcctccaagtcccgaagaaacttgttgagttttatagatatccgttgaaatggatatcatgttaagacgatagataaaatgaatatagaatatctttatattacaaaatatatttctcgcaagaagtgcattgtagaaaagttaccaactttatcttctatcttatgttattcaaagattagtacagttgaagtacactctatcgtaaatcagaagtttactgattcaaatacttttgttctttggcatggccgtttgggccatcctggatcaataataatgagacaaattactgaaaattcgagtgaacatcaattaaagtacctgaagattcttacaaatgatgaattttcttgtgatgcttgttatcaaggcaaaatgatcattaaaccatcaccaatgaaggttggaattgaatcccctacctttttagagcgtatacatgaggatatatatggacatattcacctagcaagtggattatttaaatattttatggtcctaatagatacatcttcaagatggtctcatgtgtgcctacaatatctcgcaacctggtatttgcaaaattattagcccaaataattcgatcaagggcacaatttccagattatcctataaaggctattcaccatgataatgttcgagaattctcatctcaagcttttgatgattattgtctataagttgggatacaagctaaacatcctgtagcttatgctcatactcaaaatggccttgcagagacatttattaaatacctacaattgatagcaagactactgcttataaataaaaattgtccactattgtttggggccatgctatcttgcatgcagcatcacttatgcgtctcataccgatacattataataaatattatccataataattagtttttggtcatgaaccaaatgttgcccatctacgaatttttggatctgttgtatatatgtcagtagcaccatcacattgcagtaagataggcccccaaagaaggttaggaatatatgttgggtttgaatcaccgtctattattcactatgttgaaccattgaggggagatttatttactgctcgatttgcagattgtcggtttgataaaactaattttctacaattaagaagagagaaaaagaaaatcaaaagagattgtgtgaaaagtttcatcattatctcattttgatccacgtactcctatatgtaatcagaaggtctagaagatcatccatctacaaaatatagcaaatcaaatgccagaagtatttactgatttgaaaaggataactaagtcacatatccctgtagagaatgtgtctatccaaattactgtcccggcatgaccatctactagcatgagatctagtaaacctaaagtacacctgaagcgtggtaggcctttgggttctaaggatcgaaatcctagaaaaaaaatcaacaaatgatcaaaatgatactataaagggatctcctgaagaaatccaagatctgactagttctgagaatcctgaagaaatcaatgaacccgagactcaagtgaagaggaacttttaataagttctattggtgatgggattaatttaaatcgttctaaaatagtggtggataatatttttgcatataatgttgcacttaacattatgcaagatagtgacaaccttgaaccccgatctgtcgaataatgtggataaagatctgattggccaaaatagcaagagtgaattcaatcagaattgaagtcacttgctaaaagagatgtctttgaaccagtatcccaaacacctgctggtataaaatcaggtggtcataaatgagtttttgtgcgaaaaaaagaatgataaaaataaagtcgaaagatacaaggctcggcttgtcgcgcaaggattcacacaacgacctagagtcgattatgataacatatttacccgttatggatttcataacattttgatatctcatcaagttagcctaacgtcgaaggcttaaaatacatctaatggttatgattacaacttatctgtacgggtcacttgaaaatgaaatttacatgaaaatccatgaaggatttaaaattcctgaaacatattcaaaatctcgaaaaatgtattcaatcatattacaaagatctttgtacggtttaaaataatctgggtgcatgtggtataatcgcctcagtgaatatttactgaaagagggtgacataaatgatgttatttgtccatgtatttttataaagaaaatggattcagaatttgttatacttgctgtttatgttgataacataaatctacttggaactccaaaagtgctccaaaaggaaattaaatattttaagaaagaatttgagatgaaagatattggaaagacaaaactttatcttggtctgcaaattgaatatttagcatacgagatctttatccatcaatctgcctatacagaaagggtcttaaaacgcttttacatggacaaagtgcatccaatgattgttcgatcacttgaagtaaagaaggatctgttccgacctccagaagaggatgaggaactccttggtcccgaagtatcttatcttagtgcaattggtgcacttatgcatcttgctaatgctacaaggcctgtcatagcattttctgttaatttactagcaagatatagctcttctcctacacggagacattggaacggaattaagcatatattgcgatatttaaagagaactcttgatatggatttattttatgctaacaaagatagttgtggatcttattagttatgcatatgcaggttatttatctgacccccataaagttcgatctcaaattgggtatgtatttatatgtgtaggtactgtcatactatggcgctccataaagcaatctattattgctacttcttcaaatcatgctgagataatagctattcatgaaggaagtagcgaatgtatatggttgagatcaataattcattttattcgagaaaaatgtgatttggaatgtgagaaaagacctataattttatacgaagacaatgttgcatgcatagcccaattgaagagaggatttataaaaggagatagaacgaagcacattttactaaaattattgtacacacatgatctttagaaaaatagtaacattgatgtgcaacaaatccgttcaagtgataatccggcagatttattcactaaatctttgccaatttcaacttttgagaagatggtatacaagattggaatgcagagactcaaatatttgaaacaagattttcatgagggagagtaaaataagcactatacttttttttcttactaaggtgtttcccacatggttttccttataaggtttttaatgagacaactagctatgcgtattattaaatatgtgctctatttcctttactataattttttcctctaggattttttcctagtaaggtttaatgaggcatattatcttttaatgaacatccaaggggaagcattataaatatattatattatggatgttcatttagtactccattgtaaataagtttcctgaagaagcttattcaaatgggagtccgccgtaaatatgtttatctatttagtaccctattggaaataagccaccagaagaagcttatcctttcggtacttcgttatggataaatatcactcttggtagaagattatcaatatctggtataataaaaacttacaagcagcttgcacagcaatttacaccgcaactttctttcttttacaaatagaggagaatttagttctttatgtacatcagtttgaattcgaataatatatcaatttctctctatacttgtttttactttatcatttttattttataacataaaagataatgtataattgctttccttgttagttttgcctacttttggatttacaagctacgggcattatggacattataaacaaatacacgaacactccatttgtgatgcttatagtagattagtgggcatattagatgcttgtacagtaagggaattaaattatcaaaggttggctcatataaatatactaaaattaagaaagaaggcctttttggttgttagtgttgcgtcattaaccatatatcttcaaaatataaattttttaagaaactcggtatcaccaatttgaattttattaattttctggttattaacttaatcggtgtctcctcccttattaattttgtaaagataaagtaagaagttacgtatctccactcaaaacccacaattgtgcctactgactggtcaaaaagaggaacataagagaataacagtgaatttgaaatcatcaccaaatatacctagctagtgggacattctatattaaagtattgtcccatgctacttgtcaaattagcacatttacaaaaaggcttttacatcacagagagaaatattaaaataatgaacacaattaagattgtccaattatttttgatgaaacctgaaaggtaactatttcaacagcatacaataaactattttaattttttttttatatacatgcatacacactaacttccccaaacctcgctgtggacctcactgagtcgttattgtatatgcaatactcttcctgcaatagctacacagagaataaaaaagtcaataaacttatttctatcatcattatattgctttaaaaattaggggaaaaaatctaaataaacatacatatatatacttataaaaaggaggatgagaatgtgatgaatgaagtggcaacataatgggggaaatcaagttggtcattcaccaatcccatgaaagctgaaacttatagtgattacaatgattagctcaatatataatagtatgagcaacaaatttcaacataccatagttagtcattcccacaataaccaaaaaagaagtgattagttaaatcatactttttgtagggcaaccccattcctccttgctttttgaaaagaggaaaacatagagtttgaaagtctgagttaggttgtgttggaattaggaaaagaaaaataaaggtatggttttgaaggaggagaggatcattttcttgattcctttctcactttggtatttggtccacatatacaagagctacgaaaaagaaactttattataatgtgctgtttgttgatgtattagctgtaaatcttgcactaactaaggagcatttcattatcttttcgaaatgatgtttatataaaattataagaaatctttatatgcttagatgtttatatcaaattataagaaatcattatgtgcatcaaactgcccatttagttgtatcttcatttttttttttttcacatagttaaactatttgaatagttatctcttggtcgctgtctttttttatgtaattctttggaatttactaatttccaaacaggggcaaagctgcagcctatcaaggttggtcaattgaccaccctccgtcgaaaaattatattgtgtatataggtaaaatattagtttgtagaggtatataacacatattgaacatcctttatcgaaatttttttttgcatttttttcaagtttgaacacccttgaaaaaatttctggcttcgccactatttccaaaatgaagcattagcaagttctagtgcaaagcaacatccttgtttgtttttccaataatttatcttggctccccaaatgctgcagaaactcttctacacggaggaatatggcgttcatatattcaaataatgcaattattagatgttgtttgtcataggttgttattgttagggttatggacatgtattacgtgtactaaatttgaacaaaatgggagatctctagtttatgtttgacttgaccaattatatgtctgaaacacttgtctatataaaagctttggttttggtttttcaaaaaacagaagctccttttgtagcttctagggacaggtttcaaaaatcgattagggaaaaagtagtttgtttggattaggagaataactattgaaacaatgttcaagaaaagcattcttgttaatctcttttgtgaaacctacgtttcgttttcatttttggtttccaactatggtttgctactgcatgctacttcaaaataaatgtaaaagaaagagcaagaattaacggcagattcaatagcattggtcatgaactccaaaacaatagaaaatagagcgttgtatacttatagcctgtttgaccaaacatttaaaatcagcttattttcagaagtgtttttctcaaaatttttggtgaaaaacagtttgtgtttgactaattaatttgaagagcacttttgagcagtaattagtgtttggccaagattttgaaaaatgcttataagtgtatttttcaagaaagtgcttctcacaaaagtgttttcgaagataagctactttttctgtttctcctcaaaaaacacttttttccatctaaaagcttggccaaatatcttaatttttggccaaaaatacttttggcaacaaaaaaaatacttttggcccaaaaagagcttcgccaaacaggctattagactgtcacaccaacaacgagcacaacaaaaccttagataggcatacaattagctacttctctttaattgaaggtttaacatgtagtctctcgcaaaggtttaatggttttgtacaatttgatatattcaaatgaaatgtttctaattgagttttgtttaaatagatgagaaaaatcttactccattccctacttgaacgttgaatcttcggaattatgcatcagtgggaccaggcccaacaattctaggcccaaattttgtttatcaagttgacttacaggtccaattcaaagggtccacattgggatggggtcgggtctagaagcccataacaaattccggttatgtgagttgagaacaattcggaccaaaatcaaattaagacgagacgaattcctaatttcctactatattcattgtcgtgagcaagagagacagccacgtgccaaacgcaatttcgtaatttaaatactcatggatatcactcgcatgtcatgtgacaatttgcctaaggtccacgacttgaatgtggcctatagctttatcacatcacatatcacatatctatgtgcttgagtccaccacttctatttagttgatgaattgaccgaaacagacggtccaaccgaccatttaagacaatatataatcgcgaagaattaatatatatatatatatatatatatatatatatcaggaaaagtaaataataaattcgggggaaatatcataagtaccttgatttacaattgggaattacaaattagctatgatatgaaaaataattaaaatttagtcactttttcatataaagataaagcatgaacaccttaaaaatcaggaaagattcctgtataatatgctggagtttgaatttttttacgaattttatcatgtgctggacttccaacataatatgctggaagttaatatgcaggaacttcataatttagcatattatattggaaattttgtgtttcagctggaatttcataatgtgctggagttccaacataatatgctagaactttatacacatgagctctataatccagcatattatgctggaactttctgcatttcaactacaatagtggctatatttattaattttacaaacggtagctattttttgattaccaaccctagaactagctagcacatgctattttcacaataaagtaagccgtcaattgggtaaaaagccttttatttactattttaaaaccaatttgggcctagttggagaggtctactttcaatggattgcgcttgtatcctttgcctcatttggtgtaaaaatggcatgtggtagcaactaagtaaggtggtctttattttttatctactaattataatactcagcaaaaatagtcactactaataggaaaaagacagttttaccctttcttcaatttttatattcccaaacccttgtttttttcattcagaagagggaaaatttgagagcaaaaatttcagggcaagtttcgcgtgctcctcatctgtatcgtcctcgcatgcaaaccagctacacttaatatttctccttcttcatcttctctgtcatcttctatgcatcgaatgatcgaactggtaatttttttttgcttttatgtatttttgtttttgtatatgtgtaatcacgatcaatgttatgtcaagtatgtgtgaaatttcaaaaataatgattataaattgattcaatatcgaataagtagcgcatttttgtgaggctgttattcagaaatttttggtattgaaatgtgtttgtggttcaatcaatatatttgattatgtaaggacatctcataaaaatagtcgtacgaattcataagctaactgtgtttatgaatttttagttaactgtgttcataaaagttaaggaccaagagacattaactttcgaacttggagttcgaagttgaggattgagtgtccttaacttttgaacttgaaacttgaaacttgaagttaaagaccaagtgtccttaactttggagcttgaaagttgaagttcagggccaatagtccttagcttttcaacttgaaactataagttaaggactgcctgttcttaccttttttaatttgtaactctaaattaagggccaattgtccttaacttttgaacttataagtcaaagtccaggactaagtctttaacttttgaacttggaattcaaagttaaggaccaagtgtcctttacttttgaacttgaaacttgaagttcaggaccaagtgtccttaacttttcaacatgaaactataagttaaggactgcctgtccttaactttttaacttgaaacttgaagttaaggaccaagagtccttaacttttgaacttgaaatttgaagttcaggacatattgtccttaacttttcaacttgaaactttaagttaagaactgtctgtccttaacttttttacttaaaatttgaagttaaggaccaagtgcctcgaacttttcaagttgtaactataagtcctaatctttatgttctttttccttctttgtagtgtgataatggaaggagatcatgtgttcgagtttgatgtttggcgtaattttatgatctattggaaaggagagttacagtataaggaaacaatcaaaacttttttgtcaaacaggcaatggaagaagttgagggatggtattttcggaaaccttttctgattacaaagtgtgaagttctgtgtaaacttattcactgtgtattgctttcagaaattgtaaataatgactctgattcgatgacattcaaggtttttgaccgtgaaattaagtttacacatgaagcatttcatataattactggtttgaaatgttattcttcactagacatcaaaggtttgcatgaaaaagagaataggctttcaaaagtctattttccccggaaaggatagagttgagttgggtgatttgtttaattttattattagtcacccacatggtacaactgcatcatttgtaggcagcgatgatgatgttgtgaagttggcaacaatttattttgttgaatctattttgatggggaagcgaaagaataggaatgtgtccgagccgataatgaaaactgtagatgatgatgaactctgctcttctttcaactggggctctctttcttatgaaatgttattaaaattattgaagatttgtttgaagcccaatgagaaagagaaagagaaagacaaagataaagacaaggataactacactatacttggctttccttttgctttttgtgtttggattatggaagtattgcctatttttcaggaaaaacaatttgcgaacttccaagaatgtaattttcctcggatgttatgttatttggaaatgaaatctccacagtatgattctttgtgtaaaaatacttccataatgaaaatgtaagttaatctaattactaactatttttttgtttatttgttttagttatgaaaacttatgtttttttttgttatataatagttgtataagttgatcgaggtggcaccatttattcatattgaagaagatacagaacctattagtgtgcgagagtcaatttctcaagatcaaagctcaatgctttcttccacacaatttgatgaagtcatgcttaaggaaattgttaaagtaggatttttgtctttgaataacattagttttttatttgattatttttttgcttaagagacttttttgtttttatggtttttgatttagagattatcagagagttttaaaaaggatctgcatgctgaagttactagaataaatcagaaaatatctgtattagaaaaaaagattgagaatgaaattaaggtaatatcattaatttcagttagtctaagttcaggaccttgtgtccttaacttttgaacttgtaactcaaagttaaggactgcttgtccttaacttttgaaattgtaagtctaagttcaggaccatatgtcctgaacttttgaactttgactcaaagttaaggactgtttgtccttaacttttgaacctgcaagtcaaactcaaggactcctatccttaacttttgaacttgaaactcaaagttaaggaccaagtgtccttaatttttgaacttgaaactcaaagttatggactgcctgtccttaacttttgaacctgtaattcaaagttaaggactgcatgtccttaacttttgaacctgtaattcaaacttaaggactgcatgtcctgaacttttgaacctgcaagtcaaacttaaggactcatgtccttaacttttgaacttgaaactcaaagttaaggacatacattccttagcttttaaactttgaactcaaagtcaaggactgcttgtccttaacttttgaacctgtaattcaaacttaaggattgactgtctttaactttgagtttcaagtttaaaagtttaggacaagagtccttaagtttgacttgcaggttcaaaagttaaggacaactagtccttaacttttgaacattgaactcaaagttaaggattgtccgtccttaacttttgaacttgtaattcaaacttaagggttgtctgtccttaacttttgaacctgcaagtcaaacttaaggactcttgtccttaacttttaaacttgaaactcaaagttaaggacagtcagtccttaacttttgaactttgaactcaaagttaaggattgtctgtccttaacttttgaacctgtaattcaaacttaaggactgtccgtccttaacttttgaacctgcaagtcaaacttaaggacttctgtccttaacttttaaactttgaactcaaaagaaacaaaaaagaacgtaagcaaaaagaaattttgaaaattcagacatctcctcaaataagaataatctaaatgaatccaatttatagcaaaaacttaaaatagtcgataaacataagtgaatatatctactattctctatgctttcttgaaaatggatggactgccggagaatatatacaagttattctatcatgaccaattcttctgtaacgaccacatttgaatgttatttttgatgactcggtagctggaatatgccttttcttctgccttctacctggtggcactttgaaatctggaggtttaacaatttgtgacttaacactttctggtacaatccaagaatcagtatgtcctacaggatgtatttgtctttcatatgtttcttgaaacttgaaacttttgaagttaaggactccctgtccttaactttttaacttggaactctaagttaaggaccaagtgtccttaactactcaacatgcaagtcaaagttcaggatgaagtgtccttaactattgaacttgatacttaaagttaaggactacctgtgtttaactttttaacttataactataagttaaggaccaagtgtccttaaatatttaacatgtaagtcaaagtttaggaccaagtgtcctgaacttttcaacttgaaactcaaacttcaggtccaagtgtcctcaactttttcaaaacaatttgcaaatctatgacagtatgaccttaatatacagaagaacaacaacaaagttaaggacacaatgtccttaactttttcaattcaatttgcaaaatcaggacactatgtcctcaatattatgtgctcactttttatagaattatcacaggatgtgatgtccttaaccttatcaatccagaaattcaaaaaaacaaaaaaatcaaatttctacttactgtataaaaattaatagaaatcggaaaaaatataactatgtcgaaataaaaatcaatagaaacacataaaagtataacttattgtaaatttatgtcgatttttggacgagaaggttaaattctatagtttgaaatcagaagagaatcttttgcaattctatactttgaaattcgacgattatagtgaagtagttacgtgcgttgttgctactgctgattgttaataaaagcgtaggtataagttatagcagaagagtattttcatccaatcaggtataagtttattaaaccagtggctaaagcctaaagacatttaaatcactggctttaaaataaagatatgtgctattagtgactatttgtgcacatcgccctcatttggtccaatggacactttgaattttggggaatcttcattgtatatagttgccataaaaagcaatagtcaataaatatatattttatatataaccaatatatatttttggaattttacctcctatagcaaaagttgatgtcttatttattttaaataaataccattttaaaaaattatattccatagctactttttcatttttatagccaaatatctatttgtggtcacctcttacacttaagccataaaatacgctttatattatttttctatctcattctttcagatttttctccaacctctctctctctcagcgccaattctcacacagcaagagattgaaacagaatccgccatgaaagaaatcgaagaagcatcaaaaggttcatcgttatttcccgttttcccccaatctacactaattgggatgatcaaagtagtagaacattaatttctgagaccgagtccattgcgtgccgaccaaatccaagtttagggcaggggatgtcattcaacgattttgacaagttttttaaagagttgcctcatgtggacgaccttcttcacctttatgcagatgaatatcgttctaattaggaatttttactttgaacaaagacgacggaatttggggctgagcaacttgaagagtatgtttcctttttttctctctcgttgtattgcaatgtatcttgttgtattctatgtatttcattgtattcattattttcttttttcattgtatttcaatgtatctcgttgtattccatgtatttcattgtattcactgtctcgctatattccatcaatgtattcatatatattttttaattaatataatttatgtattcagatttatagttgagtttgttgagttatactaggagtttattgtgttaattgattcactttccgtttaaaaacaactgaatagaccatgaattgcgctatttacgttgttgtattcataaatacatatcgtgaatacagtcgaatacaataatctgtctagctgtaattccctgtttcacgccgtaaatacagtcgaatacaataatctgtctcgctgtaattccctgattcacgccgagaaatgctactgtattcatgaatgcagtagcttaaatacatcgaatacactctagaaaacctggaaacatagctataggaagtaatatagtaaatgatagctacaactagctaataatcactaaaacatagtaatttctgaaagtttctctatatttttgtatatttaactaggaactgtaattatttttagacgaccgaccaaataaaatcccattttataaattaaaaaagctctgacatttcagcaagtcgcatttggttattgtctaacattgatctcttaagacttgttaagaaccatatctaccctcttgtgtaaagtaacctttttcgaatatttcactcaacacacattttcacttccttatcctttgctgatatgacttgatttgtcgtagcatttaggaagtcacaacaggatcgaacggtaattttttttaattattattattcgataatatttatacgttgcgtataataataaatagatagttttaagaactaaacatagtttttcctttttgatgaagttgacttttgtcctttttacttgattattataacttacgcaaatgtaccattataaaattatcaaaagcaatatgaatattgccaatgtacgcacaatttagatcgtaaaagttataatttcacccttagagattttaaaataggaatactcctctttacttgattccgaccatccttagtgcatactttactaactgggtttattaaaaaacagtaatcatctgctttaaatcattagccgatatcacacaccaactctaatatactgttgaccgttagttagtctagtagcgaggaaaaaggtcgagaaaaaaaagtcaaaaatgggcacatcaaacttaaaactgaatacaggtccacgtctccttcggtagagttacgtcccaacaacaccacgacgcgctcgaaccctttgatgtaaccgacacgtcattctccgtgctaaaatagccgtttacgcttcctttggactcgtcgttattaatttcacaaccaaccaaccaaccatggctgccgccgtgaccgagaaaattatgtcgccgtcgcctccgccctcgcaacacatgcatctgtcgccttccacttcccggcgtggccttgacgccgcctccgatactgatgctctcgatcgccgcccttcccttgatctttcctctgcttcttcccctagcccaacacgattatctgatgctcaggttaccttcttttaaattaatttgttcaattaatttctactcgatattgcattaggagtctgaattatgaattaaattccacaattttagtgtatactatatgaattttatgggtgatcatagcttcaaagaaagtttctactctggtttattgttgcatgcaaatgaagaactcttttacttttcaagagtttgtcacaatcaactaactaaatttaaacaaaattggagttgtggttggtgaatgatttgactgtgtgtggctgattgcaacaattatcaattttgtgacagaatcagctgtttgtgaagagtgaagagtatcgacaactgttccgtttaccgcccgatgaagtgagtatccgtctcttatgtgttaatttctctatgaatttgtttgcattgaattgtggcagtttacttatggttatatatatatgctattttgtgattcaccaggggcggatgtagtgaagaagctacggttcattcaatcttagtagctttggcttaaaccctttatatgtgttaaaaaacccattaaataagtaaatataatagatttcgagcccagcaattggactggatgtagtagaattccgaatccgaacccgaacccataaagtttaaatctggtgaattcaccagggtatactctgacctttttcccttggtattttaatgtctttagaagtgtcagtatttctgattatcatttcttgtttgaggcttaatcctgtaagacaacaaacaaattgcaaaactagtaccaaatatcaaagttctttttttggcgtggttatggaaataacttctccggctatgtgcaaacacatctggtcccacgttggaacaaagaaagagcattgtagtcagagaagttgttttgactcgggataatcttaggaagaggggaatgccactttgttcaagatgctatttgtatgggtaggatgaagagacaatcaatatctattttcacactgcaggattactagtcaactttggtatttgttcatcaacattagaggcattagatggccaatgccaggtagaccttctgatgtgttgacaagctggaccaaagaaggaactgcagctgaaacaaagacaggtggaaaattgtctctggtggacagtatggaaagagaggagttcgagatattttgaagataggagcagtttcttacagctgattaagattgattgtgttcctctttttagtttttggcgtaaatctgaatgtatagatgatcctgaggctctcctatatgcgctagattccttgtaagaagatcaaggttttattttggtttttaatttggtgccatggtttaacaatttattttccaccacaacctttgtgctgatgtctctctcgctgtctctctctctatatatattaaagggcagtccagtgcacaaggcattccgcgtttacgcaacatccggaaaaaggccgcacccaaaatagacaacctaccttagtgcaagcattagtggttgcctcgatgggtcgaacccgtaacctataggtcacacggaaataaccttaccattgctccaaggttccctttctctctctctctatatagaatgttgccttctccaaaatgaaaaggagcgttgcagtaggttgacaaccaatgtaaattaatgtagaactagtctgactatgatcaaacctctagagcggaatggtacaaaagatttgtatagctgactccaaccaatttagggttgaggcataaatgggatatgttcctgtttgagatgctctacaagcttaagaaaacattaggttgttcacttaagcagatgcttcctagtgcttgttagcaaagaaattatctagaaccgtttactcaaaaagtacttagccttcgtgtgtccaagtcataccttgatttgcaccccatagtgtgtcgttctgccaagttcaatttttgtacatcttatcttcatgtccatgtttcgaaacaggaatagataatgtgatctttagatccttttcttttacatctcttcacttaagttgttgattgagcatgtcttgtggaatctttatttcatctgtatgaagaatatagttccacctcttctttcccgtggctgaatgcagctttcaaatctgcatgctaacagatattttatgtttatgttctgttggcctgtataaattctttacaggtcctggttcaagattttaactgtgcgctgcaagagagttttctacttcaggtaaacttgaactgtatgatgtttcacatctatccgcattaaaaagatgatattatacatgtatagttgaacttgtggcttcttgaaccaccctaatttctaatatgtaacattttcccttcctttctaatttgtttacacgcttttgtgcgttggttaatgttttactgttgttacagggtcatatgtacctctttggccattatatttgcttttattccaacctcttcggctttgagacaaaggtttggtgttctgtttttttttacccttcaataaattcaccttttataaagcctatagttgattgagataggttttcactactgataaggtgttcttctctgtacacaaatatagctgagattttgtctgtttcgattatgcaattattttggaattgctattaacaaaatatttactagattcacggggtcaggatagaggttatgtgcctgcatgagaaggaaaatgcatattttgatttgtttggatttgttttcatagcactgcttgattgagaaggcttcatgtgattcaaggtagaaagaagaggaagggaaggttctatttacttagaactagatatgacaatttgtctgtacaaggtgcttacgtgctacccacctgaaatgggtgcattagagaaagtaaacattccaagtaacactaggaagggtttggctcacatgtttgatgtttggactgatacaacaggatataggttatagaagggatataggcaaggatggtaatgatacgacctctcatgtgcggtgggatgtcatatggaagagagattcgaaaagcttatagtggaatgctctattatcattccatcttaagcagtttgttttatatgagagttttgtgaattgaaggcgatgaatatttgaacaacaaaggaccctctgtttcctatgtcttcctttttatccccccccccccccccccaattctttgttctggtgccatatacagatttcctttttttatttgtcgtgttgctttcctgcttggcaactgttgacatattttagtctcgatacataaaattcttgctgctattgtttgcaataggagggtacaccatcatgaggtcctaagaatgtgtttaaaggattgctttgtctgtatttcattgtttggccttgttatttaagttttaagactgactaataagctccattcaatatttaccaagaattatactgcatgacatctgaggatagcttgtttcctttttttttttggataagtaaaaagggaatcaaggaaaatatagtaagataaataagaaagtttctctttctcatctgttttgctatacatttttaccttgatgtaaattaagttatcaatatccatcttccagaaaataatacattttcatgagatcacgtcagtacgaagagctaaagctgcggccatattcccgacagcaatagaaatagtagccggagaaaagaaggtaatgtcctggatttgtgatgccatttataatgccatatgttttttttaaaacatgatgtatgccatgttaatgctatatgcctgttctcctttcagattaatacttcctcggcgtagtcttgacttgccttctgttaatgcagtacttttttacatctttcctgtcccgagatgaagcttttaagcttatcaatgatggttggctacaacacaatggtgcagcggaagagtctacagatctggtgtgtcgtcacttacatagcttgggaatttataaaatgtgtttaggcttgttgcaatatggagcaccccccccaccccccaaaaaaaaaaaaaaattctattttttggttaatgctgataaattatgaatactccgtttgtgctattttggttagtcagtaatcagtcgctctccgtgtaacctaacattgatgcattccccagttccttgaaaccttgttatgttacttgttattttcaactctaaaggcaagtgtgaaaaaacataattttttccagcataaatttgaaaagaaagatgccgcagcagtgtaagggtattagtattgaatgttccaagtagaatctctattacagttttgactttgctttttggatttatttccttcacttcccttttagtcgtcatctgtgcggaatcttggtattggtggtacatcagctacataagtaaagggaaggatttagtcatttagcaacctaagtaagtggaagatttagattttagacccttcaaagatattcttctttgtggaaatggaacatggtatgcaattaaaagttaagcaatgccaagaaggcggcgctttttactagaaaatctaatatataacttgcattctttaaatgaaaacacctgatagtaaaacggatggaatctacccttcattgccaaagacgttattttggtattacgaatagttgttcccttaatcgccaaccaagcccatataatttggaggcttctgtgcctcacttcattgcaatgggttgactcctggataagttgtgtgggcaaagtctcagacatgtgccatgtgctacttcactgacatcttaaatttggttgtgaaagcattggtgaccgtgtcctttcatctcccttagcctgttttctcaccataatggctctgcataagttacgtgaaaatttggacattctacctcttggttttcttctattcatttttctcttattttgcaaagagaagtttgagaattctctttatattcatcttccaagaaatatctgtttcaatcctgaaaatatttcttgctgatgcttttattttttttgggccttctctttgcagttctgactgtgtttaactttgctttgacgtcaggagccaaaatctgatctaaacagtcaagatagtggaataccagaaggaacagatagtttcaggcaggctatggaaggggtagaatccctcgaaaggtatctagagtcaagttaggaattatcttcccttgcactggagttatttcagtctgttaattcatgtgaccaggaataaggatgatacagtacaggaagactcaaagcccttggccaatggcgaatttgaaattgtatcaaagcctttaggattgcagcgcaatgtggaagaaaaagcagttattgttcaaagtactgattgctcctcttctgggaggtcctcagctttgaagcaggaggattcagatgcacctcggggtcagtcaaatgtccctttgggctttttgttatgtgcttcttcattcttcaagtgtgttaaatgattttctccattcaattaattaacaatctctggtttctagtatttaaagaaaaattgcttattcgttggctgatatgttgaagtcatgtgcattcttttgttgcaagatgttagatacttatgtgtaaataatcttagtcctatatgtagtaggagcagaatacgttctagtcccatatgtagtaggagtagaatatgtcctagtcccatatgtactaggagtagaatatgtattatatatagggctcattgtatcattgttaataaatagatttttctcccatgcattctcacatggtatcagagcttagtgagaaaattattgttatgcgtcattccagcgacatccgggaagaaagatctcatagccgtgcaattttccggcaacttagtcttgttccagggttcatcactgctacagatacgaaacccttgtgcgaccaaaccctagaaattcccgtcctatctgaacagaaaagtcagtcaccgtgtgtttttccgattgactactcaagattgatttgcgttatctcctcatcggtaagtgtttgtgcaaaaaccaacactaccatcttgttcgaaaaagttaggcgacaaaacccagccaatcgctctgacagaaagtcacgcgccgccagaactagggttccgtcgagctacagtaacttttccggtgcgtgtaagccattctggccactttttgacaaaacttcttcaggacaacttactcgtctggtgattcgagcctacgcatataaattacatcaaattctgacaacttttattttttccagcgtaaacagtgcacttcaggcatgaacagtgatttcccggtgtgaatagtaatttctagaaaagttctgttttctggtggtgttttagaacctattttgtagtgtggaattcggcgtagtctcaatattttcaaatttttccggcaacctttcggccaacttctgtttatcagcaaccacttggttttgttgcttagggggagtcgagtggccttgtatgtcgaataatcaacttgcagatattttcaccaagtctctcacgagtcctcgtattagttacatatgtaacaagttcggtacgtatgtatgcacctgcttgagggggagttttagatagttatgtgtaaatagtacgagtcctatatgtagtaggagtagagtatgagcccgtttggcttggctgatttattgtagctgataagcattagatgctgaaaaacacttttaagtgctggagctgatttaaaaaataagcagttatgtgtttggataaaagtgctgaaattaataattagcagctgaagaactgagtatacgaagatttttattttaaaaagaagtattttaggaatagaatagtaaatattttggtcaaacctaaagcgcttataagttgaaatttgataagttgggggagaccaacttatgacatttggcttatttttggtttataagcacttaatttataagtacttttaattttaccaaacgcgtagataagccaaaaagtgtttataagtcagtttgaccagcttataagcttagccaaacaccctctatgtcctagtcccatatgttgtaggagtagaatatgtattatatatagggctcattgtatcattgtcaataaatagattttctcccgtgcattctcacacaagaagtatgtgctcatgttgcgttgcctgtatgtttacttcttcttcataatactgagaattgcagtgtcactagtctaaaacatgaaacggaattagagctaaatgtaatgcgcaaagctaaatctcatgtaactctcccaaatgtgctaacgtgtaacaagggaaaaggcaggaagaatgaattaaactacccggtgcatttaggaccttcaagttggaaagtgctgtcatttttatcttccacaccttcccagataacatatagtgtgcccttatcttggtctggttttctaatcctatttctttgcctctatctgctaatatgggattaagctgggtttgttgttgttgttagtccgctaatatggtatcagacgtgcacatcatgaagtgagagaactgtctgctaataaggtatcagacgtgcacatcacgaagtgagagacagttactaggacttatgagcaggtttactttcctcgtactagacagatgttatctggtattctcctatggggtgggtgtctattctcagagttctgaccacaagttaatgctcaagttctgtttgatagatgcgtactttcagccagaaacaagattctctttggtacttgtatccaataggttctaaagctattaaagcaattgtttcttggattccaccagcaaaactttccttttcttttttatattctgtgtttgaaattctattcagttcctgatttacctaaactttgcattatttgacatgcagtccctgaatgctttacacttgttgcagaggccaagtttccggtgatataactttatctttttccctagttctttcatttgttctgaatctctagttttcttcatgatggatgtgtaattaatcttagactgttatttgaacttaatatttgaggtgcaggttacggttgagaagttctttgaactcttcatttcagatgacggtattgcttttcaggagtcattccgtagaaaatgtggtgataaaggtgacagtattcatggattttgctgacgtggatatatttcagcgcattctgtcagttagatttagaagcaatggatcacaatgaactgataagtaattatgtggttaaccaaaagttttccgtcctttttccccagattttaagtgcacacagtggcgtcctcatgaagaacttgggcactctcgtaattggtcgtttcagcatcctattaaattctatttaggtgtgactacacctctatatcaacaatttaatttcaaacatgacttgagcactctcaagtgaatcaagatttatttatttttgactaatttatggtttgattaggtgcaaaatttggtggctgccatgaggtacagaactatcgtttttatagaaacaggtaataacttctactatggcgctactatagttcactgattttgcttttttttttttttaagagatactggcactttaagttctctttgatgctgtcattctctctgctgctccatgcgttagcttgtctcttacatgataaagttctttgcataacatcatttttgtggttacatgtgagtttctccgaaagcaaaagcttttgagtcaatgtaattcaatgaccggagagcatagatttgtggaaagttgtctagcttacgtgctaagaatacaggattccctaatttcaatgcacaatgtatgctgcaattttctcatcatatcaataacaattaacaatttgctgaccatatgattcttctaaggtctatcatcaatatatttaaaaaaacctttcatcttttcctttttggtaactttagctttttgtcatataaaagcatatgtaaagcacataaaagataatgttttctcacagccgatatatgatatagatgtccgagaatcatattggaaattttttttagtggatcacgaagcagaatcttaataatttggttggcttaataatttgattgtgcgccaggttccgcctacagagaatctattcataggagaggatttcaatggtcatattggggcgactgcaggtggttatggcgaggtgcatggagactttggttttggggagaggaacggaggaggtacattgctgttggacttcgctgaggcttttgggttggtgattgcaaactctagatttccaaaaaggaaagagcatttgattacttttcaaaatgcggtagtggagacctagattgactatctccttcttaggaggtgtgacagcgggttgtgcaaggactgcaaggtgattccaagtgagacactctcgtcgcagcatagacttttggtgctagatgttggtattaggttaaagaggaggaaaaggtctgctcgggaaaaactaagaatcaggtggggagccttgactaaggataaaacccaagagttggagtgccggttgtcagctatgggagcttggaggagcagtggggatgcgaacactatgtggtcagcgacagcagactgcataagggagtctgcgagagaggtgttaggggtctcgatcggtgtctctagtaggcataaaagagactggtggtggaatgaagtggtccaaggtaaagtggaagcgaaaaaggcggcatacctgaagttagttgggagattaggtgagtaggagaggcgagcgtgcatggagagttataaggtagctaggaaggaagctaaaatgtcggtcacggaggctaagactgcggcttattgtcgcatgtacgaggaactgggggaaaaaggcggggagaagaagttattccggctggccaagttgagagagaggaaggctcgagatttggaccaagtgagatgcatcaaggatgaagatggtagagtagtagtggaagatgcccagattaagaggagatggcagacttacttttataaacttctttacgaaaaaggggatcatgatattgtgctaggcgaattggagcattccaaaagtcaccgtgacttcgggcactgcaggtgtatcgaggtcgaggaggccgtgggggctatgcgtaagatgagtaggggcagagcgaccgggccagacgaaattccagtggaattttggaagtgtgtaggaagagcaggtgtggagtggttgactgggttgtttaatgttattttttaggccaagaggatgctggatgagtgcaggtggagtacggtggttccattgtataagaacaaaggtgatatccagagttgtaacaactataggggtatcaaattactgagtcataccatgaaagtatgggagagggtggttgaagcgagggtgaggatgacaacgtctgtatccgacaaccagttcgggttcatgcctgaccgttccaccacagaagctatacaccttgttaggaggttggtggaactgtacagagagagaaagaaggatctgcacatggtgtttattgacctagagaaaacgtatgacaaggttcctagagaagttctccggagatgcttggaggcaaaaggtgtgtcggttccttatattatggcaattaaggacatgtatgatgggctaagacctgggttaggacagtaggaggcgactctgagcattttccggttgaaatggggctacaccaaggctctgcgctcagttcattcttatttgccctggtgatggatgcgataacaaaccatattcaaggggaagtgccatagtgcatgctattcgtcgatgacatagttctgattgatgagtcacgagccggtgttaacgagagattggaagtttggagacagactcttgagtctaagggtttcaagctaagcagaacgaagatagaatacctcgagtgtaagttaagcgctgagccgggggaagtggacgtcgatgtgaggcttgagtcacaggttatcccaagtagaggcagcttcaagtaccttggttcggttatccacgggggaggagagatctacgaggatatcacacaccgtattggggtaggatggatgaagtggaggttagcatctggagtattgtgtgacaagagagtgccaacgatactcaaaggtaagttctacaaagcggtggttagaccggccatgatgtatggggctgagtgttggcttgctaagaactcacatattcaaaagatgaaagtagcagaaatgaggatgttgaggtggatgtgcgggcatactaggatggataagattaagaatgatattcaggagaaggtgcacgtggctcccattaaggacaagatgcgggaagcgaggctcagatggtttggcatgtacaaaagagaagcccagatgctccagtaaggaggtgtgggcggctggttgtgaaaggcacgagaagaggtagagggcggcctaagaagtattggggagaggtgatcaggcaggatgtggcgagacttcagatttccgaggacatgacacttgataagatgtggaggtcgagtattaaagttgtaggctgggaggtagttgagtcttgcgttactttgtacctttgtgagcctagtctggtagggttttgtctaagaacgctaggggcaacgtcgtgtcttactattttatttttcgacgttggatccatttactagccaccgtttttggtttgcatttttcttctgcattttatgttcctattttttctatgatctccgtgatgaatctaatatcctctccttttgtcttctttttattatcttgagccgagggtctttcggaaacagcctctctaccccttcggggtaggggtaaggtctgcgtacacactaccctccccagaccccacttgtgggattttactggattgttgttgtttgtttgcttaatttagtgcctgaagtagcaagtatgttagtaatttgggtggcttaatttagtgtcccagtagcaactatgtcatatttcaaatgatcatgttaattcggaacttcttaggcgattaactgagttaacagtggtttaacatctaacatcaactcttgctagcactcctggctatctccatcctctggatgaggtctctgccttcaattaaggggtggttggacaagcataaggtttggcaatctaccttttcagaattttacatggttgtggagaggaattaatgatgtacggacaaacttgtaatagcttttgaggccctaagttgcagcctaaaagcgttaataattggtagacagaagttgaaaggggaactgtttgagcactaagttaagtgacgagagaatgaattaaacgaatgccgtaaagtgatatatggacaaacacacgtagtagtttttatatgtgctctaagttactgataaaaagactgaaggaagttaaaacaatagatgtttcgagggctctgggttaagtgataagaaaattgaataaatgacgaagaaaatgtcacttcctgcatggtagatcttatgcgtcaaagtacgtctaaattgacgctacatgtgcaaaaatatggaagaggaatagtgggaagggggcctcatatagggaaaggaacaggagaacgtttgaagaaaagcagaggaaggttctgcaactagaaatgattatgctgatagattttgtagctaaagactcctttatgtagattcccttccatttgtgcaggtgagcttttctttcttgccataaagtttattttgttgtaggagaaagcattgcatcacacaatgtgaaggaagcaaatttatctgaaaaattctttgatctttctattaaaaaaattatctgaaatttctgtattagctgagcagtctgatatgcaatgatatctttgtagatgctagaacttcaaaaggatgtttaaaaccaactctaacaactaatattacccaaactctacatagacaaccttaaacctttcactataaattttatgctcggtgctgtaacaactaataattaccaaattatcgtagttacagaaatatccacaatactaaaagcttgaaatatagaaagtacaataaaaagattaattgaaaaggtttcgaagtctcagtttgtatgcatgtgaatacacacagataccaagtattgatgtaagaagacatttaaactgaagaatggaagataggaaatctgatccaaagtctgtatctcaagaggagtgaatatatagatctttcgtattggttttgagaacatttgttgtgaaatgtggcccgacatcaacaaaagacaatagctgaaatgtggtctcctcaaggatggggacttgtatttaggagaatgttgaatgattgggaggtgactagattcactgatttctacaaacatctggaaggcttcacaggattacagaatggggtggatacactaatatggcagggacacagcagtggcattttaaggtgaatgcatcatacaagattctgagctaaactgacatgcagattatcagttggccttggaagcacatgtggaaaatcaagatcccctaaggtggcctggttcccatggttactagcaaaggaggctgttttgaccaagacaatcttatcaagagagggatgccactatgctcaagatgttatctatggagaagatgttgagacaattagccatctatttttacattgcaagataactgaccagctatgtaagatttttattaatctcaaggcatattttggacaatgcctagcaagatgactgaagttctatttaattgggatggagctggagttggatcaagagacagagatagatggaagactgtcccagcatgtatttggtggacaatctggaaagagagttccagatgttttgaggatagcagcaattcagtgcagaagatcaaactcgattgtgttttgctcttttacttttggtgtaaacaaagtgttagctgaaacgtaaaagaaagaacacaagatttaacgtggttcggatcaaaataatcctacgtccaccagagaacaattgcccttttaatattaacaaaggaaggggagatttcccagttacacttaagagaatttctctcttagctctctactcactacaatgtattgtattattttgggatggtttctacaaatgaaggagtacatctatttatagaggtaaagacctccttttgatgtcattggtgacatcaaactacctcctcttgatgtcatgggtgacatcaaaggaggaagcttcctcctagcatccacactaactctttccaccaactcttccaattggcatgccattgttgactaaacataaaccaacaccttcaatctccaccttgatttgcgtttcgagcgtgcgtgtgaacaactctggccaaaacttctaagcttactgggcaacccgttgtaagaaacaagaagaatcaaaccattgttgaacataccacctccacctaacaacttttctcttcggagttgcatcagttgatgcacacccccgccaagtccttgcagtgtgcaaacttagcgagcgggactatcttggtcaacatgtctgcagcattatcgtctgtgataaccttcacgaccttgatagttccctcatcaataacatctcgaataaaatgaaatctgacatcaatgtgtttagtgcgctcatgaaatctttgatttttcattagatgaatagcactctgactatcacatctaagagttgattccagctgaaccaaactcaattccgctactaaacttttcaaccagataacttcctttaccgcctccgctgctgccatgtattctgcttctgtcgtagacaaagcgacaatcgactgcagagtcgacttccaactgacggcactgccaacgagggtaaagatgtatccagtcgtggaccttcttctgtcaagatctcctgcatagtcagaatccacataaccgagaattgaaatacctgtaccactttttcgaaaggtaagaccaacaccagaagctcctttgagatatctcaatatccacttgacagcttcccaatgcctctttcctgggttggacatgtatctacttaccacacttacagattgagcaatatctggacgtgtgcataccataacatacataatactaccacctgcactggcataaggaatctttgacatatgctccacctcatcctcggactgaggcatttgtgactctgaaagtttaaaatgaggagctaatggtgtacttacaggcttgcacgtttgcatattgaatctctcgagaaccctttcaatatacctcttctgagaaagatgtacaacatcgtcttctcttgaaatctccataccaaggattttctttgcagctcctaaatccttcatgtcaaattccttactcaacagtttcttcaaagcatttatctctgtaatgttgttagcagcaataagcatatcatcaacatacaaaagtaaataaatcattgagttaccagacatattcttgtgatacacacagctatcaaatgcactccttgagaattcatgtgtagtcatgaatgcatcaaacctcttgtaccactgtctaggggattacttcaaaccatataaagacttctttagttggcatacgtgatcttcttttccctcagctaggaaaccttcaggttgatccatatagattgtctcttctagatcaccgtgtaagaaagcagttttgacatcaagctgttgaagctccaagtcaaattgtgcaaccaatgctagtagcacgcgaattgagctatgcttcacgaccggagagaaaatctcattgtagtcaattccctccttttggctgaaaccttttgcaaccaatctcgccttgaacctagcatcttccacttcaggagttccctctttctttcggtagacccacttgcatccaactgtcctcttccccttttgtcttttcactaagacccatgtctgattcttgtgaagagactccatctcttcagtcatggctaaccgccattgtgcggcattcttgcaagaagttgcttcaatatacaaggagggctccaaatctttaatctcttcttgtgcagctacgaacgcatatgcaatcaagtttgcttgatttataaggcattccggttctcgtgtctgcctcttctccctccccttcgcaattgtgtatggttcattgacagcaagttcttcaaggcctacatcttctgactcatctttaacctgagtctcttgatccttttccttggcaagctccaccggaagctccacctgctcgttgttcttgtttcctgaaaactccacggaaactttacgaggatcaagtatagaggattcatcgaaggtgacatctctactaactataaatttgagtaaagacaaacaccaaagtttgtacccttttactccatccacataccctacgaatatggccttcttagcccttggttcaagctttccttcattaacgtgataataagctggacacccaaatactcgtaagtatgaatagttagagggttcacctgaccatacctcattcggagtcttaaagtcaattgccgatgctggagatcgattgacaatatgagcagcagtgtgaactgcttcagcccaaaatacttcggacattttgacttgtaggagcatacaacgagccttttcaagaagagttctgttcattctctcggcaactccattctgctgtggggtatgcctgacagtcctatgtcttgagatcccatgaaccttgcagaattcattaaactctttattgcaaaactccaagccattgtctgtgcgaagatacttgattttccgctccatttgattttcaaccaaaatcttccactctttaaatgcttcaaaagcatcactttttgccttcaaaaaatacacccaaacctttcgtgagaaatcatcaataaaaatgagaagatacctctttccgcccttcgatggaagtttagaaggaccccataaatttgaatggatgtagtctagcactcctcttgtcttgtgtttgccagtgctgaagctgaccttcttctgcttccctagaacgcagtgctcacagatgtcaagcgtgcttatcttctcaccttccaaaagtttacgattgctcaacatctccagtccacgtgcgctcatatgacccagtctcatgtgccatagtcttaccttgtcatcattagataactgcactgtagatgcatttgcagagccaacaatggtgcttccggccaatgtgtaaaggccgttctccagcttgcctttcagcatgactaaagaacctttagtcaccttcatagttcctgcttcgctcatgtacctggagccttgttcatccagagtacccaaggagataaaattcttcttcagatcaggaacatgacggacttgtgtaatagtcctcatgattccatcatggcagcgaacccgaactgagccaatgtcaactattgcacaagttgcattattgcccattactacggttcctccacttttctcgtagctgctaaactagtcttttcggaacgtcatatgcagagtacaagcagagtctaacacccatttgttttcataactattattattattacacgatgttgttagtacataatcattatcaaaattatgtacctgttcaactgtagatgcactcgccttttccttggactttgacattgggcaatctcgttcaaagtgccccttcttgccacaaccccaacactctgtattcttcttgttcacacgagactttgatctgtgctttaatttgctctttccctattggctagtccggcctcttacaaagaggccacttgcctggtcatctctatctccttcaatgtgcctccgcacatcactagagttaagtgcctgccgcacttgctcaagcttgataggctccttgctatacatcattgaattctcaatatcacgatatcctgaagtcaatgaaaatagcaaagcacatgcaagcgtctcctcctcccttttaattcctgcaatctgtaagtccatgacaagtttattaaacgcatctaaatgatcttgtaacgaaatacctgaccccatcttaaatgtgtgaagacgccgttgtaacaacattcttgttgtcactgatcggtcttggtataacccttctagcttttcccacaactgtttggccgtctcttcggtacccgtactcacttcacaaagcacgttaggtgcaagggatagttggattgcactcaatgcatccccttcaatcttctccttgtcgggggctgatatatccgtaggatactttccgtcaatagcatggattgaaccttccctccgcagtaacgccatcatctggatgttccagatattgaagttgttgcgtccattgaatctatcaatttcaaacttcatggaactcatatttgcttgttcttcctccttggatcgttaaagaatcctgtcgctctgataccaattgttagctgaaacgtaaaagaaagaacacaagatttaacgtggttcggatcaaaataatcctacgtccaccagagaacaattgcccttttaatattaacaaaggaaggggagatttcccaattacacttaagagaatttctctcttaactctctactcactacaatgtattgtattattttgggatggtttctacaaatgaaggagtacatctatttatagaggtaaagacctcctcttgatgtcatgggtgacatcaaaggaggaagcttcctcctagcatccacaccaactttttccaccaactcttccaattggcatgccattgttgactaaacataaaccaacaccttcacaaagttacccagaagatactgtttcaatcctagatgtcttagattcttgctaggactgcagaatagtcttttcttctccgtcgctgacttgttaatattgtctcagtacaagccatgtactgattctatatatatatatatatatatatatatatatatatatatatatatatatgttaccatctcaaaaaaataaaatataattggacacgtgctgtacgaggcttctctagtatattaagttctcataggaagcaagatatatagcttggatactttgtatatagagatattgtggacatggacaacacagtaattggtagaacaaaggagtagttgattatagttgggcccctgtcctattttctgaatgaggatcctatctagctcatgaagcccatcaatagttgtgctctttgactatagcctccatagcggcatcctcactctttttatggtggaacaccttattagtcatactttaaggccaaggatgctaagcagatcttctattctgtcggattccactagtggcattggatgacctttgctaatagggccctatacatatatgtggaaggttatgctgttgataaattaaatctgcaagtgtgaatcatctgaacaaaaatctaaattggggctttactcgtctttatatagatatacttttaaggactgttagtttgatagttaaatagtatagtaaataactctaatcccatatgtattaggagtaggaaatgtatgatatatatataggactcattgtatcattgtcaatattgatcaagaatattttctcccgtgctttctcacatggtatcagagctttggtgagaatatatcgctgtgcgtcattccagcgatatccgggaagaaagacctcagtcaccgtgagattttccggtgacctaagtgactatttgcgtcaaagccactaattatcagtgttgtgcaaaatccaacaccacctgaaaacactcacctacgcgcctgccggagttctgccggtggcgacgcgtctgtcccacgcgctggcgcatgagggctgttccggctagaatttcaaaaaatttcttttggacagtgtaatagccttgcttttccgagcctacccatcaagtttacatcagattccgacaacttttttattttccggcgagctacagtgtttccggtgaacagtaacagtgaaacaatgatttccaaacaattttctgacctttccggcgtgaacattataatgtcattcttattagaagccttagactcacaattcgttggatcaaatgcattaaatccaatccagatggtttctttacccgattatattgagttccttcagtacaaagcacgtaaacagacatcttcaggattagcctttgttgttccaacaaatagtagcatgactggtgtgtcccaatcttcaccttctgagtcttgggtcattgattcaggtgcatctgatcatatttctggtaacaaatctcttttcactagtatctcatattctcaatctcttccaacagtcacaatggccaatgggtctcaagccatggcaactacaataggtcaagcaagtccacttccttccttacctttagactcagttctttatgttcctggtagtccttttaatctcatagccgttagtcgcttagccaaatcacttaaatctgatgttttatttcttgatgaccttgtttttatacaggaacgcagacagggcggatcattggtatcggacgtgaatcaaatggactttattaccttatccttgcaaaatcacatggactcgcatcttgtcttcctccaataatttctcccgttactgattcaccagatttattacattaacggttaggacatccagtttgttaaaactttagaaaatggtacctggcttatctcacttgtccactctagagtgtgagtcgtgtcagatcggtaagcatacccgctcccatttcccgcgacgtcttgataatcgagcagagtcaccttttactttagtccattcagatatttggggtcctagtcgggttagttctaccttaggattccgctactttgtcagtttctttgatgattattccaggtgcacttggatatttttgatgaaaaatcgatctgagttgttttctattttccagacctttcacgctgaaattcaaaatcaatttggggtttctatccgcacatttcgtagtgataatgccctagagtatttgtcttccccatttcagcagtttatgaactcctatgggattattcatcaaacatcttgtccgtacacatcccaacaaaatgggatagctgaaagaaagaatagacatcttattgaaactgctcgtaccctactcatacaatctcatgttccgctgcgtttttggggatgcagttcttacatcttgttatcttattaatcgtatgccatcttcagctatccaaaatcaagttccattctctgacctgtttccccacttacctttgttctctctttcaccccgtgtctttgagagtacgtgctttgttcatgaccttactccaggaaaagataagttagctcctcgtgctcttaagtgcatatttctgggttactcaagaacgcaaaagggatattgatgttattctcctgaccttcagcgatttcttatgtctgctgatgttaccttctttgaaacccaatcatacttcacaggtccagttaatcacttagatatttctgaggtgctactcgtcccttctattggagattcagtccctatctcccattcatcttcctccatagctccaccgcctacaactctagttgcagctccaccacctatagctccagttccaccaactatagctccagtaccaccacctagtctagttccaccaactatagctccagtgccaccacctagtccagttcaaccttctacagctccaccactcctgacttatcatcgtcgtccgcccccagcatcaggcccagctgattcatgtcctgcaacctgaccctgctaatactgcggacttgtctcctcttaaccaaccgattgcactacgaaaaggtatacggtccacttaatcctaatcctcattatgtcggtttaagttaccatcgtctctcatcatcccattgtgcatttgtgtcatctttgtcctctgtttccatccctaagtaagcactctcatcccggatggcgacagacaatgattgacgagatgtctgctttacatacgagtggtacttgggagcttgttcctcttccttcgggtaaatcgactgttggttgtcattgggtgtatgcagtcaaagttggtccagatggttaggttgatcgacttagggctcatcttgttgccaaaggatatactcagatatttggactcgattacagtgatactttctctcccgtggctaaaattgcatcaatccgcctttttctatccatggctgctgttcgccattggcctctctatcagttggacattaagaatgtttttcttcacggtgaccttgaggatgaggtttatatggagcaaccacctgattttgttgctcagggggagtctagtggccttgtatgtcggttgcaccagtccctctatggtctaaagcagtctcctcgagcctggtttggtaagttcagcacagttattcaggagtttagcatgactcgtagtgaagctgatcactctgtattttatcgacattttgcttcaaatctctgtatttatctggtcgtttatgttgacgatattgttattaccggcaataatcaggatggtattagttagttgaagcaacatctctttcagcactttcagactaaggatctgggcagattaaagtattttctgggtattgaggtcgttcagtctagctcaggtattgtgatctcacaacggaagtatgccttagatattcttgaggagacaggaatacaggttgtagatctgttgacactccgatggatccgaattctaaacttctgccaggacaggggagcctcttagcgatcctgcaagatataggcggttggttggtaaattaaattacctcacagtgactagacctgacatttcctttcctgtgagtgttgtgagttagtttatggattctccatgtgatagtcgttaggatgcagttgtccgcattcttcggtatataaaatcagctccaggcaaaggcttattgtttgaggatcgaggccatgagcaaatcgttggatactcagatgctgattgggcaagatcaccttatgataaacgttttacgtctggatattgtgtcttagtaggaggaaatttggtgtcttggaagagcaagaaatagaatgtggttgctcggtctagtgcagaagtagaatatcgaacaatggctacatgtgagctaatttggataaaacagttgctcaaggagttgaaatttggtgagattagtcagatgggacttgtgtgtaataatcaagctgctcttcatattgcgtcaaatccagtgttccatgagagaactaaacacatcgagattgactgtcactttgttagagaaaagatactctcgggagatattgctacaaaatttgtgaagtcgaatgatcagcttgctgatattttcaccaagtccctcactggtcctcgtattagttacatatgtaacaagctcggtacatatgatttatatgcaccagcttgagggggagtgttagtttgatagttaaatagtatagtaaataaccctaatctcatatgtattaggagtaggacatatatatatatatatatatatagggctcattgtatcattgtcaatattaatcaagaatattttctcccgtcctttctcacaaggaccaaatgtgatcacatgctttgcgtggattcactcattatcatacttcaggaaatgatcaatatgttaacttttcatcaaaagaaaatgataaacttgttaactcttggaaaatgcagtatttatcaatggggggcagactaatgttgattaaaagtgtcatggacaacattcctacttatatcatgtccctcttccctatgccaagcagagtcaaaaagcagctagataaagccagaagatcattcctatgggagggcaatagtgaagatcacaagtttcatttggtcaagtggtccaaagtaatcatgcctgagcaccaaggtggtctaggagttagggatctacaaaagcacaataggagccttttattgaagtggtggtggaggtatgctcaagaaaattcttgcatatggaagaaggtggtgacagctaagtatgggaagttggacaactggagcaccaaacaaagtagagctccacatggagttggaccctggaagtatatcaacagcttaaaacaggaattctttccagaggtatacttcaaagtaggggatggcagatttgttaaattctggttgataggtggatcctgccccaacctttaaaagacacacactcaggcattttccagatagccttggatccagactcatcaattgcacagaatagagcagggaacttatgggaaccactcttcagaaggaacctgcaggattgagaactagaggaactatttgatctcttcagaatcattgaaggttcttccatagaccttcaaactacagacatgctaagatggggcaactccaaggaacctgcaggattgggaactagaggaactatttgatctcttcagaatcattgaaggttcttccatagaccttcaaactacagacaggctaagatggggcaactccagcaagggtacaacaaattgtgtgcacctaatggaatgattgacaattggccatggaaacatatttggagatcaaaactacccactaaagttatttgtttctcctggattgcccttaggaatgctacactgacacaggacaatctatgcagaaggagcatccaactggtcaatagatgttacatgtgctgcagcaatactgaatcagtaaattacctttctttgcactgttcagtggcatctgacatctggaacatgttcttagcagtttatgcaatacctatggacatcagagaggcatttgaaggctggtgctcctggaaaatttgagaaatccataaaaaaaacctggcaagtgatcccaacttgtatctgctggagtatatggacagaaaggaattccagatgttttgaaggcatctcaacttccaccagctgtttgaagtctaaatgtctagtgaatttgtttagttggagctacctctcccctgtgaatgatgccattttccttttagattttattagctcccttagcatggcataatgcctcttttgattttggtcttggctaactcaagtattatagttttttgtctttacagagttagccaaggactcacactttgtaattttctggcatcttcttgatgcattcaatgaaacatcttacttcatcaaaaaaaaaaaaagagtattgtgtcaaatttgcatcaagataatgctattattcttattattttataaaatgagaacttacatcaataaaatttggcggtgggaagagataagatccccttcttcaaaataatgctattattttgaaacgagaacttacatcaataaaatttggtgtaagtaacgagaagggaaaaaaataatgctattatttttattattttataaaatgagaacttacatcaataaaatttggtggtgggaagagataagatccccttcttcaaagacttaccaaattagcttttgacgtcccatgattctgctagtttagaaacaccaccagggaccggctcaatgagcacctttgggcggcacaagacgattccacatatcgaggtcggaatgggatcgggtgtttttacgtcttaccgtagaggtcggtccgtgacccccggatgctgaaggcgtcctatcttccttctctcatatttggggttccacatatgctctaacccccacccccaaaccgaaaaaccaaaaataaagggccatggagctccatcaacattatttccatgatcaggcccatagatcagtggaggggcatttttgaactctacataaattgccattgacacttcagataattcagataatagtagggtaaagcggctccttttggatactgcctctgtgctcatcgcagtttcttcagtaagcttagagcttctttctggcttattttgctctggatagctttttgtctcatcttacctgggcttcacattcgttttcatgttttcctctcaccttatgttcctccatttcaaacctattcttctttaattgcaatcctttctatgtctggtttccatcttgggattctgcctttttcccctctacaagttccagggacatgccaaatgcaaacgttgtgttacttaagtgatggccgccttttgctttgttgcttgtttttcccaaagcacctgaatttgtattgaggcatagctgattgatgtttttggatacgtaggtgattgaatttttttttttttttaaatattcacgaggatattgcatgaatcgagtaaacttcaaacaaagcagccattatggttccgataataaactatcaaggtttaaaactttgtcaaagtttgtttcatagaaagattcaaatatttcaaggccagtggcatgtttccaaaatccaacctccatcctcccaaaaatgctccttcctgctgcacggctgcaagaaagaaaaaggatctgtttcacttcactcactgggataagcacatctttttgttttaacttgctagattttgaagcttatattgatctatttacttcctaaagagatgtcccaggcctgcttacatctagagattttgactttaggctttcttcggtttttcgctatcatttagaaatgcacatgttttagtctgttgatttgctattgatatttatgttgctattctaacttctttgattgcagtcacctggtgattgagacatcacaagaagttagtgatgttccttttgcagattattttcgagtgcaggtatgagctttacttttcataagggtctgctttctcgttagcactagtactacttgaggttatcttggacgggtttttgatcagtattgattataaatctgcacttgcatctatcctttttttttaaatgaaaaactgcacttgcttctatcattaaggtggtgcacaattcatgcgagataaccgattgggacatattcgtaccaaagaaatgtctcataaacggaaaattaaaaggtagacattgactgtgaaaattaagaaaggaccttaggaaatgctgctgctgtctttccttctcacattgcgatcatgttcgtaaacaaccattgctacccttctgtaatcatcagtcactctgttgaacaccagccaaaggggtcatttttctgggatatatggggttatgtttggtgggataaactttgggcaaatgtttgatggtcttaagtgcttagtctaattcttttctgggccccgccggatgaggggatttttggcatttttccctttctctccccactcaccttggactcttcttcccttaattctgtgttttgcgttgaatgttccttggatttttctttgtttgttttggactataattcaaccttatttgaatagattaaggatcgtattatagtattgctaagtaggaaccggatagttttatctgcccagtgttattagcaaattagtgtaagcactctgaatgttggtacatttatcttacctggctttgctgcctgggttattatgttcttaacttatcctgcctgaagtcatgtgaccttaatattgctggtttattatccccctcatgccagggtcatctccacaaacattagaattccaatctccttgcaacagtttgcaaccttccatagctgctactagcctgttaaatttaaactgtcaattcctgaaaacacattatcaaaatgattatgtatgttatgttattttatgttattttattatgcgtctattgatagtactaatatatcgtctctcttgttgctttcttgagccgagggtctcccggaaacagcctctctgcccctcggggtaggggtaaggtctgcgtacatattaccctccccagaccccacttgtgggattatactgggccgttgttgttgttgttgtaaattcatagatttgaaaatactatctggaacttgaagcttggaaagagaaatatcaattgacctcagtatttcttatgtacaattcaagcatggttagttttgtcctcccagctataggactctcatacctaagagggccaaaatatgtgtttttttttgttcttttagaggctgtttgaggttagtttgttggtgaaaggagaggttgagttgtttctctttcccactttttattttctttttctcggggatggtaggggatagaatgtggggatggggaggtgacaaggagtggtggctgtttgttgtctaaactgggtctgtcttgctgagactctaatgcaactgttcttgataaagtaataaagggattttcatgtgtaagtcagctcacagataaattatccccaaaaaagggttagccagcagagagtttaaactttaagcagccaaggtaagtatactttgtcagttcatttatgtctaactgaacaaccatttttacagaattgacaattgccaatttttatatgatgcttgaagatgaatatataagtaagtgagatacagagatactgaggagagaacaatcacattcaactgtacttttccaggatcatttgttctagataacgttgttcaatctatattgctgcatgtggtgtctgtttcacatctgagccgattctaacttaaccagtgttccgtctgtctaactttgttttctagttgaattgtagaccatcaaacaatgtcgtcttttgttttcagatttcccaatcacaaaattggtggctgatatatagtatattcatgtagtttatagattccatatgtttcaggttagccaatattggattccttgtgttggaggagggggggggggggggggagggttgttggtcatgttgaaatattttcgattttatcttagtttcttctcatgatatatttcttcctttcacattagggtttttgggatgtggagaaggatcacgatgaaccagtaggaggctgcagtttgaaggtgtacgtaaatgtggccttttcaaagaaaaccatgtttagaggtgcacatgtgtctttattgctcatatataccttcttcaagtttgacttactgtaattttcaaagaaacagcaagtgacttcttttttctcaagaaggaactgcaagtgtgatcttactgcgactttaagaggcgttgaaatctgggctagaatatcgtggctttttttcctttcctcttgtatgcagggctttccaccgactcatcaataatttaataatttcataaagcatcttgccttctcattattgaaagagttatgcttttggtgatagattaatcaaatgcttctatatgctataatccttctttattcaaagggcttcttatttataactctgacttggcttgtaagtaaacgtttgtgggagcacgggatgatgatgaaaatataaatcaataaagagacagaaaaaatgcaaaaaacagctactgctatcaatacaatattaaagtaaaagtgactaagctcaacggacacctatgtagcaattgcacaggaatggtcaattgtggcacaattagttcaattattttagagaccatttgatccaaaaagttactgttgctgcttttgccatatcgtggggctctccagctctaggaagtttgtgtctaggatctggtaattgacgattacttcttctggtcggcttgtactaacatgtgctttagaggcatatcacttttactatcaggatctggatctttgttttctagaaggaaaaaatgggttcctttcacttcgagttcttttgttgtaatcaaatatgatagagctggataaacaaggcaaggatcgcctgctcttcaatgcttgataggttaaccaaatgctttgatgtgcttagtacacttttgatgattgattaatcaaaatatttcgccactgatgctacatggggcttatccactcatattcgatttctttgcttctcctgaaaaggggtgtcaaataggcggattgggctacatttggacaggtcaaaataggttgcatcaaataaacgggctgggctataacctgctcaatgtttgcttgggttgaaaggggcgagtcaacttgggctaaacaatgggtcattgacccatccagcccaactcaaaacgttttccatttatttgtttgttcttttataatctgtttaataatcatatcaaaataataaaatatttttctttgtttattatgactattttaaacaaactgaactcaaaaaaaaaaaaacctttttgtgttttgataagttttcttatggatcattgccaaaatgacccgccaataaatatatccaagcccaaccctcaacaccccagttctgatgttgacttgaaatgttgaacaaatctacatcccattttttggagaattaatatagataaccatttgctagtgctcttccttcaactgagcctcatttatgtttgatcaatcatattttagttagtaatttcctagagtttatcttttaagttgctggtgattttccattggcagtcattatgagcatctatgttcttagttttttgcacaactaggggtttaatagttgttttatgctaagatgaaacttaagctttcagaaaattcctttatttattctgacactaactgtaagaccgtgaagccgacgcagctatttgctggtgctcttccttccacccagtcttagttgtgttccatcatatcatgtcctttaagttgttagcaatgatccattggcaaggtattatgaggatcagagctatattttttgttgcccaagttgaagtttaaagagttttatataaacaatccccacttgtatgtatagatattcctgagtctggggtctattggaaacaacctctctaccttcaagctaggggtaaggtatgcgtacattctactctactcagaccccacttgtgggattatactagtgtttgttattgttgttgctatacttgtatgtatagatattgaagagttttggtttggtaggctctttgaaagtgtgttttcatgttttcaaagtttacatgattgaaaatagagagagtttttcacctcatccacatggcatggcttgacatgatagtaaatacagaaagaagtttttcaccaaaggcatgatatgtgcagcactttttgcgtatatgttttgatataacaaattttgagcaagacgagatacaacagaaaaaagtggtcctacttaggatttgatgtgcattttagtgtatccttgttagtttcaatgcttaagcagttaagggaaaaaggtaacttatgatgatcaccttacaaaaatatctgtttggctgctaaatgcttggaaatctctgcagggaagatagtgcagtctactgttgatgaatgtcgagacgtgtatgcaatatggattgcccttgtatttttctcatcccttccggtttcttctattttcagtttgcaggtatttcaaggctgtttaagagattgatttgggtttttatttcaggcacatgaactgttgaagcaaaagaagttagagaaggaagaaggtagtgcttctgggaacctcttgtatcatacctttgtctgtaacaattggcatctgctgttttatatgttgcagtatatgttctttgattccaggctcacattatctgattaaattattttctgtatcagccggtggtcatgctgctaatgtggtaacaagtgctcagcagaaagaaagttctgaacatgtggaaatattagacggggcaagtgatgaagttaggtcacaaacactgccactcaaccagctagctgctgattccctgcggggtagttgtagcagtaccgtctctgttacttccttgtgtagaaatttcatggttaagtgttcatcatctttcaaatctcaaagccaggtttccattcttatagtgatcaccattgctgtgatcctgctcttaatgcaggtatgtttctcaatttgcgccttctatctgagattacgtttaactaatttgctaccacaaactgttcctcatatgatgttgtgagcaagggaaagtaaactgctttggtcatgtgatcacgcagttgctgattttcatgcttttttctgttaatcgttagggttgttagggtcaacaaatagttactggagaatttgtcaactgcagattgtacgcttgtttttggtctgaccctttttccctgattttggggttagtgtcgtgatactctctgtaaactattcttggtacagtagaattcacctttcgatgtccaagatagcgatgcaaacactccctccttaccattttaattgacttgggttgaccttcaaggtttgaatggcttattgtattggtttatttgaggagatcaaaataataatttgaagtgtgaggaagtgtacaaatttgttggaaagatcaattttgaagtaataaaaagtagcatatattcatatttgtttgaatagaaggggaaaaagttggaacaaattatgattgaaatcatagtactgacgaattaaggtagaaaccgggttaataaaatggtgacaagagagggaatgtaattagctgcatgttacaagagttggctgactttcggtggtagaagtaggttagggctatacgagctgatattcttgtatgtttgctctttccatcttgtttaaatgtaggaaaatgctgtccttgttcccttcgttttgatgcatgtggaacatgctttgtatttatctgtctctcctatgagatgtacatcatctgatcctggcattactctttttcattatatgccttctggaaaacaagtcaacattaccccctcccctgcaaccaactaatttgcgagtttcagcccagcctggcttttgtttgactctgtcaattttgttctaatttgtttgttactttgtatatgtgatgcattgatcttctagtgtgcatgacttaatctgttttcacatatggtggtcctcagaacagatcgatcagtcaatattgctgtcagaacttctcttgcaaactgaggtgaaacataaattttgctgtctaatcttttggtgtaatcaaacttcatttgcagatgagcatactcgtgttattaggtagacctcagcacgtccacgtgatacctcaaggggactgcacaggtagcatgtatcgactgggagataggggtatagacacactagcctttctggataaacagattagtcatctcaaagaggagatggttatggtcgaaacactgctcggcaaaatgcagcaggagcatacacttctaaacacgaaattgaaagagtttgagcgcctacggaagcaccagaaaggataaacgagctgtgtacatagatgctgctgcttcttttcttcccttccttattatcttctttttgggtgaaaggcttgtatgttgtacatttttctgatttttcgacattcatgtacattttgaattaattacatggttgcactatctacataaaatagtaaaacaaggttactggactgtttataaatatgcaagcgccccaagagcttctttatataaacacatataatgattagaataattatggaaataggataaacatgcgtataatatgtgatgctaaatatatatactcaatactcttccaatatctaaccatctaaattacacaaactcgttttggaagatatcaagcacaagttaacttcgttacagttatataatatgcaaattgagagtgcaaaagcactaaaatattttgaaatgagtaaccattaacatattgtagggatgaatcaattctgcacgtcacattttatagtgataagttatgtgattgtgttttgatgatttaacaaagcctgatacaaagcctcaaagtgttcggaacaaaaagtcacatgtctggcacaagttccaaatatcaatcaagggagcagcaaagggaccatattgctatcagttccttggatcacattataagttaactctttacggctgtcaaatgttacaccccatgttttttacgtgagagtacgtcgtaagtcaattaatgtaagctcagaaataagatcgtctttgaaagtacaaaaagtaagttaatcatgttatcttggaagttacaaatctttaaagtcatgaataacaagtaccaagagggttgaaaggcttacaagctaaacaaattgaagaaaataagtttcgtcgaatgtcgacaagttgtgaatgttataacatgtacatttggggtgatagtaaggtgcttaacatgataaagaagtaatgttatgagttattttagtcgtatgatagtcgtgtattatgatttgaagtcaaacgagttgtgaaacaaaagttggcaaaggtcatcacaagttacattcataaattatgatgaaaattaggtcaaatgtagctaagcttttatcccaatatacttgaaattacgggattatccacctaccagaaggtctacgagtctagtttccaacgcattaaacccttcatcgatacaagatcgaagtagagagatattcgtatttttgcgagactgcgcaaacagctccctatggggcccacttaggcagttgagacatcttgatgtatatgtgacgcctaaaactcgttttaactcattatttttcaccctcttcaaaccctagacacctaaaaacgttctctcaaatttctctcatgatccaagacccaaaccatgggcgaataacacaaatcaagtgtcgggaatcccgtgatgctagtgagtttcttgttcttcttgtggttgctgattttggtgtggttccatctcgtgtggggagttttttaaagtgatttacgttctgtaaaatactcttccaaggttttcatattgatcctaggtgattttaagtcttccaaagtgattctagagccgagaagcccgaattgattgctagttttgcttccttgttcttgtggctgttttggagcattcttcaagttaagtaaccacaaatttcatatttttcttgttgtttaaggtaataatcagtccttccttcatatattagattttcaaggcgaaatacaagtgtttacacacaccaacttgaacacaaatgttgattcaagaagagaatacaactcatatagtgttgtggtgtgattgagggttgttgtgagctacaatagatggggatttcaagttgtatatacttccaaaggtaattatatcatgttcttggttgtgcttaaggttatcttgatgtagattaagttaaatggatggactagacatgaactagagaataaagttgctaattgaggatagttggatttgtggattattttctttattataaatatatggtgtaatgctggaatcattgatgaatgacttaattatcatgttaatgatacttttaagctaaattaagaagtctataagtggtgatatagggtatacgtgatccaatcagagtttgccgctcatcgtgaagtagttgtgacttgttgttgttatatggtgtcttgttattgatacttatatgttgccggattgttctagttgttgtttttggtatatggtatttgaggaggcactttttataggggagatgctgccgaaattacgttaataagctgctagcttaagttactgatatagcctttactcaacactgattttgaatctccttctgctatggtagattgagttgaattgtttgaataattgcttggaaagtattaaggactcaagggggtcaaggtatgttaaggctatcaatattcccttttagcatgatccttatgatacaaacgaaacgagcaaacacggaactttcacaaatgacgttattcttagaattactaggggtgcctaagttcttgatttcccatgtgtcctattattatatcatctgttcatgggtctcagaaaatatgtatgttgataaagtttattttatgatattaaccgaaggcatattgatcttatgataccctgagtgatcttattgacttacttctcatgcattgcattcatttatacatgtatattgatccatgaccagatgacattatatacgcgtatattatatatatatggggtatgagaaatggttatggcattatatacgcaaccaccatcttatcagttggtatacgttgatgatttcgcccagagaggtcgagatgatatgataagatgccctcggaggcttgacgatgttatgtacgcatatacctatgcatgatatgacatttatacgatacgcatgaaattatgaatgtttcatgattcacagagctattcaaacttacaggttgagtccttttacttcatgtttctttcatgtcttttatatactatttttcatgccttacatactcggtactttatttgtactgacgtattttttgcccggggacgctgcgtttcatgctcgcaggtcctgatagataggttggcagtcctcctagtaggctatcagctcagcggaaggtgttagagcactccacttgctccagagttgtctatttgattagtattcttaggacatgtattgattggtatgacggggccctctcccggcctttatgatgtttatgtaatcttagaggcttgtggacatatgtcatgtatatggatgattgtatagccttgtcggcctatgttttgtgtgtacaaatgatcatttcgatcttataggtatgtatgtcacatgtatacgtttgtatactatattgggtcatcctaggttgagtattctcttatgtttaattctggttatctcatgacggcctttcaggcttatttacccatgattgtacgataataaggatatgttacattagtactcgattgagttaggcactaggtgatcgtcgtagcccttcggtttgggtcgtggcattaaagttgttgcactgcaggcgcaacagtgcaacaatcactttgaagcatgttatgtaccaatacgtgcttgtataatcttagtgacctcacttatatattatcaacatgaagcaatgaatacacacgctcgcaaaccctacaacattattttctctcaagtgtgcaaccgcctttatttactccaaggcttgaagaacaaagaagcaacagaacaaatgagcagatccaagcactgagttcatcatgtgtccttagtattattgtacctttgttaattttattcacttgtaattcctactcatcttagtaagaagcatctcgtagaatatctttgtaaaccataagccttgtgtctgtgtttgactagagttcatccaagtggtgagctttgtaataatagagttattacaaagagacttgcaatagagttattgcaagtaggtgaaggattaagagtttaattcctaggttacaataggttgtaatttaaagttgctcgattagtgaagttgaaatcctacgagcgtgagctgagagttttccacgtaaaatactaatgtgttatttacttaccgttgtgtgtgtgtgctctgtgagaactgatagagaatcaagttctctatacaatttggtggactcttagtttacatcaattggtatcagagtaggttctttctataaggctaacaccttttaaggatctacatggctgctccaccaaattttgaagaaggtcaatcaacctacaaaccaccaagattcaatggacaatactatagttagtggaagacaagaatacatgattttatcattctgaaaatttggagatttggaatgtcatttgtgatggacccttcgtccctatgaagaccattggcaatacagcagtgacaatcccaaaaataaagaaggaatacaatgatgccgatcgcaaagctatcgagaaaaacttccgagcaaagaagttccttgtttgtggtattagaccagacaagtacaacaaaatctcatcttgtcaattttccaagtatatttggaaggatctcgaaaccgcacatgaaggaaactctcaagtcaagtagtcaaagatcaacatgctcactgttgagtatgatctcttcaaaataaaggatgatgagtccattcaggacatgcatactcgcttcacttccatcatcaatgagctccatcttctagggatgatcattccaaggaacaaattggtcaggaaaatacttagtatgttaactggttcttgggagagtgacgagttagtatgttaactggttcttgggagagtgacgagcttgaaatacacacttaaatatgctcgctagtcgaatatagtaatttataatatcgtatccacatggattggaattaaatagtattatcataatttgtagctagatttgctatccaagataatcaacaatggagatttatgtgatttaaacttgatagaatataagggtccaccaaactctattgagaaccaggttctctattaggttcaacagtacacacacacagtagtaaataaatgacaagaggaatttcacatggaaaattcccaactcaacgggattaaaaaccacgacctacccttgtaggatttcaactgcactactgagcaacttttagattacaacctatgcaacctaggaattaacgtcttaatccctcactaacttgtaacatacctattataagccactttgtaataaatctattacaaagactttacaacatgactaactctagccaagactcaaacacacaggtttaaggtttacagaagagttcctacagaatgcttctaaacaagctaagtaggaaatacaaataaagaactattacaaagttacaactcaactaaggacataaaatgacttgatataggaactggtctgtagttgctttgttctttattcttgaagcacttgaaactttcttgctggatagtcacatgagaagcttgagtaaaatctctaagtgttcaagtgaatgtgttttacctcccttggtgttaataatacatgtatgacctcacataaaatgatgtaagcaaggtaggtaaaaagccttccacagaaagttgactgttgcactgttcttgtacaaatgcgtgtgcaggcagcaactttacagctggagagttgacttcgtacagtctcatcgggaattggtagggacgtattccctcagttgttccttccactctgaggagttgaatcatatcccaacctggaaccttgtgatcttaaggtcttgtatatatgaaacaagttccttatttggttctggttagtaagtttgttggataatcaaaacataaagtaaaatacatatgaccaaagtacttgtaacctatcaattttttcctttttgatgatcacaaactcattattaaaaatcccagaaagagccatatagaaccagactgcgaactagaaagaccttaagtttccccctgaatctttgcatcccccttaattagtacctgaacctctgtgagttccccctgaatctgttacctgggcttctgtgagttcccagtttccccctgaatctatcctttccccttgaatctgttacatgaacctctgtgagttcctaattcccctgaatctgtatttctcccccttcagattattattcaattatgctctttattattcaattgaatccttccccttttggcatcataaaaagcacagaacaagtatgtagcataaagaagtctagcatagttaactcatgccacttgtgtgcacacaatatgatagaaaatagaaataaaagagcagcataaacaacaaaaaggaaaccacttgcattaaccaaatttggacttttacaggtgggagcaaaatcattgttatcatccatagtttaaaacaaacaaaaaaattgccagaaacaaagaaaaacatcaccaaaaacaacttaaaaagatggacattggaaactggacattgaggggacaatctttaggggacactagaggaagggggcttagaagaggaagcaaggggttggaggacaagatccatgtgagcattcgtggacatttgctcattgagcagtctttctttcagatcctccacttgtttcctaatctcagcattctcctttgttaggtgtgcaacttctgagctatgagaactactagaaccatgtgcctgttgtaattgactgagctgactctcaagaattgcattcctagctttcaacttccggatctcctctatggcgttattctgagcatttattagttgagagatagtggaagttcttccaactcctccggctttgtcaatacactcacactcctcaagagtagttttggaaaaggattgctttttagtgcccactttggcctgtcccagaggtactttaaaggactcaaagacctttgtgataagaaaaccataaggtagtccaggatttccatccttaagattttctaccttctgcatatgctcaatcattatgccaagcaaattgatggtggtaaaattatccaaggcttccacaaggaatatgtcagctttggatgcaacaaatcttctctcagcgcggggaagaaacactttgttaaccatctcaaaaagcaattgatatactggaataagtgccttcttatgcacctgttccccatattgtattgccttgtccttgacaatggcatttctgaagtttgatatgcaggcaccctgaacagacgacagtacttcggtaggaacacccagaattgaccccaataaggcggagtgcatcactatgtccaccccatttatcaacacacaaatttgatcaccctctattgtgaagaggctggaatagaaactcggtacctcctcctcatacactttgggaacctcatttgtaaacaaatttatctattgttgagaatcacaaatttccaccaattgtctcatcccagcaagttctagaatgttagaggcaaatgtgcagccccatagtactttctgattttttaacttccttttcacagtactgagagactcactaacttttgctttcttgatggaaccaggttcctcatcatcgtccaattttctttttactgacttgcgaaaagactttcccttctccactgactttttatgcatatcttcagcagatttttccacttcttcatcatcagacttgtcaccactctctttcactatcttgtcacaagaacttttcaccaacatttcattggaagcagtatcatcactcttgaaattactttcagcatttgtagaagtgtgccttatagattgagagtaagagtgcttctgcttcaaggacttgtgaattaaggaactaggttcctcttctgcttcctcatcaacatttaccatagggacgaccttttcatgcacaactcttccatcctttaccagccttctctttcttttgctcctttgactcttcttgagagcagactctagagactccttttgctgcaaccgagtaatgggtcgcttagggattgactctggagttgcaactagcttactcctagccctgataaaactagcatattacaagtcatttgtgtcttcctcactatcagaattcatctcagccaacaccatattcagaggctgagcatagaagtggggagaaagagcatgatcaacacttgggaccccagtaatgccatcttgactcggttgttcaaatggaacaagtgctccgcagtcttctgtagcatgagtcttttcctcctaagactcaaaccctcctccaccttcctctataacaaccccttctgaagcaatgaaaaacatattttctattccctcattttcttgtgtttcatggatatttcaagagaaagaggagtgatacctgtaaaatagcagcttgtcatggttgtcccagtcttttcatgaccaatcattggatttcacttgagtgcccattcatggagagagttgatgtttcctaaacaaggttcccttgtttaccctgtttactctatttgaccggtgagactttctcagataaggaacataatcggagtgggtaggagagggagtggagtgtgggggagactctgctttaaggttttgactactgattgtgtcagggaaggagtttgccactggaatgctgactggtatggactcaatcacaatattgtcaggtacactggaggtttcttgattttcagacataatgagatttgtttactgtgaaaatggtaacaataattaaatttgtaaatggaattctaaaaatatgtgacctattctcaagctaattgttagagcagatgatgctaagaacatgaagtttaacgatgaggtgcaagctaaaatgaggcagtaatcaaatcgaaggggcctgttgcccagatgcagaatcggtcgatacggacctcggggtcgagattcgagtcgagctcaagatatcgggggcagccgggaatgggataacaattaaggatacgattaagtagggctctttacgaccgatattgagaaatatagtgaagaacaagtaagagaatgatagatattaaagtgacctcgggccagtgagaacgagcaagttagaaagaaaagagagagagatattattgcatttgtgaagaaatggagcaacatcagccctttacaaggtagggtgagtcccctttatatatgagggaggactcggctacaagtatgtggagattaattacaaagtatggagataggatggcttgacgtgatgcctcaacataggctctggataggccggccctgtaagacttagccgtgtgccttgggagcttctccctctgtcctggcttcagtctccattttctctgagtcgggtttcggcgagccccgaggttgggaactcggtcgtggcctcccggggggtcccgagggatgcttctgaaatgacttgacaacgagaaatcaagtcttctgattttgccgcgtacagatagtctccgcattttccataacaaagtgatagaaatgattgtgacacttgactcttcgagcttcttttggcgacgccatatcaatgatgcaactcctggcgtgagctttgtggtaaccggacacctaccgactcgtgcttttcgacctcgttcattgcactcctgattctttcttcctatggtgaaggtaccgccgtcggttcggttttccatggatgcattgactgcggccgtcagtcaatcttccaaagcctagatgatcgtgtcgtaaccccctataaatgggggtgccttggctttgcttttcctatcccagtgcctccgttgacttgcttgcctatttcttcttatcatcttctttcacccttgaacatcatgctaggggctcatggcctcaaggccgtttgacggaggttccttagaccgtgtcgtggccttctaccggggcttcccttcgtcgagcataaccatgttgtcccgctactgatgtggccgttaacatgttcattgtggctggtattactggcccgaggtgatgatggacggggagttagtttccccatcatgtagacagtcattcggattatgcaccgctgctcaccttcataccccgactcgacgttgtgctctgctccaagttgggggcttgcacgactagacattccaaggagttgattctaagtagccgtgcaagcgggactgaggattattcggtctactatctctccaagcttcccttggccaaagagggtcctcaagcttcggagagctacaacgttttttcatccctccctgccactcaccttgtcccttggggatatcagtgtggaaggttgggatgaaacttccaagggtgcgcgtccggaggcacctgttgcggaccttcgaagatggaccgatcttcgagctttcactttgcgtgtgcatccctttgtctattcctttaggcgtagagatcctccgtaggattttgtcattgtatgtaatgtcccctcgagggctattgtacatagatcttttatgaatatgaatatactccattgacttctgctttcgatctttgttttgtttctgtatgctctcatgtcctttgaggccctttgagtgccttcctttatttgttgatcgtcgatatctgacttgggcgcgggcttctttccgctcttctactggtcgacatggctctctattgaacccatcgtcgtacttcagactaatcccagattgatacttcggaccaatcccagattgatctgattggcccgggataccgaggtcctccgagttgtatggagacaatgcgtcgaatttcggatccttcaggaatgttatcctgaacgaaggtcagcttcgggtacccaggggtcctttttgatcttgatgtagataacctttttttaaagcgtataggatagacttctgctgaggagttgcctatactcaggcgctgcttcggaccctcatggagctttagcgatcggagcttcctgtgtttattcctctttttagaaagagggaatcacaagaccaggtacttgccttgcatcgagtgatggcgttgaaagctttccgaagtccaacttctccttggcggggatcctcggggtagagcgctatctcgggattggacataatacggacaatttctcgaactttggcttctcgtcgaaggatgttttcgggattgggtatgaccccgtcgatctgtatcgaggctgtaggtttcttgggctcactctgggtaggcgagtcatcgctgcttcttgcatatatgtggggcggcttcggcttcttcgcaagacctcactattttagatagctacccttctgctttggcatagggttctccatttcttcaggcgcaaaaaacattggcgcacgtccttgctctgatctgttagttttaccacaatcatggtgagcacttcggggccggcccgtcaggaagtagggagtgctgctcctggcgctcaggatccactagggtttgttccgaagactgtttctacgataaaagaggaacatctggagatggtgaggagatactgcgggtggagtgaggggataacactgcaagtgctttccccagatgagagtattacggactccactgatggattcttgagcatatacctataccctttcgcatttggcccccctgatagggttgtgcttgatttttgcttaaagtatcgggttactctggcgcagatacatccgttattttggtgagtggtgctgatgatgaggttctttgcggagaaggctgggctcgaattcacgtttgatcacctcgttaggctataccagccctttcatcatcgaggcctgctaactctgaggtgccgtttatccacgccctttgttgttgatgatgaagaagatggggatcgagagtgggccagttggattattcgggtccggacgactgacatcatccctacggggcttttgtcatttcccaaagggtggaatcatgcacgtgcgtggggcgtttggtgtcacacctcactttttacgggagttttttccaacttaaagtgacaatcgaaacgggatcattttattaaaaattcagagtcgccacttgggataatttatggtgtcccaagtcaccggtttagaatcccgaatcgaggaaaagattgactctgttttacagtccgcgaacttagaaatccaggtaaggaattctgttaacccgggagaaggtgttaggcattcccgagttccgtagttctagcacggtcgctcaactgttataattggcctattatctgattttaatacatgttttagcatatgatacatttttaacttattagccgcttttaattaattttaggaagattcaacgttatctgaaacacatcttgaaccacgccacatgaaatgcacccgcggtccacgacacattttatttaacgttattgagatttggatttgggtcacatgaaatgcacacccgagtttaggaaggtaaattattaactagcacgcctaaagcaaaccacgcattgaattattttcctaatctttgagattgttataaggccaaatttatgaacaagatattattggggccaagggctagctaacatgatctattacttggcctagattctttatagttcaagacacaccttatgcccattcttattccttgtcaagaaagaaacaacttcaattttcatctacccaattaaaagtatttattcaagaacccaagactacatgcatcacaatcaaaataaaaaaaaagaaaaaaaaactaattaaaacaatttaaaggaaaactaggacatgctactcaaacaacgtggaatcacaaatcaaccaacacgcgcaccaagctattataacacaagaaaatgataatgaaaattgaaaaattgaccttttgttgatgcacaaagctgaaaattgcaagtcagtcgggctaaacaaagcaacaacctcgatggaaccgtgaattaagcgcaaacggactcaatttagcgcaaacggactcaatttagcacaaggaataattgactacattatcgagctggggttttattgttgtttgaatcgccacattgctgagaatcttttcctgaacagcaaggtttgagacccttttgttttcttgggcaagaccataaaccgtgagaggaaatatttctgaacgaaagtcgaatatccattggtatatctccactgtaattagcggcgaaatggattggccgtcaataagatagtggtttaaccaatattagcaccggaatgtaagttcttcaatgtcgactctaatctgtgcaacaatttaaaacactaaaaagcaaggtaaggatatccaagaaccaatcagcaaattcacaaataattcatcatctaattatgtaaaaataaaagtagaggaaaatctattgaaactttacaattaacacaaatttaactccttcagcatcgtttaccactttccttatcttctttactagtgatttcaagactttattgtctctccttgatttagctgcttgtttgagaaaagcattgaaatcattcacatctcgtagtaaattttcaactttactttttattccaataatcaagtcagcattgtagattaacaattacatcaagttttctactaagaatttcattgctacatctaccatggctgaagcaacaaattccgttgagcagaatataattgccactaaaatgggagctgccgttcttttttgtgtagtctaggtctaggaattaaaaaacttcgggtaaagtttctataattggatattttatatggaagtgggaagggatgatgaccattggatttgaaggaaatagatgactatgattaaatcttgcacttaaatgggctaatgggttgagaagaatgagctaagggtaattggggtggaccatgtctttttgtgtctcaattttgggctaagaagactccaaaattattattcaaaaccatagctaaattcctttaatataaaataactatactacatgatgcaaaaacaaattctaattaattaaactaaactatattaaaacatgaaactattatatattttttgtatttttcaagattatataaagataaaaataaggtactatttttgtatttttttactttatgaaaggtacataaaataaaatatttttgtaatttttattttcttgtaataaaataaagtaaaagagtcaaaattagttgaaatagcgatattaaacctaaattaaatatttacatgctaaagtataaaaaatcttggggagggtcaaaaatcacatgtctacatctggcgcttttttagattttgcctatagcgaaaattagttgagtaataatgttgtctcccttgttgcagcaacttcgtggatgccgggcgaagtccttgacctacccgactgggtccggagtttggtgaccattcgacctgcgacgagcgcaggtggcgagctgtatttcgtaccagatggggagtgaaataccaaggtatgtgcgtatgttgcctttgccttggcctttgtatagttgaggtaacattttcccctttcatttgtactagattcgccgtttacagatatcaggcggttccttgggatgaggtagtgctcttccgaagaggggaaggagtcgtcggccttcgagccgagggacgatggcgataagggggattggcacccgcggggtgatggagcttttagtggcgctgggcaggcccgtatcttcgaggagagggcatcgtccgagcctgatgttcccggagtatcagattcccgggcgacggttcctccgagtgaatatgctttgcccaaggttggttctcttggggccggagaggcatgatcaacatgagtatgttctgactttgaggaagtccgtcggcttctctttgaggtgagtttaggtgtgttttttcctgcatgtcgcgccctcctctcttcattgagttttccttgtgcaggcttatgataggcttatgtctgagctgctccgtcaaggggccaggctccaaaaaatcctgaatgagggcgagtcccttaggctccttagcgaggagaaggaggctgagttggtgcattggcactatgaggtgtatcagagctcaaactatgagagctatttgatggatcaggtaacttcctatattacgtgtttcactcctttctaaccttaaggctaaccccttttgttatatcagctgtagaaaaaggcggaggccttggagtacctcaaaggcgacgtcaaccacgtcagagttgcttgtggggagctaagggctcaagtgcaggctcgagctttggaggagataagtgcctcagccaaggtccctgccttcgaggtccaactctgcgtgactcgtgacaacgccaaagttaaagcggatatgattgggaaacttgaatctgatctctcgaaggtcagaactgagataatcgatgcccaggctaaagcgacattaagccgaaccaaggctgatcaggagatggcgattcgtatgaaagatgttgctgatgcccaagctgagctgaagcgagccctcgatcgggagaagaggatcgaggaatatgttcgttgtagatcccgaagagaggtactcgaggaggtcgatgcaaggggcttcgtcctctcgaaggaattggctcgagcaagggcggacgagcgtgatgctcggtcacttctcgctgacgtcgcggagggcgaatttgacaagctgtagacctttagtgtggagtgtagatttcgtcgttttgtcgctttgtttttgatatatgtagagcatgcatgtagatggagaatgcgcctttttcgtgcatgtaatatataggaagaaacttgaagctttatttcttctgtacctctcttctattattgctttcgaccgggcaggctggttttggtatttggcgggatcctcgtaggtccggaactgatcggacagacccaggggctcttgagtgtaatccttgacgtgagcagttcctggggcctccgtgcttggcccgactgtttaggcttagtttcctagttgggcttcgactcgagccttcttgcccttgaatcgtttatgcccgtgcgggcaggtagtaattgttcttatttcttgcccttgtgcatttgccgtttcgactattttgggtccagtctccgagtcgcatcgtgactcgagcttccattgagcctcaagctttttcctgcccgcatgggcggatgatgatggccttttgtgcttcgagtcgaagtgaccttacaggcgcgtggcccagagactcgctcggttggcaatagtggcatttatgccgtgctctaaggcatattgcagtttaactatttcgggtccaatctccgagtcgcgttgcgacttgagctttaattgaccctcaagtaccttttggttttcagactggcgatagtgcctcttacgctgttttggtcgttgggaccttttgatatgtggcccggaggcttgcatagttaactgttttggattcagtctctgaattgggttacgattcgagctcattttaatcctcaagttgtcaattttcaagctggtgacaatggctcttacgctgtttggtcgtagagaccttttagtgtgcggcccataggctcgtttggctggcgacaatggctcttatgctgttttgcttgtgggatttttctaggctttgttttccgctcgttaaggtcttttgaaatatttttgcctgacctatcatcagttctggaagaaccttgatttcaagtcattgtcggcgatgttttgagcacctcggaaggttcatagcttgtaggttgagtagatcaatgccttgcgattttggagccgacatggtcagagctcatttttgcctgttgagggaagcatgttttactcggttctttccgaagtatattcggagtagtgtcctgcaattttgtttagcaacagtcgggcatccccgagttgcgttattttggttatatcatccgttttgaccgtagtcatatgtgtttggccgtagccattttttttatcccgagtgatagtttaagcatctacaccgagggtatgccctttagggattcttacaaatgcgacgtatagcttaaacttcgggattttcatgcctgttgaggtcttacaatttgttatgcctattaaggtcttacagtttgtcatgcctatttaggtcttacagtttttcatgcctattgaggtcttacagtttttgtgatgtagaatagatctagttgagtctgcccgctaggggtcttacaggtttcgggttttccagcgtgtggcgattaatgacagtcttcgagtaatcaagtttgtttaagcttgaagaccgcttctcatgagttcagagttgccttgtgggggctttatgagcccggagttccgaccctggggtcgtgcgggtgttgaattgctgatgctaagtctctgagtatctcgggatgcatttggcggagaggcccttgccacgagtatgctgaaatccccttttccgaagtatgaaatgccgaaaatatattctttattgcttggcgtaaacatatgctgtaaatacatgttgtctcgttgttgtgatctcggcacgcgtaggtacgactcttcggaccatctgattcgttacaaggttcccttttgaaactcagttgctatcttcggtccttccgagggaatggtgcccttaagagaagatcatcactcgtcgtccgattgtagaagaaggcatgtgatcttattggatcgtgctggcgggacccttgttgggggtacgctgctccgctaataatcttgctggcgggaccctctttgggtttgaagtccggtcgagggaagagagcacggcgggccctgctaaggtcttggatctccgggtggagttagaacttctgaatgccccggttgattgcctacatacaggttagtgaaaaaataacaaaggagtgaaatagttcttcctcaccgcgggatgtgtaggtgacatttcaaggtttggtatgtttctgccgttccgaggcatgagccctaatacagctttctactgtgttcaaccaggcttggccaaagatgtggttttgcgtaccctccgatccctttgagggcggaggcattgacgccggcgatgagttatgtggtgaggatttttctctcgtcgcgtgtttccccttgccgccttattttaatcatgccctttgcatggaattcatctttccggtgaagtggggttgatgctgtctccgggcggtgtgccagtggttgtctgaataggacgcatgcgctttctatgatggtgcagagctcggcgtctcaacctgagctcagacgggctatatcaagagaatggttttcgtggcgatcgtcatccggaatccgttggggaatctgttggggatttgagatgcaaaagcgattcagtctgttggtccggaccgctcaattgattttggtccgacattgttggtgtacttgatcaaatctcctgaactcatgaacatacattttattgaaaatatattaaatgagggggagggttaccaatgtgtcagtgtgagaccgaggtgaggtcttggtgtccttttctctagatgtaagggtgccctttggaatatttccccggacctgttcttccctggtgacgaagattttcactttccattttatgagttcttgggggttttcaccgctccttcactgtcatggtaatacgtcgtgtcttgtttgcttcattcttcccgattgctttcctcccttggggctgggttcgagtctgaccactcgatgatacttggtggtgatttttattgagtagcacggttgtcgtccttttgagctggtggccattttcgaccccgtggcagcgcgcgctctgcagttcccgcatcgggttgtggttcttttgaaggggtcttggtcgaatagtcctgagtcatttggaatccctagtttcgcttatggtgatcatgatgtttggtatagcaatgctgaaatcatactctgctgggcggggttcccctaccggctgtgatattgaatttggttccactagaggttcctcgaggatgttgtcctcgggctatttccctatcgttgtgaggtaggttgcatcttgtgccgttcctcccatacgtggcgcatggatggtacctctacctgtttgacattagtttctttgttaggagtccgctttgatataccgagcccgaggaggttcccgaacggttttccaaggccctgctccgtggttggtgtggggtgcgggtatccgaccagatcttggctgggtacctgaccaagcttcgcttgaaacatcctggagtcatcaggcatgcttcgtttgaacttcgggcgaaggtctgggttgtccagccatccgaaactgggagcgatctcattcgtcctattagggaacgagacgcgacttcctttggtgcttcactcgctctttgtttggttccaggtgtgtcgggctcttttgttactacttcaatgacatcggtgtgtgctcctgcggaggggtctgctgatatggtaatcgggtttgtcaggccaggtgccaggctgcggcgctgcgtcatggtatgttttgagagtgtttcctcgaacttcctcaacgagacaggcttgaactcatcatcttggaagtcgctgcctttgaatgagcacgtgcaagcggtggtgcgctcgtagggatccaaggttctgtcgtaccttggggggtttcggcgttccgtatttccatgaagcaagtttcgggaccgcttcctcgggagacgattgctgtatgaactttcacgaacctgacccgatcctttcgaagagatccccaaacatcctcgttgcggtggggtcggttatcgatccgttgttgcttgatctctcgggtactcgttcggtgtagggagatgtttccggcgctactgtgctgggagtctacgggtaactttatagctgagtgatagccaactattgtgcctgcaacatttcaaaaataacatgaagactaacttcttgttcttctcgggccgggtttttttgagcttcttgttggtcgatatgttgtatgctaccatcgatgcgcaaggctccatcgacctgttgcgtgccctgcgaacctgcatatgctaaaattggtccagatgcattatcgaggttctgcggcgtcgtgccagccactggaacagctacgccgtttctgccgtgattttcgggttagtcgttctcgattttgctcaccgagccagacattttgacctgaaatcaaaggattttggacaagaaaaagtgtgaaagataatgtgcgtttgtgcaatgaagccatcaagaaaataatcactattatttttatcctcacggtgggcgccaaactgtttaccgtgaaaatggtaacaataattaaatttgtaaatgagattctaaaaatacgtgatctattctcgagctattgttagagcagatgatgctaagaacgtgaagtttaacgatgaggtgcgagctaaaatgaggcagtaatcaaaccgaaggggcctgttgcccggatgcaaaaccggtcaatggggacctcagggtcgagattcgagtcaagctcgagatatcaggggcaactgagaatgggataacaattaaggatacgattaaccagggctctttacgactgatattgagcaatatagtgaagaacaagtaagagaacgatagatattgaagtgacctcaggccagtaagaacgagcaagttagaaagaaaagagaaagagatattattgcatttgtggagaaatggagcaacatcagccctttacaaggtagggtgagtcccctttatataggagggaggactcggctacaagtaagtggagattaattacaaagtatggagatgggatggcttgacgtgatgccttagcataggctctggataggccgaccttgtcagacttagccgtgtgccttgggagcttccccctatgtcctagcttcggtctccattttctctgagtcgggcttcggcgagccctgaggtcgggaactcggtcgtggactcccgtcctcggggtcccgaggcatgcttccgaaatgacttgacatcgagaaatcaagtcttctgattttgtcgcgtacaagattgtactcgaagggttgtggattgagaagagagaaggcaaagaagaggttttgaatttggaagtgaagggttgtgatgttgatttatttatgatgagggaccgttctgaaacggcgacaaccttttgcttggggagttgtatcgttcagaaaaggtgtgacgctttggatgaaaatacacaacttaaacagactatcacgctgatgatatagaattgtttttgtccattttaaattgtgtatgaaagaacaaagaaactattaacctgtatcaagaaaaccaggttccctgataggtttggaaagtgagtttaaccccttttttagaatgcactgcaatatctgcttctgtaatcatcatgtgtatctacctgtgacagtataaaggtgattagacttatccagaaaacactttagctaacttttacctgagtatgactttcataaccaatcgtgaggaaccaggttctcagttgtgctttattatccccaatgcaaggcgattttcctcagactgttttcttctcagggctttggtgaagatgtcaacaacttgatcttcaacaatcaatgtatttgtccctcttgagttggactcaaggtcttccaatttgctgtttggtctacaacatctgagcacaacaggaggtagatgatacatattcggtttcaactgttgagagtgccattgaattttgcttccttgagcctcatgagacaagacgggaatccagagaatgtcccttttttgacgtgcttttcctatccattacttgaaggatagtggaggaccaggtcttgtgttcctctaagatatctcaaaattcttataacagccttcagatgagactcctttggatttgactgaaacctttgcacagaacccaattctgaacacaatatctggtctacttgcagtgagatacaagagtgatccagtgatgtctctatgaatggtttgatttagagtagaaccaggttcatccatatctaggcatgtagctgaggcaatgggagtgctgatgacttgagatgcttctatgtcaaaccccttttgacaactcgattttcagcttctgttcttgtagtcgtgggaccaggttccttgctggaatcaatgagcgttctccaccttgatcagtatttctattccctcttgggacgagtatattaggaggattcctccatctcttttaagcgtcaaattttcgaagttgatcctttccattgttgagaacataacaattgcacccagataccttctgatgagtcagcaactttggtcaagatatttgcaaaccctctatcaaataatattgacggtgcaaaatcttcaagagtcttgttcttcttttctacaactccatttgcttcagtgttcttggagctaagaagttgagtaattcttctttgaatgcaacattcatccactatggcattatctaaacctgttccatgatctgatctgatgcaagccatatttgtttctatctatacttagatcttcttgacaaaagccacaattacttgagagatctcatccttggttctgaggaataaagtccaagtggacttggagtagtcattcactgtcaacatatatatcttctttctttcctgtttggctctttcacttctccacatagatccatatgaagaagatcaagtggccttgaggtgatgactaccccctttttgggcttgaatggagatctggcatactttcctactgcacactttatgttccttgatactcaacttggtcagaccaagaaccaggtcctttagagccgatttattcagtgatgaaaaacttgcatatcccagccttctgccccatagttcagcatcgttttcaacagctctcaaccaacttgtatcaccacttctacagaggatcaaacacatcaccataagtattattgtgccttttggctacaacatcacctcactagttacaagatttgacattgtgcatatcctcgacaagaattccattttatttcccttgtcacatatcttccaactcctaaagtgtaccccttttagctgtttccaaaagggtacactctctccttgcaaggcttttagtgaaggaaagttgatcgtatttttagtcatgtgctttgagcaaccgctattcatatatcattgtaggtttctccccttcactgctcactgcataaggaaataaatggttagctttaggaacccaaataagtgtgggtcccttattatgagagaagggatgaatgagtgctcttttagtccaagtaggcattatacgattcctatttgacgaaccatgtcctctagcagtagttactttctcagcaaaaactttatttttctaatgagactgaaccctggccatgcagttttccttgaggtgcccattgttaccacagtgggtatatagccaattgtcggttacagtaacgtacttgctatgaggcttgtagggaattttttccctttgaaacccagtcccttgcttgtttaccccgctgttggtgtacatggcagtgatagcatcagaggaccaggtccacttaagcgatttttcaaggtcattttttactttccctagttctttctgaagctgtttgtttttctcaagttcagcacacagactagtctttaccaaatttaactcattttcaagcttaatgtgtgcatcacttgcaaatttctttcccttttcagagtttctaggcctattcaccatttttaattcctcaattatctctttcaagtctacgaccaccactactaggtcatctctctcttgctaggtttctttttgtttacttatacacccaatggtttcttttaagtccaccacaacaaccattacatcatctcttttatgttcgatactggcaattttctcttctaaggcattcctttcctttttcagattctctgttatttctttcaaatcaactacaacgactactaagtcatctttggtttgttcatcttcccctagttctatagtcaatgcatctttatcattaataagactatggtacgcatcaattagtacatttgctaatgacacgagctttttaggagagtaagattttagatttctctgaacatccaaaaaatttaccttatcgttgtcatcttcatcttcatcatattgagccattaaagcaaagattgaatcatactaagttgtttcatttcccactaccattattgaactaccaccatggttgatttcttcttcagattcactggaggagtctccccatacagcaagagcttgctttacaacattgttagcgtcattctttctcttgaagcgtttgttaggaacccgattcctcttagctgctttgtcaaagttgttattgtactaatcttgctttaggagagggcaatccttgatgaagtatcttgtcttgacacatttatgacaaaggtcataatttcttggctccctagaacttcccttttttggaatgcctccattcctgtgaaccatcttctggaatcttcttgtcaagtaggccatgtcctcgtcttcaccacttgagtcattgctgtctgtcttgaggaccaggttcttctccctctagggctctcttctttcattgtccttcttcttgttcttcatttcataggttttcaagtttctaacaagttcatccatggtcagtgtttgcaagtcattagcctcagtgatggcgttgacttttctttcccaagaactgggcagtacactaaggatttttctaataagcttgtttctcggaatactttcaccaagagagtgaagctcattgatgatggaagtgaatcgagtatgcatatcttggacggattcatcatctttcattctaaagagctcatattctgttgtgagaatatcaatcttggatttctacttatgttgttcccccgtgagctgtctaaaaagcctcccagatctcttttgctgattgatatactgctatcctattatatttatcaggaccaatttcacacacaagaattttttttccacgaaaattcttttctatggcctttctgtaagcgtcattgaattccttcctcatcttaggaatggctacagctgggtcaccaaggttctttgtagggacaaagggtccgtcacatatgacatcccataactcagaatcttcagccatgataaagtcgtgcatcatagttttccaccatccatagtattgaccgttgaaccttggaggtctctaagtagactggccttcttcgaagtttggaggagctgccatgaggatcctttctaggtattaacctgatagaaagaacctgctctggtaccaatttatagaatataagggtctaccaaactctatggagaaccggttctctatcaggttcaacagtacacacacatagcaataaataaatgacaagagaaattttacgttataaattcccagctcaacgggattaaaaaccacgacctacccttgtaggatttcaactttactactgagcaacttttagattacaacctatgcaacctaagaattaacctcttaatccataactaacttgcaacacacctattataaaccactttgtaataactctattacaaaaactttacaacatgactaactctagccaagactcaaacacataggtttaaggtttacagaagagttcctacaaaatgcttctaaacaagctaattaggaaatacaaatgaagaactattataaagttacaactcaactaagaacataaaatgacttgatatgggaactggtccatagttgctttgttcttttttcttgaagcacttgaaactttcttactggatagtcacgtgaaaagcttgagtaaaatctctaagtgttcaagtgaatgtgttttacctcccttggtgttaataatacatgtatgacctcacatacaatgatgtaagcaaggtaggtaaaaacccttccacagaaagttaactgctgcactattcctgtatagtagcgtgtgcaggcatcaactttccaactggagagttgacttcgtacagtctccccgggaactggtagggacctgttccctcagctgttccttccactctgaggagttgaatcatataccaagctggatcccaacctggaaccttgtgatcttaaggtcttgtatatgtgtaacatgttccttatctggttttggatagtaagtttgttagatcattaaaatataaagtaaagtacttatgaccaaagtacttgtaacctatcaaaactaaaattaaataagaatctaagctattggctagtgacaaacaatgaaaatagtaagcaaagaaagatattaatgggagaagatagggttgataggataggtgcaagataaatgcttgggatataactctagataattcacttctagtgttcaaacgagtctctcgaattagcttggttattaattcaattatttagtagaatctcttctctcgattaagtctcaacctcacaagatgaaccaatttaagctcgtggagatatgcaagaattcgtagtgggctggtctttaggagaacctctctcgattatcctcctaactaagtataatcaacaattcaactagcctcttccgattactaagatgaattaatgacttcaaccggcaaaacataatgcaaagatatcacaagtcatgcctctctcgattacattaacaagtgaatgtagatgcaacgattaaaacatccaaaacgattcaatacataaaactagagttaattatccacaaacaagtatcaaaataccaaatccattaaacgctaaagagaacaactccataaatatggagtaattcataataacaatgtttaaatcaaaggaaaacataaaacgaaccaaactcttgtcttgaatgaggattgaatgatgaaatccttgcgtttttgcttctccacctcctcttagcttccttaggtgtaagatgtgtcaaaagtcctcaaaataatgttttacgtgtatttatactaagtagggtcgggaccagacgaaaacagcttttcctgcacgaaataggattccgactctataaaaattgcacaggcgcgctgcatgggacgacgcgccatacaaggaatttgtggggaagttcagagaattgattctgacaggatgcaggaaaattgaataggcgcagcaccccacctgccgcactagtgttattttctctgagtacatatttttcttgactttttgatattcggacgtggtttttgacccccgaacgcgatcctagattaatccattgggattttacctagacttcaaagctcgaaataactcgaattcattttgtaatatctacatagctcggaatcctcatacaaggcataaaacacacaattagtgcaaaacactagtgataaaagttcaaactcaattaaagtgtagtaaattagagtgcaataagcgactaaaatacgagattatagcctaccattagagagcaagtcaatgctatcacggaggcaaattatctgcaaaagctgacgattgacgaactcattggaaatctgaagacctatgaaataaaaaacaagaagaaggaccatgtaagaagagataccaaaaagaagaagaacccggttctcaaagcagacaacagtgactcaagtggtgttgatactgacatggcctatttgacacagaggtttcagaaaatggttcgcagaaatagaggtattccgaaaaagggcagctcaaatagttatgatttttatcacaaatgtgggaagctaggacattttatcaaagattgtcctctccacaactaggaccattacaagcacaaaacagacaagatggtcaagaggaacctggttcccgtcaagaaattcaagccgctgataatgttgtgaaacaagcttttactgcatggggagattcctcaagtgaatatgagggcgatgatgaataaggagacacctccatgatggccattgaaagagaagcagtaaatatgactctatttttgccttgatggcaaaatctgaagaggatgaagatgatgatggcgatgaggtaaaatttctagacgttcaaagaaatttgaagtcttactctcaaaagaagtttctatctttagctaatgtcatgattgatgctaatgtcatggttgaagtcttaccctcaaaagaccttgttcctcagaacctaggataaaacattgccagtttttgctgcctttgtgaagcagattcaagtgaagatgagccataatgttgtaagcacaagatttgatcatggtaccgagttcgacaatgcaaagtttaacgaatcccgtgctgaaaatggtataagtcataatttttcatctcacagaacaccccaataaaatggtgttgtggggaggaaaaataggactcttgaagacatgacaaggacgattctaattgatagtattgtaccaaagagcttttgggatgaggcaatgaacactgtctgctatctgataaataggtgcatgatcaggtccctcctaaacaagaccccgtatgaattgctaaacgggagaaaacccaagctgacttacctgagaacattttgttgcaaatgttttgttctcaatagtagtaaggaagcgctgagaaaatttgatgccaaaagcgatgaagggatttttcttgggtattcttcacaaagaaaaacatacaagggctaaaacaaaagaactcaatgtatagatctaaagtattgaagttttaatgattagcaaagttaaatattgaagttttaatgattaacaaagtatggctgagtgttcaaagaaccaggtcctcaatgtagttgcttaattattctaaagaaccagctcttcaagagaaaggatcagtttctcatgttgataattatacgtctatacaagataataactttatctcaaagttacccatgtccgagtttggtggaagaatgtttctataagtgataaaggtcattgctcaagaagatacagataattcaatcagagacaaaagtcccatagattgtggaatccttggaatagtaggagccctgtcaaagaggaagctgactatgaataggactcctagaagatctcaagttgaagcatttaatatgatcgactttggacttctgaatcatccttttacacataaatgaaaaagtcataagttgtttacttaagtcgggtacttgaattgttctctttctgagtcagtctagtgaatgtgttttaggaaattgagttgtaatcaagtgtcataaatagttggtgagttggagtgagtgttttgctttacaagttagagtaaatcaaataggagtagtaggagtattggacagtatataattgtagtcttgtaattgatacattttggctcattgttctagtagagttggagttgaaaatcctacatggtaggtcgtggtttttgcaccttttgagccgagtgattttccacgtaaaaaaatatgtatttattttattgcttatttagtttacgcttaaggaacatggtaaataaccaagttctttagtaattcgtacgggcactcaaactattagtagaagaaagtatacatgtaatctttgatgaatcacaccacttaagtggaaaagaatcacatgataagaatgatcaggatggagagcattcaaaggttcctgaagaagtcattgttatggcaaacgggaaggcagatctaatgagtcgggtcaaagagtctagtgtagaagatgcagcaaaacctccaactgattcagaggaacctggttcctccattacaacaactgaagcaaaaaatagagttgttgatccagtgcaagacactcatgataatgaatagagaagtggcacttactctttcatagatgcaaataatggatcccacacggtagaacctgggtcctctcaccatgagactcaggtgtctaactggaagcacaaaagcttacatcgtctccagaatgtaatcacccctctagattcaggaatttagactagatcaaagacaaaaagcatgtttgctttctcagctttcttatctcaaattgagcccaaaaatattaaggaagctttgaaaaatgctgactggattacttctatacaagaagaactccactaatttgagagaaatagtgtgtggcacctggttccccgaccttcagatataactgttattggaaccagatgggtgtttagagacaagcttgatgagtttgaaaatacaacaagaaacaaggccatgttggtggctcaaggctataatcaagaagaaataattgattataatgagactttcgctctagttgcaaggatggaagccattagaattctcattatttttgcatctcatatggaattcaaattgttccaaatggatgtcaagagtgcatttctaaattgatatttgaagaaagaagtctttgtaaaacaacatctgactttgaatgctatgagcatcctgaacatgtatttaagttcgacaaggcactatatggcttaaagcaagcccctcgtacatagtatgaaaggttgtccatgtttcttctggaaaatggtttactaaagaaaaaattaacaacactctattttctaaagaaaagagggaggaacctgcttattgtgtaggtctatgttgacgacatcatctttggtgcaataaatgattccttgtgtgaggagtttgcaaggcttatgggaagcgagtttgagatgagtatgatgggggaactgaacttcttcctaggtctgcaagttaagcaaaccactaagggaacaacgataagtcagtaaaaatacattaaagagcttccgaagaggtttgagatggaaatttcaaagaccattgatacttttattgccacagccacacgtctagacatcgacgaacctggttcccctatgaattaaaccatgtatcaaggcattattagttcactcttgtatcttacaactagcagaactaacattatgtttagtatgaggttgtgtgctagattccaatcaagttcaaaagtatctcatctaaaagttgttaagagaaatatgaggtatctcaaaggaacacaggacctgttcctctattatctctcaggagataattttgacttaattggatatgttgatgatgattatgttggttatttggtggatagaaagagtacatatgggatggcacattttctggggtcatgcttgatttcatggggtatagagaaacaaaactctgtagccctctctactgtagaagctaaatatgtgctagatgctttctgttgtgcccaattgttgtggatcaagaaacaactaaaagattatggtgtgttttctaactatgttccactactgtgtgacaacacaagtgctctcaacatgacaaagaactcgattcaacataagaggacaaagcacactgatgtgcgacatcatttccttagggacaatgttgaaaagggtcttatctacatgaagttttgcaaaatagaggactagatagttgatatcttcaccaaagcattgagcagagagcattttaaaaataatctactggagttgggactaattaaattgaattgggaacctggtccctcaatgactggatatgaaggaatggtaaggtgaactgtgaaaaagtattttctagcaacttttaactcaattctataccattacaggtaaacacgcatggcaattactggggaaataagcagctaatgacattgcattttggtaggaggatgaggctcatatttgcaaaattagtcagggtacctggttcccttaactcaggttagtagttcctcttacactcgcacgcatttcaaactgctaaaagtgccacgccattaaaatgtgttcgccctttccccacaccttttatgcccaaaaatcacatccattacagacctacccagctacctagtctgttgcatccaattgtaatcggtccatcatttcctctaaatcacaccaaaagacatgtctctctcataactgtctacatcaaatccatcaaaccttcctcttttctttgaaaccctctttatagtgtctttattctaaaaagctcaccatgtcttctcagaaatcaaagtctcctaaagacaccattgacattcttattgtgccttcatctcacaaagagcaacaagctaaatctgagcctcaaccttcacgagtgaaacccccatctccgacaaaccaccacccactgtcttttccccgactctatcaagttctggttcccagtgtagccaaaaaaatcaaacatcccagaagtttgttgagtcaacttctccctctgctatgccaaaaaatggtagaagacggactggtaaaaggataagagggaacataggtttcaagtcagttggttgaggaagtaattgtatcccaaaaggttgttgctagttttggtgaaacatctggtgtatctaccacccctctgctccaacttttgatctaaatagtgtatcactattaggtaacacctctctcgcttctaccgattctacattgttggatgtgagtgaaaaaagccatagaaaacatgatgcttattgctattgaagggtgtttagttggggagtatgtgtctggtgatgcgatgtcacgacccaaatcacacatgttgtgatgacgcctataacaatactaggtaatccgacattcacaataaaaccatgtgtctttaaatttggaaaacataataatataagttcaaggaagaaatctcataaatattgataagaaataccgtgattaaatacaaaagccctcaaaatctgagtgtcactgagtacatgagtatctatacgataacatggtctgaaacactatttaggagggtagaacaatataaataaaactaagagataaaggaggagagtcaaggtctgcgggtgccaaagcagctagctcgataatctccgtactggtaaaaactctaaattagcaaccatcgtgaccaaaaatacctggatctgcacacgaagtgcagagtgtagtgtgagtacaactaaataaacaattaataagactaacctttgggctgaaagcagtgatgagctcaaccaatacagtttgaatacatagtttaacagtacataaatgataggaaataggacaaacatctcaaagaaaactcataatttgttcgtacacggtacatgaaatatagacatgcttacagttttaaagttaagctcaatacagataaaatatgccacgtgtgactgatatgaggaatacgacatctctatatctatatgccaatatgcatatcgtatgtgatgcaatacaatgaaaacctcacgtactcacactcttagagtactcaatttgactgtctcaatttttaacatgaatcccttacgtgttatgtggttggtgttgaggtgacacacatgctaggtgaaaggcatgtgggcgtgcactgtagaaaatgagatcggttgattcggtggtattgtgtagtcatcaaaccttgtagccattcatgtgacctctatgtgttagagtaattgagttgcagattcatattagaaatcatgttaggctatatgctaatcctattaagacccaatggtcatttatgatggatgtgactaagtacaaaattgccatctaagcaaatagttcaacaacagaaatgatgatatgcatgtagcacagtttatcgccactagaagtggtagggcagtctccaaagagcccattcttaaaagacccactactagaaaacagaagaaataaaaccttgaaaatgtgttgaagaggaataaggagaaaaagattggtgaaatggggaaaattagtaaatgaggaggatttgcccccagccaatattgtggatattgaggacgaagaggtgaatgagaaacctgctccccttgttcgtaaatcctataagaagtctgtgattgagaagcccaagaaaggatcatctgtgaaaggagttgaaatggatgaagagaagagtgttgagaagaaggagtctggtgagaaagctaagtctggtaggaaggagaaagcttttgagaagaagaaatctcacaagataaaggcaagtgatagtgaggaacttggttcctccaagaaggctagaatggaagtgtctaaagttgtctgaagagaaaagatgaagcaacaaaaagtgttgtggggcagagtgtttgatattgacattcttgacatgtcaggcatgagacaactagttgaaatttgcgagtttcagaagtggagtaatctttttactatttagagtccaaaagtatatgaagaggaagtttccagcttctacgctgatttgttcactatgaaggatgacaatatctacctgaaggttaatggaatggatgttatgatggatgaagttgtactagagagtatcctggatgtgcctactgagggctctcgtctgttgaagggacctgttctgccgattttaggaaggttattctaaagcctcaagctatttagaaaggggaacgagtgcacaaaaaggccctacttccaaaataccagctcatgtttgagatagtgaacaaaatactgctccctcgagtgaaagaacgttccattgcatcaatagcgaacgtgttactcctggaggcattggatggatacattactatcaacctatctataatcatgattgaacatatgcaaaaggtggcagacttcaaggatgggaatcataatttgccttatgggttcctgatcaccagagtgtttgaatatttcaaagtccccttggggagagcagctgtgggaactcaaaagcaatcattctcaatgagtaccttggaggagtgtgatgtatcgacaagaaggggagttggcagcaattatacggttttcagcagattgatgcttagactgctgctaatgaggagatatggaggatgaaggctagacattccattcttgagaggcagctcagtcaagctaaagaggaaccttgttctagcagtgctcagggtgcagaggttgcccgcttggctgctgaaaatatagacctaaggaaacatgttgagaacctgaaagagtagctgatcaatgagcagcggtctacaaatgctctagtggatgtttttctcaaagcccttgacccttcatccttccctactttttcaagtgccccttaaacagtctccttgtcagtgtctagattatcaatgcatgtcttagtcctagtgtcctactttgaattttattcttatgactgtggtactttagtttgtttattttgtggatgttttttaacaatggtactactactgccaatgtttttcttctctcttcaattaatgagcagctcagtcttttgctatgcatgctttactcttgtgttatgtttttagatacgttgtgtgcacacaagtggcatgagttaactttgctggacttctttttgcgtttacttgaattaatcttttatgatgacaaaaggggggaaaaaaattgaaggggaggaacaagttctcagggggaatatcaccaaaaataggttctcagggggaatatgactaatctgcagggggatccaaatggagatctaattctcagagagaacctcaattctaagtttgtcatcatcaaaaaaggaaaaattgataagttatgtgcttttgtgttttgataatttaacaaacctcatatgagaactagatagggaacctgatacaaagcctcaaagtgctcggaacaacaagtcacatgtctggcacaagttccaatgatatcagtcaagggaacaacaaagggaatagatggatatcggttcctcctgtcacagtacaagtcaactctttatagttgttaaagctgctgcactataaacgcaatagtgcaacagtcactgttgaagcatgctgtgtaccggatacttgcttgcatcatcctagtcacttcacttatatattatcaacatgaggcaagggattacacacacttgcaaaccctaaaatattattttctctcaagtgtgcattcgccttcatttactcaaagacttgaagaacaaagaagcaacagaacaaatgaccagatcccatcattgagttcatcatatatccttaggattgttgtatctttattaatgttattcacttgtaattcctactcagcttagttagaaacatctcgtaggatatctttgtaaaccataaacgttatgtttgtgtttgactagagttagtcaaagtggtgagctttgtaatagagttattacaaagaggcttgcaatagagctattacaagcaggtaaaagattaagagtttaattactaggttacaatagtttgtgatctaaagttgctcagttagtgaagttgaaatcctacgagtgtaggtcgtagtttttaatcccgtgagctaggagttttccacgtaaaatactgcagtcttatttatttcctttgtgtgtgttctgtgggaacggatagagaatcaggttctctgtattgtttggtggactcttagtttacagcatatgggcatgaatattgtatatcaatgagtattgtaaccatagtatgtattaaaagctctcagggtatattagtgaagtaattgtcttttgctatgacccctagagcccaaactttgcttagattaactttgtcctctttttgtcaagacgattacgataaaaataggagccattgaacattatttgaatggaagaaatgatttcagcgctctgataaattacttttgatcattataagcattagagttgtgcaaccatatacgtcgcaagttgtgccttcttaacatgaaaatagagtaaatatctgaaatataaaatgtaagaacatagagtagtttacaaggaatattaatatagtagttttacgtattttattttttaaaataaatgaaaaatagctcaaggaggcctttctaacctcgatgtgttaaaagggttaaatactgaaataccaaattatcggatgatgtttcattttagtttgaattaaatgttatatttcataataaatgaggtcatttttgatatcttgaaacttctgctaatgactatatctcaatatgggtactaacttttgagggcaagattagttgttggttctattcaaaaaggtcaattttcggaatttaaaaatttaggggagttataggaaaatttcgcaattatattatttaaaatagagtgatcaagatatactcaatattttgaaaatctgaggagcaaaagatcataaagcataataaagctttgatattcaaaagaaagctaaacgaaaacaagagatgtatggaatatcaactttaacaaatattttaattgttgagaatgaaaaaacatgttgaagtccaatatgaaacttattcaacttagagacatgtaaatgcactcataagatagttacacattttttcacgagcaaacgaaagaatatatgtaatattcaattaagtaaaaaatatatatattcaactaagtcacacaatagaacatttaagaatattttgcttaaccatgacaataacacttaattatgataataattggcataagtacaagatatttgacttgatagcctaacgatttaatgaaagatttattttagaccgttctcatgacagttgcatacacgtccaaagtaaaattaaggagtgttcattttgaatcgtaaaactatctcaatcccaaaggagtaattaacctttttttcttgataaataaacattttttgtgggactaaatttgtcctgaaaataaaatatagttcgaggggcaccatatatttgttttgtttttaatttttaacccatatatttagtgtatattttgtaaacaacgcccccctttgggtttggcaccgtctcgagatggcggaagaagtcgtgggagaagtagaagcagtagaatcagtttacggcgatgattgtttactccttcaaacttatcctccttcttttcatctccatatcagacctcgtacggctgatgactcttctcaacaggttccctctcttccctaatttcttccccctacccaaattactctttgtgggtgtgtgttttattatttttaacaatgaattggcttcttgaacgatctttctgctgaaatccttatatttagtgcgtgtatgattttagtataattgtgtggtattgtaggatttaggctaattaattacctgaatgtgaaaactcagctttgtatgtctgttaaaagagaattatgagttggggggaagcggaaaagattctttttttggttaatgaatctgttttctaatttgttgattgggatacgaacattaggagaactgacaccctaaaagctagctattgagtggagagctcaatgtcgtataaacctccaattgaaatctggtagttttctgtttgtacgtgtcatccttgcatagtggcgttgttaatcttctctgtaccattccctccaattttattgccttgatactcgtgctgaagtgtcgaggggaagtgctcagcttgagcttcaagtaactccaggacttaagcacgctttaaataaagcctttgacaacactatgacaacaactacgcctctatcccaaaagagttggagtcaattatatgagttccatttaagctcgttacagacaagcctttgttgcctagatcgaaagcttaaagcattaccaaaattctgtccgtttagtcacaatttggcgggtgtaggaaagtgcagatccggaatctcatagagagattgatagaagaataatgttctatacagattatatacacattatgcatgcagtgactaagagggaattggttttggagtagttcgtgcttcctaaggctgtcaatatttgctgatattttcaaatgaatctgatgaagtgtcattatactttacagttctttttgttctttggttttctggttactttcctattgttttatgttgtatgttgctatagccttataaagaatagttacattttttcattctcctgtcttgcagtttgtggaagcaatcatcggaatccaggctggtccaaaggtactctgtcactgtgattaatattctttttggggttgttgattatcatttggttcttttgttgtctaattcattcgcgcttaccttagcgaatttcatgtccattttcatctgatagctttgtgcagtccacccacacttgcgtcccatttcatctcttatttaactagttcatgttactattacggttgctactggagctactaatgaattgtcttttcttgttttttatttccgtctttctgagccgagggtctatcggaaacaacttctctgccctatcgtggtaggggtaaggtctgcgtatacattaccctccccagaccccactttgtgggattttactgggtagttgttgtatttaactagttcatgtgatagccatacttgtatgattagacaggtttcacatttctttcctgcactgatataattattttggcagtatcccgacgagcctcctgctattagaattgttgattccaagggccttgatgaacaaaggcataaacaattgataagttgtctttcagcaagggcttgtgaactctcctcgtgtctaatgcttgtagcactttgcgaggtaaccattgcaatgtccagatccagttctgtgattgatgataatcctaattagaatactctcttttattaaaacctagctacataatctcaagacttgcattatgatgagtaactattactttggatctttttgtcctgaaattaagtcaaaaggaacaggttttgtaatttatctaaaagaagagaaactcctagggttttggttcagccataagaaagtacaaccatggtgtgtgggttggactcacaccacgagttcgaattcttccactgacaggtgtctggtagttaagtggtaattcaaagaattgtttgtgtcatttatatataatatagatttatgttagaaactcgagctttactggtattttaactttgtttagcggcagggtgctctgtttctttctgaaagcaagtctgatagttaagtggtggaattaattatgactttttatgggctgggattggattatctacttgtcgaactattgagtaaaactcttatatattgattgtgtcagggactcacatttatgagctaaacaactaagacaatgtgttgctaaataggccaaattactattagaatctgggttatttatagccggccatattttgttgtttactttttctggccatatgcattgattatatacaactgtacacatataatatatatattatacctccaccggctatttttagtttaagggattgggagagcggctatttcagttaattcttcttagaatttcagaagggggcttaatttccagaaagctgatgctctgaatgtattactaggaagcagtggagcagctttccagcatgaatcaccctgatggggagtgtccattgtgcttgtacccattagttgatgaagatgcaggaagctctgcgccatttatgaaactgatgtcttgttttcattgctttcattggtaaattctgtcagtagtacccctttattttgattaatttgctactggctgaaagatgcatggttgtaacttcgtactcatttatttttcttattgctgcagtgagtgcatcatcagatggtggaattggcttcaactattaaaagaatctgatgcccctacggactctggttctgcttcgtcttctaggaacagggatcaggatggtccgtcgcaatgaaactgatgcgttaagatttaaatgtttcatagcatactccacttccattttcttctcttggtctgactagattcagaaaaggttaccttaattttattgggaattaagataggtctttaggatgatttctcagatattgccttttcttagataattattgatatgaagattgttgagcatataaaaaaagttgtgtttggacatgttggaattagaagaaatctctttaaagttagacccctttactccttcaccttgccctccaccccccacccccaccccccaaaaaaaaatgaaggcaaaagaaagacaataggattgacggaatgcataagatattctgtggggtaaaccagttacttgagctcaaccatgtgtcgtgtcaacttttgccaagggatttgatttttctttgctcaactcacctgactaatgagattccgttgaaataatgcgtgcattcacatactctgtcagcatacctggtctagttgcaagatgttatagtactttcacttatttcctatgttgctcggactctctgaaaatatcgatgggtgcatgtcagatccgacacgggtgcggcaactgttttggagagtccgcgcaacatagcttatttcattagaatagctacttgcatcatttggtccaagaggctctgcatccactaacctaggggctagggcatcccctgtcttgtctcttctttctgcagagaggatgaggtttttatttgattctgccttccttctttcctgtccgtttctccatcttatagattaccaatgagtcaacttatttcgatccatttcttttccatcttttgctcctataccactcgcagtggttataccaaaaggtttctttttgcttgcaacctcagtttgtcgagtactaatttgatatcttaatgcttcaccgtaaaagccctcatgctttgaggacggggtaaagagatttttgaatttgttttattatttttaggtttctactttttaaatattttccagatggatggtgtttacagctgggggttttgggggacaaccgagggagaattttatttttatccatctgtgctcttttttttgcagacatagtttcccaacatttctagttccctagctcactaattatcttgcttggtgatgtgtgattcaacagaagaagatgtggggaagtgcccggtttgtcgcaagtcttttctagcgaaggacattgagcacgtgctagacttcgtgaagactcagcatgctgtggtatgttatgaaagtatcttcttttttttttttaggccaactcatatcttttccctaatttctaggtagagaaaatactttgatttgctgaaatgttataaaagctgcttttatgagaattcctgatttcaaaaagaaaaatttcctctcttacttggggcaaggaaactcctcatgagccaaaagaatggggaagtgtcattttttgctccttgttgtgaatgtatttgagcatccaaacatagaactccgttggatgtccttatgcatccgatgtgatgtattatgtatttgtaacaacctgtcacacatgtaacctaattctggggttcatacctggatttgaacgtagacttgagatcgtcaggaagggtttgtcaaaagagtctcaaaaaagagtttgtaaaaggtattgcctactaaaagtgaacaaataaactaggagactcgatatgctaaatctgaaacaaattacagttggttagtgcccttggttagtactaaatggaatgaagtgtttgtttttggtatagttacaacattttgttatttatattggaggtagtctggtagagcgagtgatatttgttcatcttttgaatccagacttccagtggatctgaagtcaacaatgaagacaagattctttcctcggactcggaaaaactaagaagaaagaaatttgatgctattctgaaactccagcaagagaagggtggcttaattgaaataaaaaagcatgaagtgttgcggccaggtatttatcttccacaacctgctgcattaccctcaactgcacccaccgaagaggcaaatgagcaaaaagacagagatctggcagccaaccccagaccaaattctagtgcttcctcaaacaaacctagtaccagtagagcgagaaactccggcacaaagaaaagcaggggacacagttcaagaaaacaagcgactcagtgggttaagaaagaaaatagtaatacagcatgatatgaaatctgtattattttataagaacagctgaaaggaaagaaaagtatcattttttgtgattgtttaacgatttgtttacatggtcaattaacatatcaatatcaagaagggttaagttgtggtataatttgggaaatcaaggaagttggcagataggttggtgccatctactctttattgtgctgacagtgtcgcgatttgtctcactaggtattttcttcgatatctttctccgagacaatatttgttaagagttttcgagaacaattgcttctgtcttgttccagctctaaactgaatttggggcaatgctgtgctttcactataaattttattgtgtcagatgtgactggagagataaatctgacttgcagctctaaggtacgttttgctgccaaatcatttggaggatggtctggtaagtaatcagtgtcaatggttttaagagatcagacttcaaaacggagaaaaagcaattttatttgtaacatgattgtggcaagaagtaacggttttattttttcaatcaccataattgtagtactttatagtttatagctatcatttcatgcaaaaaaaaaaataaaaaattattcccctttggtggagctagctattgctcctctagtgactcaaacacatgaccctggaattgtaggtggtggccggagggtgttgaccatttgcacaatcccctcttgttgattcatgtttaaaataggtagttaaatgaccgctttaaataggtctatttcatatatctaaaccattgcaaaaattgatggtatatattgatacataataaacatgccaagtcacaacagcataaaatataatttcataaaaaacacttgtcgcatgtgcaagagttcaagattcatttgctgtaatcaatcacttattcgtattaattccatgcataaaattatgtgagaaacatgctatttcagcataaaacaagctgtgaaaggggttatcactcatggtatttgtgttgtaaaaaagtccaaaccatcaaattgaaaacatgttagaaggtcagagtattacaaacaacgtcactgagatcatatatttcaacgatcctcaatctcaactctaatcatgcgtattacgacatataaatatgcaacttaataaaagcgagtcatgtggtttagtgatcactcatattacgacggcccttaatctctcttacgcttgtctctaatgaccaatctcaaacaaattctcctacaatgtaggggaagagacatcaaatagggaactccaagccccttaggttcataacttaagtatgcagtgtttataagttggttgtataagaaaaaataaatcctaatcatattatgctacgattttttttttttttttttttgggtgcctcacgtatcttggtccttttaggaactgaacaagtataagaaccaatattttaaaaggcgaggcattttacctctgacgaggcgaggcgtaagccctgagacatggggctaagtcccacggatctttaaattttactaatttcatgaattttaagatagtataaataaaaaatagttataaagactacattgaaatcacaaaattataacaactaatctatttaaaatacttataaattataatttgactatgaataatacgaaaagtatgacatatatcataatatgcaaattagctacaacgtcgttacaactcaaatatcaaaagtaatgtattcgatacaaaatcttatatgtatcttttaatgagtaatgaatcttgaaagaatttcgatattataatttgatatgtttttcaaaacactcatttcatttaatatgctttctatttgaaagagaatttatataaaaacataattcacaatttaaatatgattctctaacatcatttatttttaagtttcaacaagttaataaagtgacacataatttaccgtacaataccgtgataactaattatttgtaaatagttacgctagctaataatgagttattaaattaataagtattgtattttgtaaacgtgaaaaaaatactatttagaaaaataattataaaaaaatttatggactattatataataaagacataacaaaagttaataaataaatactttgaaagatttaattaaaatttactatcatagcagtcttagtagataacgtgcaataatttttattttaattatgacataaaatactctcaatttaataatttatgattaaaaaaaattaattttgagactaacacaattgtataaagttctattaagcgagcccagtacgctaggcgttgggtgtgtccggggcgtaagccccaatagccgaggcgtaagtctcacggaactaagccccacacataagttcaggggcgttttacgagtgttccgtcccggggcgagtctcaattctgccttttaaaacagagatacgaactatcgtaaatagtttagccaaggattattcatcatataactccatatcaaaataatagagcagaagtagaaagattaatcagaaaggaagttagaatattccaaattagtttggcataattagacacaaagaatgaagaataattatgacatacttggcatctttactttcggttagaaggaataacacgtagcctcatacgaattccgaagtagcatttcgacttttatccctgactaatgactaaattaagtactagtgtactaatttttatatgacgatagccacctcaaatattttaacttatccagtttatcaaaacttgcgttctaaaatagctgaggtttttcacttttataacttgttaaatgaggattagcatcttttcgtctgcttgaatattgacagtacgttgtgattatattatgagccaacattccatgcatgagacccaataacggataggatttaggatccaaaaataatactgatgattttcagtagtgatccttttatgtgaagttcatggaaccttaccaactttatggggatcactttgtaagttaacccaaaaatagagcctaaaattggagcataccttttattatggatattcttacacgatctaaactacatactcagattctcggtcatagtttcgatgtgaattctttctttagttaaaggaccttatgcctatctctctttcgataaaatatttacgtactcctcttttcacaagaatgatggctttcaatgtatgagctaatctcaaaatattggttgtctttgtgaatttagatatcttacctttatatttttttttaaaaggaaaacgtccaaatattagttggctttcgatgtacgagctatgtctgcgatttgtattacatttatagttatctattatattggtccataaaagccgtcatcattatcttttgtttcaaatatgcctctcccactaacggtttcctcctgtgaaaaaataggtctgatttggttgataaggcgaattgttcaggcatcttttaaattattatagaaagtatatataaaccaatttgatagtttaaaatcgagctaacgaaagagataactgttgcaaatgcatttctgaaagagccctgcatatcaatccacaaaggataatgttagatcttgcattagaaaatatgttattagaagcaaaagtagaagcacacaaaaatttcaggacataaatacaatttaatcgactattggattattaaattagttgtcatttttgtgttaaaaaatccaacttttaaagagtgttacccataaaaaattaactttttaaataattttgatagtgtaaacgagtttacactgtacataagtaattataaaactttattgttgtttaaccaaaaatgtgattctttggtcaaaactaaagacaaatagaaattcgggctactgataatcaggagacgaaaaagaaataatagacttattgagaatgacaaataagcagtaaataggtttgtattccaatgtaatgtttttgatctcctccccccttacaaatgacgagacctcctccttttatagttgattctaagtaaaggagtaatacattagtcttaatgagataattatgagcaataaatgatattaaataagacgttacacaatcattcctatttaataccaattctctaacgtattgagtatttaatattgaatttggactccttttcgtcatcatatccacgtcttcaatgtcttctgatctcttggctttaaatgacctaaataggtacgtaacttgtattattcgaattgcctcttgtgcctatttagctttcctttccccgtatctgttgtcactcgtgcctcttaactgatcatcatgttttgaccatttgaccagtcctcgtgtcatgccacgtcaccttcaatgtaaattcaattttttcccaatacagatagtccccctacttccatttatttatcaattaaatatctgggaagtagatcttcataaaaagggaatttttgccgtaattaatactatgacagtactaatgcttcaattaccccttataattaatgctttgcatacgtgtcaccttttatttaatgctctacacacgtgtcactttctgattggttctgcaattctgcacccttttttcaaggcttcttcattctcactattcacgaagtgatagttgcctttattataggttttccatcattacacttctaagttggacggttgtcattataaacatatttaaccctctttcttttgtcttcttcttcatagatcttcaacaagcaatttattattcacttttgctttttctcccctttagttcatccttcttcaacaatgtcatctccaaaccctaaccctagaaaagttccaattctagatcacttccccaatgcccccgtaagacataggagaggcagaggaggtaggcttcggagcttgagcctaggatccactcgtggtggttcatctagttctgcttcttcttcttctggtattaggagttctatcccaaagaccccctcttctaaaggtaaagaactttctaaacctactgaggaacctttagttgaagaaatcgtacccaatgatttatcttttgggaatgatagaagatctctccaagaacaagttaaaaatttagaaaaagctgacacctatccttctttaataactgaacttgtgattcccactgttaggaaagattgtaattggagagataatcttcgtatgatgattcctgccccaaaccagagaatttcttctttcagaattggattctctttcgtttatacttatccctttactttgggatttaatcctgccattgacccagttatacttgaattttgccgctttttcaaaatttgcttagcacaagtaggtcctcttgtttggagagttgtggcttgcttaaggtatttgtctaccaaagccaatgttaattttaccttttcccatcttgttcacctataccaccccaaattattctgccatggagtttttaccttgactgcaagaagcaagaaggttttggtaaaccccgaagatgacaaggatcgagggtggtattgtcgttacgttgctgtacgtacggtggatttgttgggtgaaacaaacattcccttccctgagaagtggaattttgcacgtaagtttttctttttcttaccgtatctattttttaagaattttgattttttttctaatctcgtctctttttggctttttgtagcaaccatgggagatgtggaacacgttcctaactttcgtggttgggtagattcaattttgaagattgcgcctatggaggcgagaacttggaaatcaatttatcttttgaatggttggaaagtgaagacccatggtatgtatttccttatgctttgccgtatattgaattctttattattttaattctttatccctctttttatcaggatttggtatcaggggtatgacagctgaggtaaccgttgccattcgagtgtcttcaaccgcttcacttgatttggaaaagactcgggccacgctaccaaaaagaaaagttgtagaagaaagttctgagaatgaggaagaagagaatacctctttgatagctaggccaagagccaggagacgcatcattgatggggatgaagttgaagatactcctgctcgagcctttatctccgagcctgttcaaatcctttctgatgaggataccactctaagaggctctaatgaatcaattcgacgtctctttgttagtggttttgagagtggagagtttggaccagttcttgatgaaactcccctctcttcttctattcccatttcttctattccttctattcctttgacaaccacgagtatttctttgcctattttattgactcatgtttccttacctgttttggttcccatatctgctcctactgtccctgctttgactcccacaactcccattgtttttacctcttctactactcctccttccattgttccccctccctttgtttagtatgcagaggcgggttctagcagcagaggcatggctatgagaagtgttactcttgaagttcttaccaatcatagccttttgagaaagactggtggagctgatatttggctcgagcctctaatcggagatattgagaagaagaagatggagagccacagttgcttgactttgatgaatgacatagttcattctaccttgaaggtacttctctttttaacttacaagttttttttatctctttatattctcacatttgatgtctttcccttgtaggctaatcttattggtactgagttaatgggaagaatctccactctagagaagaaggatcgagagtctgcgaaggctatctctgaggctaggagaatagccaaggaaacccagcttgaggcagcaaactggaaggagcagtttgagaatgctcaggggaccatagaggagttgcaagaaagtagaaatcacctggagcagcaaaagcgtggtttgacttctgagctagcaattgccaaggcttcttcaagccaatttgaaaaagataagcagcttttggagtgctcattttcagaacaattatcaaaggtcagtggagaaatcagagagcttaaggcacttgtggagaagaaagaagaatatgcaggggagttagtgcaaagcttgactcaagctcaggctgacttaaggatctcctctgacgagatacgtgctttgaagagttctcatgcctcccttgaagcttcccttaactcccacttagctgaataccagatattgaagaacgatcttgctatgtgggaaagggagtatggacttcttgaggagaacttcaacatagaggtaagttgggcttttctaaaatctcgtcgtgatgctttgatggaagctactcaagaaaactttgaattgcaatctgaattagccaaagtcttagacactattaaaaaaagccaacaaccagttgatactccttctcctgcacttggaactcctggggcagaagagcttttaaatgaagaagtggctactacggcaattgaagttgcaattccggctcccgggggtgaaacttttatgacacagtccaaggaagctgaagctcccgtgactcttgcttccctcggtgattttaacactccaggcccagttgaaaccgctcctattgttgctccctcagaagttgttaccgtgcctgtgactgcccctgaaaatgagattgcaacttctgatgttccaaccccttcagtgactagttgaatgtatttcaaactttactgttttttttattaattagtggtgttatcccttggcaactttaagggatcttttgatgaagtccccagttatcataatggggcatttgtaaaaaataaatattttgctgactaagtttgtacttagtcttttatattatgaagttttattggtacttctgtatattctattcttgcctatttatctaggacttatagaatagcttagcatttttatcctttgaaaatgctttatgatacttgtaagcacgtgatttttgccctatatgagaaatactcccaaaaaatgcaaaataaaatgattttccttggtgtgcaattttgagtatttttgtgacatttttggattattatttgtatttgtctgtgtttgtttatttgctaaattaataaaaaatacaaaaatatgtcgcatttgcatgtaggatttaattctataatttttagtaattaaattagttttacaaaaattaaaaaattacaaaacaatatgcatcttttgcatttttagcatttaatgtccaaatgaacaattttatgcttaattattacttaattgtgcgttaattgttagtggtagtaaattttcgcttttataacttaatttagttcttaataataatttaagtatttttataatttagttttagaaaataaaagaagaaaagataacaaaaatacaaataaaaatcggattgggccacttcttcaattttcaaccccaggcccaaacaatcttctccatgacccagtccacttcagaccgggtcgacccagtccgccccatgacccaaatacccaacacccctttttcattttgtcaaaacacaaaacaaaacaaaaaataaaaaaacccaaaaaccctaaaaacctaaactaacccatccgccccttcgctatcttcttcttccccaaactcaaaaaaaactcctccaaagctccaaccaagcatccatggctgcccagcttcccgtcccaaacaccaccaaacgacacaacctccttcgcattcaaacgaccccagccctatccgccattgatgaagctcgtcgagctcaagcttgagctcgacgtccatgtcgctgctgcttctgtttcaaaccaaacaacctgctactcctgccttctacttcatcgtccaaacaaccaaacgaccacagcctcgacgagtcagctgttgttcgaagctcccatcgccgctgctcgtcacggccaagctcgcacgctgccatcgggtccaataccgtttcgccatggacgtcgtcagttgcttctgcttgctgcgtcgaccagctttacggcttcatcttcaccatggccaaacgacctccgttactgcttcgcttctccgagcttgggcatcaccatggccaggttgtcgccggactgctgctgctcaataatattcaagttctgctgctgcttcgcttctccgagctgcttctattcatcacttctccttcgcccagctgctgtatcttcagacgagctgctcgtttgagttttagtcgagatcgtcgagcgtcgttttgagttcgtcaagtttacaagggaggtgagttcgtcgttgagtccggacagatttattcccatttgagttttgtcaaaacagttcatacatatgtcgtgttgatccggttagtagtttttgaattttatgtttgtccgtattttgttttgatattttcgaatctaaaatcggcaaatgtttgttttgtttatcgtttgaattaatgttttgttcatgttcatgtgttgtttgttaaattaatttttcagatttcaaatgaaggattaattagttatttttcatgtttatttcatgtttgtattgttgtttaagtgaatatttgttagttttatgtttgttagattcaaattgaaatttaattaattatttcttcaatttgtttcatgttgttatggattttccagaaaatattaatgttgtttgaatcgttagaatccgtcatgtgtgttgcttaaaaacagatttaattcatgttcatctttgtttgaagttcatgtttaaatccagcgatttaatgtgagtttatgtttgttttgatttgttagtttaatttgaatcatgcatattgttgtttgtattattgtctctttgttcatccattaatgatctaaattaaccaggattggttcccgatatggttgatttatttccattaatttggaattttgtgttgttcatcatgttcatgtaaattgttgttgaagattgttgagaaattggtcatcttgactatattttggtcaagttatgattaattgattgtttagagaagaggggtaatttggtaaattgcattgcattcgggggtagatttgtaattgcaataaggtcggaggggtatttggtaattgaacattattttgattctttatgttaagcatgggggacaaatataatggggtgggatttttgaggtatttgtttaatataattgggtggggtttttgaggtatttgtttaatataatgggggacaagacaaaacataatgaggaggaatcttgtactttttttaatataggcatgggggacaaattataatggggaggaatcttgtacttttttaatatagacatgagggacaaattgtaatgggttgggaatgtgttagttatttaatgtaggcatgggggacaaaatttaaaataaagaagacatttaatagtgggccaaagcatgccattgggggaataattttggggttgggaatggaagacttgtcttgctatatatagaggactattcttgacattaaaagggaggagaacttgaaccttgagaggatttttttggagagaaaaaagaagagagtttttagaacttgaatattaagagatacctgagagagtttgtgagagtaaaagagaaatccaatttgaactttcactcgaataatttctgtttgcttttcttcgagtgttattcaaaaatccgaagctactgcatctcgtgtcttttctctcttctgctttgactgtgattgtacttttttcactgctgagttttcaatctgtcactgggttattctactggttgttactggttttgcggtgttgcggaacctgctgttgctgcgttattactgttgctgactcctacttctttgttcttgtactgctgtttccaggtacacatttgtacactcttagcttgaagcgaaaaatgaaatattaatcaggctcctgttcctgttgaattcttttgtttggatctgtgtttgaatattaattttcctctcttcgtataaaaatgtagtcgattaattaatgagtaatgaggttgcatatgtatgatttcttcatctaataatgctagtttaaattatttgaagaatagttaatcggctttgatattattgtgtatttatctcatgttctagcaaataataaaatgtggaatgaaagcagtttttccttgtacaaacgcgatcgcaattttccgttcacataagccgtaacttaataactaataagttgcgtttttcagcatgtaaataattaggagatttttcttttattttagagacgaacttaatagaaaatgtagtcgctataggtttatccttttaaaataaaaatgagacgagcctcgccaaataaatcacaaaccgccggggccctcaataaaatacataaccattgactagactttggatttggccgtttaatgaaccttcacggcctcttcctaaaataacaatacgttagactctttaggatgcgccttaataaattttaccttcttaaactcgggtgcacatttatgtgacccaaatccaattctcaacggagtcgaaatgtgtttctaatcacgggtacattgattgtgacgtggttcgagatgcgtgtccatgacgttgcaatttcattttaaaaaaaataagaatgagatgagcctcgccaaataaaatacaaattgcggggccctcagtaaatatttgctttaaaaattgtttagacttcgggatggaccgtttagtaaaattccacggtcctacccaaaataaatacgctagtcgctttaggcgcgcctttaataatttaatttccttaaacttgggtgcacattgatgtgacccaaatccaaatctcaacggattcaaagtgtgtcgacgaccacgagtacattgattgtaacgcggttcgagatacattttcacaacgttgcaattcttgataaaaacagtaaaatgataaaagcggttaaaaattaaattttgcacataagttcacacttgtataaaatcagataatcaagccgaatataacagttgagcgaccgtgctagaaccacggaactcgggaatgcctaacaccttctcccgggttaacagaattccttatccggatttctggtacgcagactgtaatatggagtcattcttttcctcgattcgggattaaaattggtgacttgggacaccctaaatctcccaagtggcgactctgaaataattaaaccaatcccgtttcgattgtcctttaattggaaaaaactcccttgcgcccacgcgggtgcgtaaaaaggaggtgtgacagctctggcgactctgctggggactagacccagaaccactggttcagggttaagaattcgagcttagaataattgttattatctggctttatttattatctgattttattacatgttttgagcctaatgtgctaaatgctgcttttaccgctttgatattatttgaactgtacatataaactgtgccgaaaccattcactccttacctccggggagaagctcgctggtcgagactccctattctgttagtgtcaatacctgaaaataagaaagaggccggacaagttacaaagccggacgatcccgcgggtccccggtacgtagccccctcctcgactcgagttgtccgctcgggtacacagtctagaacaaatacccaggttatgaacctagaataactcaacttcatgcctgatccctagtaggaacgtttgtttgcatcacgtgcatttgactttggaggctcaacacaggggttgggtctgtctaggacaagtgtaccacaaatggaaatgaccatcctgatgcatcttacttgctactacttgcgcatttatttgatttagacttgtgtgttgactgtcttgtgaatatcaggaataatattttgaaatgcgaaaaaaaaggaaatagcggttagagaattgattgcttatttttgaataaaaccaaatgcccaaatactgtcaaaactctgccggaattttaagaaaatgagaaaaaaatgtttagtttgttttattaaaaggaaaaatatatataaaaaaatatcacaattgttctgttttgtttttcaaaaaaaatagaaaagaaattgtttttttatttgtttatgaaaatgcaaaaataaaaaataataaaagagtctttctttatttgtcacaaatatatatgtatatatataaatccaaaagttttttttaatttccaaaatatatatatatatatgtctttatttgttgcaaaaatatttgtcttgccaaaaagtctagaaaagtttttagacccccaattttcaaaacaaaaaaaaaatccaaaaatattttcccattatggacttctttagaaagtctttctaatttttttttatttttttttaaaaataataataataaaaatatccgaaaatattttgattcttctttcaaaattgaaaagaaaattcaaaattcaaaaaaaaaacatttttagaagcatttcttttactaaaaagtaaaattccaaaaatattttctttttctttagaataagaaaaaaaaaacgaaaattcagaaaaatatatcttcctttcacttttgaaattttcaaagtttaaatcaaaagaaaaggaatttttacaagtctttctttcaataagaaatcaatcaaaaaaaatacttcttttcttcttttaaagtagttctttcgcaaattaaaaaaaaaagaaggttagttcatctacttattcttgactgaccgaactacgcgggtttgattctcaccggatgtgagatacgtaggcaacccttatccggtccaaccccaccttttgctaaaaaagcgaaaaacaaataaataataataaaaaaaacaaaaaacaaataatatgtcaaattttaattttgtcataaagaagtcgggtgatgctgttttgtcataaatagccgaatgttcccgaaagggacgccggaaggctgactttgcataaacagccacctttgggtcattttgagatatggacccacacagcctaaaaatcttcgtccccgagacgttgaaaggccgtgtttgtaatattgagttttctaatttgaaaaacaataaaaagagtcataaagaagtcgggtgatgttgttttgtcataaatagccgaatgttcccaaaagggacgccggaaggctgactttgcataaatagccaccatcgggtcattttttaagatttggtccagttgaccctcacagccttaaaaagcttcgtccccgagacgtcgaaaggccgtgtttgcaacacaaggtttttattgtaatttgaaaaaaaaaagagtcaacggtcaggtgaatgccgtttggatgtttagtaaaaaaaaatgaaaaataaaataagccgagccagattcggccgcgtcttaaaccgttcttgccgaaatagccttagagtatctttcagttgtcgaaaaactattttcgtaaaagaacggacaagtttgtaaagtgtcataaataatcctccccggcctcaaaattcacgtgaaatttggaaagggccacatttgcaaaaataaccgtttggttgcatttgtcgaacagagaaagggagctagccttttgtttttgagtttgtaaagcttttgattagaatatgtgggttgtttgattttcgagtttgtaggtcatattcaaacctttgaaacccagtttgttctaatatgaaaaatgtttattattgtttatcttttattgtccgaactacgcaaggtctgattcatgcggggacatgatacgtaggcaatctccataagattcgaccaccactaaaaaaaaataataataaaaagaataaataaataaaggaaagtgtgggaaattttcggaggggcacaattgtatctctgatatatgattgtctgtcaaatgccctaacactaacattgatggcttccctttgctgtgttcatatatagaaaaatggttggttgtggtagctcttccctgcaaagcaaaatcaaaggacaatggctcagaactgcagaaccgagtgggtcggtatcgatgaccgacaacaattggtcgaacggaataacgggttggtagaggaaatgaaaatgctgagacaacatgtggcagatatgtatcaggcatggataactggaaaagcaccaccccctccaccgccaagtctcttgaactcggtcatttcccaagcacccaacaccataatggaagatcccccatactctccatcccaacccacttatggcagccttcccagctacccgagtagctccatcactcctcaatgcttctccactccccaacaccacttctttccccgccatacttcactttccacgcacccggatccacaaaatgcctacccacctacacaagcctaccaaaagccgcctggatcaggtttccggccctgtcaacatgcaagaatgaaaaggttgctgaaacgaggaaaggctctcacccccatcggggtatcttatgccggtctgtttgaaaggctaaggcatgctggttcgattgagccactccccgcatgtactataaatccgcttgcaaggagctttgatccggcatcacgatgcgcctaccactccaatgtcatagggcacaacattgagagctgtcatagctggagaagggaagtagagaaaatgatccgagaagggcgggttgcgattaataacagtgacagggggcactcgaacctcctcgagaatttgccgacggaggttgatgaggttgaagctggtaatggtctcggcagtattgatgcaaacctcagtggctaaaatgccaattttgataaagtgggaggacgttttgttcctgggtcagcaagagagaagcttgtggtggctcattttgttgtcatttctgttgttcggattattagggttatgagtcggatgttgtcttgtccagtttgtttttaggattttgttctggattgttttgtttgttttgttatttaaaccatttcaccggtagtctaatacaaagtccgatcttttattatttccagtcatctttttgtttagtccttttatcatttttgattccatgccgattctagggacatgacatgcgcacacagtttgggcctagtctttaaagttaatcataaaaccacagaaaggcgatcaaaccatttaaagaaaataaggacggtttgagattattcagagctcgagtcatgtggaactggggcaagttaaacaaaaagaaaaccgtttaaaagcaagattcgccaaattggcatgaggttctttcataataatgagaaagagagtgtcacccaacggtttagaagtgacaaatgaacaaacagacgtttaacataattgtcaagtccagcaccatcagaagggactacaagtttaaattgtgttgtttgcgcttggcatgttttgaagactggaatgacgaaggcattttgttctgctacccaaacactttatccttcgttaccccttttgagccttatttattttctttcatacccctcgttcggaattagtagcaacgattggaatacgcaagcatggcagttaagagaaaagaaggaaaagaaaacaacaaaacgggaaaagaagaataaaagaaaaaagagagaaagaaaaaatgaacgacaaaaagaaaggagaaatgagaaaagaaaaaggcaaaagaaaaagaaaacaaagataagaatgagtgaaaagaaagtcacaagaaaaaagaggaattgggaactacgtttgacctgattcctcaaagaggatacgtaggcgcttcacggctcggtcatagttttgaaaaatgaaaaaaatcagttaggatatccccaagcaagaaactggggcaaaagttgcgtttgttgtaaataaatctaattccgaaggttgtaactaataacaccaaaaattaatgtatttttgagccttttataccctttgtttctagcctatccaaaacccacattacggtccaaagaaagaccttccgatcagtcttcaaaagatgccaagacagacaaatgaagagtcttaccggcgaacataacattctgttccacagcagaaaggactctaatctccagcagaaagagtcataccggcgacactccaaatccccagctggaaagtgatacaaatgagagagtcttatcggtaaaaaccttcacaggcaccataaggcgatgaaagctgagaaaaaagccaaaaatgagagagacttgatagtgaaaacccttcgggcactgcaagtcgaataagatcaagaatcagatggggaatcaccaattgaagatcttgaaagatgattgacggtaaaggataggccacatatacatgtcatggccattagagtcggtatctgcatttgatatatttttatttatagtttcttttgtaaaagagtcatcgtttcctttgtcttttattttgtttctgttatctttctcctttcataaaaaatttccccaatagagtctgtccggtcagaacaagtatgaaatgacttcaaaatatgccatcagctttccaagatgagatctgactagtatatccaaatggtatagtcagcgaggaacaagcgcgaggctagtgtcaaaaaagatatccccagcaaagggaattgacaaaaggattgacgagcgtcaagagagatatccttgccaaaaccaaggttataaacctcaaaggccaaggcccatgaacagagcaaggagagcagtgagcatgatttggcgaaatccatactagactaaaaggtcggggaaatgccagtttccaagctatgccacaaaagaagagggatatccccagcaggaagggattatccccggcacataatatcatccctaacaagtcgtggaacatagcgcaatgaaggagaaagggaaagtcatcccaataggagtatcacagccaaccaccatgttttaaactaacaaattttgtttgatttgaaacaggtaaatgaaatggcattgatgcagaaacgcatgccacaagggatattatcaaactggggcagaaaatttcccttccatttagaaaattttctggaagtcaggtaccctcagctgataacattttacccccaataggtaagtaaataattcctcaacagtattatccctagcagttgcgaggagtccaacacaaggttggaaagtcggtatcctcagcggttcctttcagggaaaggcaaaacgactctcaagggaggtagtcttcgaaggaagaagctatgaatataaaaataaaaaaaaaataaaaaaaataaaaaaataaaaaaaaataagaataaaaagataataatgaaaaaaagagggaaaattcatcccaatccccagcaagtattcgaggtaagacattttcaagtcttaaggatattttgggtccatccgccttcgaataggatatgtcgggttcatccgccctcaaataggatatgtcgggttcatccgccctcaaataggatatgtcgggttcatccgccctccaataggatatgttgggttcatccgccctcgaataggatatgttgggttcatccgccctcgaataggatatgttgggttcatccgcccgcgaataggattttattttctaaattgttgttgaagacaggcgtccacctgaataacgagaggaatacatttctgtcttttcatttctgttctaggtcacccaccagtataatgcgggcatatcatttttcatatctttaccaccaggcgcccacctgaataacgagaggaatacttttgtctgtgtatttcatattttaggcgcccaactgtataacaagggaatacattccacgtctttacccataggagatgcatttcctcctaagtttgttttagtttcattcataggagatgcatttcatcctaagtttattttagtttcatccataggagatgcatttcctcctaagtttgttttatttgcacgcataggagatgcatttcctcctaagtttagttttacccataggagatgcatttcctcctaagtttagttttacccataggagacgcatttcctcctaagtttacttttacccataggagaggcatttcctcctaagttgttgttgaaaccaggcgcccacctgtataacgagaggaatacatttcagtctttacttttcaagtgttgaagttgggagcccgcccagataacagaggcatacattcagtctttacttttcaagtgttgaagttgggagcccgcccagataacagaggcatacattcagtcttttactttcaagtgttgaagttgggagcccgcccataataacagaggaatacattcagtctttactttcaagtgttgaaattgggagcccgcccataataacagaggaatacattcaatctttacttttcaagtgttgaagttgggagcccgcccagataacagaggaatacattcagtcttttcatttcaggtgttgaaattgggagcccgcccataataacagaggaatacattccagtctttacttttcaagtgttgaagttgggagcccgcccagataacagaggcatacattcagtctttcatttcaagtgttgaagttgggagcccgcccataataacagaggaatacattcagtctttattttcaagcattgaagttgggagcccgcccataataacagaggcatacattcagtctttatgtttcaagcgctgaagttggcagcccgcccagataacagaggcatacatttcagtctttaattttcaagtgttgaagttgggagctcacccatacaacagaggcatacgtttcaagatcaagtccaaggacaataaaacagagggttacagcaggaatccccaacaggaaacaataaaaatcccagcaccgggaagcaaaaggttgtaacaagaggccccagcacatactcaagagcatgggtcaaaaggaagaaaagcatcggaagaaaagcaccgaaggaaacacaagcctacaagaaagcaaggcaacaagaacaagttacagtctagcctagcttcttgttttcttttaaacacggtgtaacaaggagatcggtaagcagtgataacagcaggaaacaacagtaacattgcagtcccacggtagtcccagctaccaaaacttcccgaactacattaacctgattcccctttagccagggatatgtaggaaacctttgaagcaaaggttcagttaaatctttttcaaaaaatgcttcacacggagtactcggatggacaaaaatcgctcgtttatctttgcgcgaaaacccttcgtgtcttcgggcaaagaggggcagctgtaagcacgtgatttttgccctatatgagaaatactcccaaaaaatgcaaaataaaatgattttccttggtgtgcaattttgagtatttttgtgacatttttggattattatttgtatttgtctgtgtttgtttatttgctaaattaataaaaaatacaaaaatatgtcgcatttgcatgtaggatttaattctataatttttagtaattaaattagttttacaaaaattaaaaaattacaaaaaaatatgcatcttttgcatttttagcatttaatgtccaaatgaacaattttatgcttaattattacttaattgtgcgttaattgttagtggtagtaaatttgcgcttttataacttaatttagttcttaataataatttaagtatttttataatttagttttagaaaataaaagaagaaaagataacaaaaatacaaataaaaatcggattgggccacttcttcaattttcaaccccaggcccaaacaatcttctccatgacccagtccacttcagaccgggtcgacccagtccgccccatgacccaaatacccaacacccctttttcattttgtcaaaacacaaaacaaaacaaaaaataaaaaacccaaaaaccctaaaacctaaactaacccatccgccccttcgctatcttcttcttccccaaactcaaaaaaaactcctccaaagctccaaccaagcatccatggctgcccagcttcccgtcccaaacaccaccaaatgacacaacctccttcgcattcaaacgaccccagccctatccgccattgatgaagctcgtcgagctcaagcttgagctcgacgtccatgtcgctgctgcttctgtttcaaaccaaacaacctgctactcctgccttctacttcatcgtccaaacaaccaaacgaccacagcctcgacgagtcagctgttgttcgaagctcccatcgccgctgctcgtcacggccaagctcgcacgctgccatcgggtccaataccgtttcgccatggacgtcgtcagttgcttctgcttgctgcgtcgaccagctttacggcttcatcttcaccatggccaaacgacctccgttactgcttcgcttctccgagcttgggcatcaccatggccaggttgtcgccggactgctgctgctcaataatattcaagttctgctgctgcttcgcttctccgagctgctgctattcatcacttctccttcgcccagctgttgtatcttcagacgagctgctcgtttgagttttagtcgagatcgtcgagcgtcgttttgagttcgtcaagtttacaagggaggtgagttcgtcgttgagtccggacagatttattcccatttgagttttgtcaaaacagttcatacatatgtcgtgttgatccggttagtagtttttgaattttatgtttgtccgtattttgttttgatattttcgaatctaaaatcggcaaatgtttgttttgtttatcgtttgaattaatgttttgttcatgttcatgtgttgtttgttaaattaatttttcagatttcaaatgaatgattaattagttatttttcatgtttatttcatgtttgtattgttgtttaagtgaatatttgttagttttatgtttgttagattcaaattgaaatttaattaattatttcttcaatttgtttcatgttgttatggattttccagaaaatattaatgttgtttgaatcgttagaatccgtcatgtgtgttgcttaaaaacagatttaattcatgttcatctttgtttgaagttcatgtttaaatccagcgatttaatgtgagtttatgtttgttttgatttgttagtttaatttgaatcatgcatattgttgtttgtattattgtctctttgttcatccattaatgatctaaattaaccaggattggttcccgatatggttgatttatttccattaatttggaattttgtgttgttcatcatgttcatgtaaattgttgttgaagattgttgagaaattggtcatcttgactatattttggtcaagttatgattaattgattgtttagagaagaggggtaatttggtaaattgcattgcattcgggggtagatttgtaattgcaataaggtcggaggggtagtttgttaattgaacattattttgattctttatgttaagcatgggggacaaatataatggggtggggtttttgaggtatttgtttaatataatggggtggggtttttgaggtatttgtttaatataatgggggacaagacaaaacataatgaggaggaatcttgtactttttttaatataggcatgggggacaaattataatggggaggaatcttgtacttttttaatataggcatgagggacaaattgtaatgggttgggaatgtgttagttatttaatgtaggcatgggggacaaaatttaaaataaagaagacatttaatagtgggccaaagcatgccattgggggaataattttggggttgggaatggaagacttgtcttgctatatatagaggactattcttgacattaaaagggaggagaacttgaaccttgagaggatttttttggagagaaaaaagaagagagtttttagaacttgaatattaagagatacctgagagagtttgtgagagtaaaagagaaatccaatttgaactttcactcgaataatttctgtttgcttttcttcgagtgttattcaaaaatccgaagctactgcatctcgtgtcttttctctcttctgctttgactgtgattgtacttttttcactgttgagttttcaatctgtcactgggttattctactggttgttactggttttgcggtgttgcggaacctgctgttgctgcgttattactgttgctgactcctacttctttgttcttgtactgctgtttccaggtacacatttgtacactcttagcttgaagcgaaaaatgaaatattaatcaggctccggttcctgttgaattcttttgtttggatctgtgtttgaatattaattttcctctcttcgtataaaaatgtagtcgattaattaatgagtaatgaggttgcatatgtatgatttcttcatctaataatgctagtttaaattatttgaagaatagttaatcggctttgatattattgtgtatttatctcatgttctagcaaataataaaatgtggaatgaaagcagtttttccttgtacaaacgcgatcgcaattttccgttcacataagccgtaacttaataactaataagttgcgtttttcagcatgtaaataattaggagatttttcttttattttagagacgaacttaatagaaaatgtagtcgctataggtttatccttttaaaataaaaatgagacgagcctcgccaaataaatcataaaccgccggggccctcaataaaatacataaccattgactagactttggatttggccgtttaatgaaccttcacggcctcttcctaaaataacaatacgttagactctttaggatgcgccttaataaattttaccttcttaaactcgggtgcacatttatgtgacccaaatccaattctcaacggagtcgaaatatttctaatcacgggtacattgattgtgacgtggttcgagatgcgtgtccatgacgctgcaatttcatttaaaaaaaataagaatgagatgagcctcgccaaataaaatacaaattgcggggccctcagtaaatatttgctttaaaaattgtttagacttcgggatggaccgtttggtaaaattccacggtcctacccaaaataaatacgctagtcgctttaggcgcgcctttaataatttaatttccttaaacttgggtgcacattgatgtgacccaaatccaaatctcaacggattcaaagtgtgtcgacgaccacgggtacattgattgtaacgcggttcgagatacattttcacaacgttgcaattcttgataaaaacagtaaaatggtaaaagcggttaaaaattaaattttgcacataagttcacacttgtataaaatcagataatcaagcacttgtagatgaagactgtatgaagcctcgagcacttgtttatttctttcaatttggtccttttcctaaaatagaaaaatatacgggactcggaggtgctattatagatgaagactgcctaactcgtatgtatttccatcagattaattgtaaccctaggctgggaattttagaaaactccattttgccttgcaggtcatgactcatcattcggcacgagttagggtttttgcctagcatctaaaatcgttagtaaaactttaataattcaaaagaaaaattttaacatggcgatacctgaccgtgggtactttatcagaagtaatatctctttaaatggacggcattccaatgtgagggtaaaactttgccgtccattgtctccaactcgtatgctccttttcccgcaatgtcacgaactctgtatggtccttcccacattggacttagctttcctgaattagcagcctttgcaaattggaacaccttttaaagcacgaagtccccaattttgaaaaatctgaggcatgctttcctattgtaatatcgttcaattacttgcttttgtgctgccattcttatcaatgcagcttctcttattccttcaagcaaatcaaggttgacccgcatctcttcatcattagattcctccgttgcctgaacgtaccgtgtgctcggttcacctatttcaacttgaattaaggcttccgcaccataaaccattgaaaatggtgtttctgcagtgcttgtttttgtcgttgtacgataagcccataatactccaggtaatatctcaggccaattaccttttgaatcctgcaacgtcttcttcaagttgttgataatgactttgtttgtggattccgcttgtccattacccactggatggtatggcgtagatgttatccttttaatctgccaactttgaagaaattctgtgatttgagctcctatgaattgtggtccattgtcacacacgatctcctttggtgctccaaagcagcatattatatttcgccatatgaagtctttaacttccttctctcgtacctatttaaatgctcccgcttctacccatttagtgaaataatctgtgagtacaagtagaaactttacctgaccctttgtttgtggtagtggacctaggatatccattccccatttcataaagggccacggggctataacagggtgtagtaactcagctggtctgtgcatattattgccgtatctttgaaatttatcacatttggacacgaaattatttgtctctttttccatattaggccaataatatcctgctcgaatcaatgttcttaccagtgaccttccccctgcgtgatttctacaatgtccttcgtgcacttccctcatcacatattctgtttgagagggtccgagacaccttgctagtggtccaccgaacatctttcgataaagatttccttgatataaacaatatcgagcggcttttttgcgaagcgtgtgagccttccctttgtcattaggcacggttccgtgctgtaacaaaataataatttcgtttcttcaatcccatgttaaatgattaaaatttacctcattcttatcaggttcgagaacggaatgaaataaatgtatgactgaagcatttgcgtcatttgctatgtcagctgcagatgcgagattagctaaagcatctgcttccacattctcatctcttgggatctgcattaccttccaagtttggaattgctttattagttcccgtaccttttcgagatattcttgcattcgagtttccctggctgtataagtccccagcatttgattgaccaagagttgagaatcactcttgattataatttgtgttatgccgagttctcttgccaattctaaacctgcaattacagcctcgtactctgcttcattgttagttatagaatgacattctatagcttgcctaatagtttcacccgtaggtggtatgagaactatacccagacctgctccttttacattagatgaaccatcagtgaataaaatccaagtccccgggtttgcaccattaaaaacttgtaattctttttctgcttctaaatgcatcctctggctaaaatcagctacgaaatcgactaatacttgagattttatagcagtcctaggttgataaatgatttcgtattcacttaattctatagcccattttgctaacctccatgacaattcatgtttatgaaaaatgtttcgaagcggaaaaatagtaactacaacaatgggatgacattgaaaataaggtcttaattttctagatgccatgatcaaagctaatgctaacttttctagctgtgggtatcgtgtttcagtatctagttaggacttacttacataataaataggagattttttaccttggtcctcacggactaaaacagcacttaccgcaacttcagacacagccagatagatgagaagcttttctcccacctttggttttgccaataacggtggttttgacaaataagctttcaaatttctaagggcttgttgacaatcttcattccattcaaaatgatcttgctttttgagtgcagagaaaaacttaaaacacttttttgaagatttggaaataaatctccccaaagctgcaattcttccctttaatctttgaacttcctttttattagtaaggatatcagggatttcttttattgctttgatctgagaaggatttacctcaataccacggttagaaacaagaaaacccaaaaacttacctgacgcaactccaaatgcacatttttctaggttaagtttcatattaaattttcgcaaaatttcaaatgtaacagatagatgagaaatatgatcatgagactgctgggttttgacgagcatatcgtctatatatacctccattgtctttcctaaatgttcttggaacattttggtgaccaacctttgataggttgccccagcattttttagaccaaagggcattactttataacagtaagcccccctgtctgtgatgaaagaagttttttcttcatcactagggcccattttaatttggttgtaccctgaatatgcatctaaaaaacttaaaagttcatgtcctgcagttgcatcaattaattgatctatatgtggtaaaggaaaagaatcttttggacaagctttattaagatctgtataatctacacagactcgccacttaccatttttcttaagtacaacaactgtgttggctaaccaattagggtactttacctcgcggattgacccaatttttaatagcttttggacctcatcttgaatcacctggtttttgaaatccccttgctttcttttcttttgctttattagtgtaaaggatgggtcttcgtctaatttgtgagtcatcacatccggtggtatccctgtcatgtcagcatgggaccaagcaaaacagaccacgttagattttagaaatttaattaacatacctggcatgtttgagtttaaattagctccaacataaactttccgttcaggccattgctcaaataatatcacagcctcgagttcttcgatggttgttttgatattttcattctcctcaggttcttgaattgtatcaggtctcgagtctaaatctgttttctctcgctcagttgaggtttgattgctgacaccttcaactgtttcctgtaattgctatttttctttgtttacggtgctcgtatctgttatagtgttgatactcctcgttgtttgctgatctcctcgaatttgacaaatcccccacggtgatggaaatttaataacttgatgtagagttgacggaacaacatccatatcatggatccaaggcctccccatgatcatattgtaggccatttccatatcaactacctgaaatttagtttctttaacaacacctgcagcaaaagttgttagaattacctctccttttgttaccacacttgaattatcgaagcctgacaaagtatgcgccttgggtatcattttgtcttcaccttgcatttcacgtaatacccttagtaatataatatttacggaactccctggatcaatcaaaactcgttttacattagtatcatgtacaagtaaagatattaccagtgcgtcattatgtggagttatcactccttcggtatctgcatcatcgaatgaaatactttcattttctaaaacctgccgtacccgtttcccgtgtgtaattgttactttagaaaccttgttggaagctgtgtaggttatgccgtgaatatcttctcccccacttatcacattcactgttctcttgggtgaaggagactttggtggatcttgcctatttttcatataggcttgtttacctttttcactaaataactcagtgaggtacccttgcttcaatagatgatccacttcactctgcaagaatctacattctgaagttttgtgcccgtgatcattgtggaattcgcaccaatgatctggattgcgtctatttggatttgaccgcatctcttttggccatcgtaccttatctctcatgcttctcaaaacagccacgagctcggaggtagtgacattaaagttatatccgccgaaccttgcctttaaacttctgtcatcatctcgtgactcttgtctgttccgatcatttctgaatcttgatgaagaaccagattccctgttcctcgattttttatcatattgctggctatcttgttttgaccgtgattcttttcctgcaggtcccatatatggatcgtacctgtttttacctaatcttttttcggtttctgatcttctggaaccgcccctttcttcatgatgaaacttaggtacggtatcttcttcaattcgcagcttcgtactgtacctattgtaaacatcattccacgtggttgcagggaattctcgaaggctttctttgagtcttctcgtggcttcagaacttttgtcatttaaattacttgcaaaagctattgaaacccagttgtcaggtacacggggtagagtcattctttcacgctggaatctatcaacaaagtctttgagcaactctgaatccccttgtttgattttgaaaatatcttccattcttttctcaaccttttgagctcccgagtgcgttttaataaaagaatctgcaagctcagcaaaagaatttgtagaatttttagataaaagagaataccaggttaatgcacccttggtaagtgtttctccaaatttcttgaccagtactgattcaatttcttgttcggtcaagtcgttgcttttcacgcctattgtaaatgcagtcacgtagtcacgtgggtatgtagtaccatcatatttcgagatgtcaggcattttgaacttttttggaattggaaggggagcagcacttggcttccaaggttgttgtgagtatttgtccatgtatactccttttattacaggcgaaactccagggatttgctcaatacgctcattttgttccttaatctgtttctgcaaggttagtactaaattttgcaagtaggaattatttgaattacctggccccccttcctgtggttcactagtggttcctccatttccagaattaacaagaccagaacgaggattctccaatgtattattattaggagttggtgtgggtggtgcagcaggcaatcgactaactagagcctaaagagctttgccgacctgtgcatcaattagcttttgtaaagcttcatttgcacctccttcaaaatgtttagattgttcttgttggtcagcacgggattcaggagcaggagtgccttcacgagattgacgtggtgaatctggaggggaggtaaccacgtcaatgttcggtaggtctccttgattttcatggatttgattttcatggtttcccaatgtgttatcattgttattgttgttgtttgacatgttgataaagacgaataaaacatagcttcaaagaaaagattatcagttttccggtaacggaaccaatttgtttaacaaaaaatgtgattctttggtcaaagctaaagacaaatagaaattcgggctactgataatcaggagacgaaaaagaaataatagactttttgagaatgacaaataaacagtaaataggtttgtattctaatgtaatgtttttgatctcctcccccctacaaatgacgagacctcctccttttatagttgattctaagtaaaggagtaataccttagtcttaatgagacaattatgagcaataaataatattaaataagacgttacacaatcattcctatttaataccaattctctaacgtattgggtatttaatattgaatttgggctccttttcgtcatcatatccacgtcttcaatgccttctgatctcttggctttaaatgacctaaataggtacgaagcttgtattattcgaattgtctctcgtgcctatttagctttcctttccccgtatttgttgtcactcgtgcctcttaactgatcatcatgttttgaccatttgaacagttctcatgtcatgtcacgtcaccttcaatgtaaattcagttttttcccaatacaattgtcatttggcgtcagcaaggaaaaatttcgaagccagattgtaaagtatattccgtcgtccttttcgttcgttgctcgatggtaatttgagacatttcaagttttatagtactgaccttttatcattcttcctttcatcaatgttttgacatgttgctttcattagtttaatattctgcttttcttatattcgtcatcaatattaaaagtaattaagatcttcccaaaaaagtttaagagaagtagaattaaggatctaaatccaacatgcatcatctttcagttgctaacacttttgtccccaccaaattaaagcagattatacttatcccatgtaactcaatatatgcaccgtccgccccctaattcctctctatcaattagtccttaattttcctaagaacattctcaccgcaaccacctcctcttttgccttgggatatatagttccgttagcaactataaatttagccacaatgtgagtatattattcctcaacacaaatatattatagcacaaattaaccgcaaatttgcaacatatatataatgcactgcccaaatcaactacttttaaccaaccacatgcattttggacttgcactgcctaatactaattggcagtgcaactctaaaattagttatgctccgagcagtcgtctaaatttgagtattgctcggagtatcaagatcagtaactctggccataactacctcgttgttgatgataaagtcaaactcggagagaggtggatggaatttcaaggaatcaaaaattgggatggtttgcttgatccactagacgatgatcttcgcgaggagattttaagatacggagaatttgtcgaagcagcctattgctgcttcgactttgacatgttgtcagccacgtatgcaacttgtcggtatccaacgtgtacgatgctgacacactgcggactaggtcagagcgggtacaaggtaataaaaaacttgcatgccacgtgtgctgttcaaatgccacggtggactgagagatttcctaatttggtgtcgccgcggtccagctggattggttacgtggcagtatgcgatgacgtggacgagattgcccggctaggtcgcagagacgtggtgattgcttttagaggtactgccacttgttcagaatggcttgaaaatttacgtgccacgttaacttgcttgcctgatgacatggcacctgaaaatagtgaacccatggtacagagtggactcttgagcctgtacacttcgaaaaatgaagggaatccaagtttacaagatacaataagagaagaaattggcagcattctcaatacttatagtaatgagtctctgagtataacagtcacaggacatagtcttggagctgccttagctacacttactgcatacgatataacaacaaaatttagtgatttgcctatggtgacagtagtatcatttggagggcctagggttggtaacaagagctttaggtgccaattggaaaaaaatggaataaaggttctcagaattgtcaactctgatgatcccataacaaaagttccgggattcgtgattgatgacgtggaaagccaaggagcagccacgctggcaagattgacaagctggcttggaaagtacatggaagatactcaatgggtgtatgctgaggtggggaaggagcttaagttaagtagcaaaggaaataatgtagcaaaatgtcacgatttgaagacatatttgcacttggtgaacaattttgttagctcatcgtgtcccctcggggccacagctaagaaagtagtatcaaagagaaaacaacgtgaaagaaaagcagttgtagtttaatttgatggattttctataattaatacgtagaataagcataagaataagaatattgttacgaaataaaagcaatttagtaaaacatgaacaagaaataaaagcaatttagtaaaacatgaacaagaatagagatagagagaaggaagagattttcttctctaattgtgtgtattttcctatctattacaaagcttttatataggcatgaaaagtgaagaaaatatgtcatggaatatgtcattgaacatagaaaatatgtcattaaccatttgagagaaagatcatggaggaagagtagacatccaccatattttgatttttatcataacactcccccttggatgtccataaataatgtgcctcgttaaaaccttattaggaaaaaaccctatgggaaaaaaatcctaatgaaggaaaaagagtacacatatttagaaatacgccttttggttgcctcgttaaaaaccttgcaaggaaaacccaatgagacaaaaccttgtaagggaaaaagagtacaacgcgtattaaccccactgatgagatcatcagttcacatcgttgagccttcgtatcccaatcttgtacactagtttcttgaaggttgatgccggtagatatttggtgaaaaaatcagccatattatcacttgaacgaatccgttgcacattaatatcaccattcttttgaagatcatgtgtgaataataatttaggtcaaatgtgctttgtcctaactcctttattaatcctccctctaattgggctatgcatgttgtattttcttcatacaaaactgtgggtagtttatcacacttcaaaccacatttgtctcgaataagatgtatagtagacctcaactatacacattctcgacttgcttcatgaataacaattatctcagcatgattagaagaagtagccacgattgattgcttagtcggtcgccaagatatgacaatgccacacatgtaaacacataacatgtttgagatcaagccttgtgtgtgtcagataaataccccacatcgacataaccaacaagatcggtattgcaatcattgccataaaataagctcacaccggtaatcccccttagataacgcaatatgtgtttgatttcattcaaatttctccttgagcggagctatatcttgctaagacattaactgaaaaagttatatcatgccttgtagtgttagcaagatatattagcgcaccaattgcattaagatatggtactttaggaccaagaagctcttcattattttcataaggtcggagtggatctttatttatatcgagtaatctcacaactatcggggtacttaatggatgtgctttatccacatagaagctctttaaaatctttttagtgtatgctgattgaaggacaaaaattccatctttcatatattcaatttgtagaccaagacaaaattttgtctttctaagattttcatttcaaattctttctttaaacagtctgctgctttaggaagctcttcgagagttctaatgatatttgaatcatcaacatacatggcgattataacaaattcaaattcatatccttttataaggatacaaggacaaattgaattattcttatacccttcatttcaacaagtactctctcgggcgattataccacatgcgccctgattgtttcaatccgtataagaatttttgaagctttatttaataaatttcttggaaaccttaatatgctccaagacaatttaaatctttcaatgatatctactataagagaacatggcttcatatattcaatgtgaggatatttactaattttcttgtgccacaagtcgtctttatgtctatcgacttgaacctttcgaacaagaacacatttatacctcaattgactttatactttcaggttttggactatccgtccaacttcacatttttcaagtgaagtcaatttcattgcgtatttttatttggccaatcttttatccgtccaaatttcatgacagatttgatctcaagatcctcgtcaatattaatcatattgagcgctacattatattaacaatatcgccgacaatcattttatgtcggttccattattacccaataaagacataacttattgagatctctttatttcattattttcaggtacctgagcctctcccatgaggtcttatgaagtgttatgtcgtggtgctcttctagggcacttgcctccttattatgaccattttgaatatttgcccctctccttcttcaaggagttttatctttggaaccgattggtctgttacacttcatgtgtgccatagactctgtccctcatggactttattctatttggagcattagcagctgaaatatgacatttagttttgggtcagcaaatgcgtctggcaataatttgtaaatgaatatcacttgaacttcaagtttatattttcttgtacgaggatctatatgtattcataataattcatttcacgtatcactttctcagctgcccattttctccccctaatgttgggatcaccaacacatttcccaaccatctttgggaactcatgtttgtgcattttggtggcataattaaatcatatagcacattcatatttctatatagaaattatttggttcctgaccctgaaccgattgtgatagggagaaattttcataacttggctagatgcgtacaagtgctgttgtatattaaataatacatctcataccaaaattcattttttttggagttttgttctcataaccaatgatttagctataattggaggcatacaatttctgctaaaccaacttggatttaaaccagtattatcaagataaatcatcataatttatattctggaactgtgctctaataatttgagcaagcaatgttgcaaaagccaaactgcaagttgataacaaatgcacatgtgaccatagaatagatgcatctattaaaaatcatatattagtaaacggtccacatggcaggtgactgggcccatatatttatcaccttttattcgttccagaaatcaagagattcaaactcaaccttaactggtatatcatgagaataagcaacacaagagaattcttgaagaattttctattcttcaatatatgtcaatataattcttaattaatttttttgcatcataattgaatcaggatggtcaaccggttatgccaactaatatttgttttagtaaacctctagtttacttgtgtcatatgatttcatcatcatgcttatatttgtgtagtacaaataggaagaaaatcgggtaaccttttatatttatccggtatgattatagaaatatgaagatattcaatcttcctttcatttatagtctcaatttgacaaccactttgacttatacatttgaaactcaaaaagtttcttttgagactttacaatatcaatgtcatgaataattttattcatctgggtagtaacaaatcagtttttccggagctcttaacaacttttgtactacaagatcttttatcataccattcatatggtaaatgtctccttcacggagaaacttatatcataataaattgtcatggtcaaaattatcataagcaaaattatttcttgctttaattttgcctttaataatttttataagcatgccaaaatattttggcgtatcacatgtacgagaccaatgacatattcatgtaaccacataataatatttgttctctttatttcactcaaacctccctcaaaggtgagttgtgtggtactcatccaatcatgtcttgcatgtctttattcattacttttatcacatattaccacattcacctttaggaatgggtctgcatcctcaatgcttatcacaagtcacattctcttcaaggaatggatcataatcaacgatgtgcttcataccaatttgatgataaacattgccttcacattttgaaggactattttgagaacccttgttgttctccttttttaatcattgtgatgattattattattatttggaacgctctcgttcattgttcaaccacttgtcttcatttagacttattatgcactgctatcatatttacttcaaaaatgtagcaaatcaagtgggacaattttcatgccttttcatggaaaatatattatttttctttagtcatcattatatcataaatatggtacattgggactcaaacccaatatcttaccaatataaaggcatgttaggccataataaattgggactcaaactcaactcttatcattatggagcatcaggacttgatcccgatgtcttaccctcaatcaatggcatagtaggctaaaaaatattgagattcattctcaagacttaatttcaatcacatgccaagaaagttatacacaactaatttgcatcttagcaaatcaaatttgctttgttaaataagtgtacaaatctcaaatcagcgtaaatctttattaatcatttgtagcatctatatgaaatacaaccgtttgtagtcagaatatttcttctaaattctattagagtttaaaaggatcataaaatcattgtcataatatttattgagtctctctcaaaaatattgttgttttcggggtataccctacctattggatttgattaaacgccatgactttccttcactcaattcaaccaagcaattagtgaataaatttatcaaaagtacaccatataggtaacaacacacatatatagtactaatacataaattcagcatttatattacctgaaaagtgacattataggtcacaacttaccagttgtagcttgtgcatcattcatataaaatacttaaaaatggtaagtcagtagcaagcatcaagtaggtcatggatactcaaaaatacctcttctagtagtcatactaatcattgtttgctttcaaatgatacgaccataaattatgaagtatactttctcaatagctggtttgttttttaaatttcaaagaagtaattaatcaacctagataaagatgtgaagtatttcttgttttcttcaagatgatttatgcttttaatcagtgggaccaattttattattatattttattccttttttttttggtactacatgcaagtgtaaaaatccaaaaggaaaaaaaaatattcatccaagtaaaagaaaatattaaaagcggcgagacagattgaagataattaacgcacaaatatgcataagacaatttatataaaatatctttggttaccatggcatgcatcatatcaacaattaactgctactatgattttcacatatagaacttcgaaaattttattccattcatgtgatataaaagatgtaatattaatatgtgcttatgcaatacaagtgtagtacgaagttgtgtgcatatgagattttaaaggaatgatacgtataagataatcataccttcttacatttcattacttaccatatgtagtttctctttatatttaaccgtgtgataatatgtatagcttctaattgtaattttttcggatgtaggaaatttttttgtagatatatatacaattggttagagactcgtgctgataacgtgttacgaaataaaagcaatttagtaaaacatgaacaagaaataaaagcaatttagtaaaacatgaacaagaatagagatagagagaaggaagagattttcttctctaattgtgtgtattttcctatctattacaaagcctttatataggcatgaaaagtgaagaaaatatgtcatggaatatgtcattgaacatagaaaatatgtcattgaatatgtcattaaccatttgagagaaagatcatggaggaagagtagacatccaccatattttgatttttatcataacaaatacaattatttttttttaccattttttggggtccgccatattcccttcggtgaccatcctgagagacggcttttccattgccctctttgtatatcctcgatgaagaacaagtacggtattttattgtgtatatatacctgcttctgctttggtattgctactattttgctggtgttgttgtttttccccggggcggatctacacatacactaattttgggtgctcgaacacccattaacctcggctcctagtagatgtagtcctatacaaaatttgaggaaattaatataaaagagcagaaagcaccagaaagacaaaaagtctaatgggtgctttgattaagggagggggttggaagtttataaaggttgaaggggcgagggggttcgaaaccgtttctcaacatgccttttaaaacaggcaatatatttctttttatttttccctcatattatcaaagctattttctactagttttcaccagccactttttctacacattactaccttttaagagtcatttttgctaactttggtttatctcttattattttacaaaattcaattcactataaagaaagaaaaaggacttcaaagttcgacacttgtgaagacgagcaattcatctgaagggacaaacccatcaatatctcttctcatcaactgcattatccatcacagtcttacggcgtccataatattaatactatgattttctggattttgatgcttaccttcttataattaaaaggagttctcgttaacttttttcaccatcgtgttcaaatagttatgtatttatacaatgtgattggtaataactttacgctagaaaaatctaagcacccacgaacttaaattcctagatctgccactggctttttcatgacttttttcattaatatatctaataatgttagtacccgcgtgatgtgcagataatttgaaagaatattaatattataaagttattgtataatttatcatattattttaataaatattagttattattttattatttattgtagtgcacagaaatatagtaaaatatatacaaatcaaaggatacgcatcatatagtaattaaaaatttcatttaccaagaatatatttacagccgctcgttctttttggactataagaacaaggcctcctatttcatattctacctattacatagacagaactaaactctatatctatccgctatggccagcaaggaaaactatctaaactatttagtatctttcttcatctactttgtcgttgtcctctaatgtgtagttggagtacaatctccctgatgatatgcttggtgtgatgttgcttctgttgaaattttcgagcattgtgctccctccaaatgtgataaaattgtttcagcaaagagccagcccaatacttctactcgcactctattgttgttcactcttctgattatccacttaacttcctccgtctatgttcccacttgtctgtgttctcccatccatttcaatagtacattccaaatagtagcagagaatgtacaggcaaagaagaggtgagctaagttttcctctgcaccagagttatatagtacacattctctgctacttccatcacctttttgatactgcagggtgagagataggtatgccttcttaatattaaacttccctccttggacaaaattctgcaattcaaccggttgttttgagccctagcatatagtttggcagtttaaggccatgagtagcttcacttcaggtattatgacttgtacgcatggtcggaattgaatttcgggaagctcggagttgatttggaaatgaaattctcattttgaaagctttaagttgaaagaattggctaagatcggattttgaataaacgacctcagaatcggaatttgaaggtttcaacagattcgtatgatgattttggacttaggcgtatgtccagatcgaattttggatgacccgagagcgtttcggcgcctattgtggaagttagccttttggaaaaaatttataagtttggattgaagtgcatttcactattattgatgtccagttgggatcccgagtctgagaataactctgtatggtgattccggtattaggagcgcgatcagaagtaaattcggaggtatgtaagtcattttggagtcatttgtcttaagttagaaatttgaaggttttgagaagtttgaccggaagtggactttttgatattggggtggattccgattcaagaagttggagtaggtccgcaatattgaatatgacttgtgtgcaaaatttgaggtcaatcggaagtgatttgatagatttcggcatcgaatgaaaaagttcaaaattctaaagttcagaaagctcgaattggagtgtggttcatgattttggcattgtttgatgtgatttgaaggctcgactaggttcgtaatgtgttttggaattgactggtgtaattggacagggtcccggagggcctcgggtggatttcgggtggttaacagatcggattggggttgggagaaagagatgaagcctactgtcatctggtgtaaccgcacctgcgaggtcttagccgtaggtgcggagccgcagaagcggccaaaggagccgcagatgcggttgagaagagaaatgttgggactgcagatgcagtcatcttgccatagaagcgggatcgcacctgcggaaggggaagcgcagaaacggagtgacgggcctggtgaaagatagtagaagttgtagtggggtcgtacctgcggaaccgcagaagcggtcaagtgaccataggtgcgagaatcgggttgggtagtgtgttcttttaaaagcgagggtttggctcattttcaccatatttcctcgatgggacgattttggagtaacttgggagtgtcattttcaccaccaagcatgaggtaagtgatttatgctagttttgagttaaatacatgattatatacggatttagacatgaaaattagtagaaatttgaaattttgaggaagacttagaaatttggtattcttggattttggccacgatttcgggcataaaattgagagtaaattatatatttgagtttgtgaggttgtgggtaaactttatcttcaaaaaattttggaatccgggcacgtgggcccaaggataattttatcaaatttttgatcggggttaagaattgttatatattggattataatgagtgtttgagcatatattaatgggtttgcataattattggctagttttggagcgttgtgcatcgatttgggtcatcggaaggacttggaagccggttatggaactttagagcgaggtaagtctcttttctaaccttgtaagagggaattgtccccataggtgaaataattaaatatgtgctcctatttgtggggggctgcgtacacacgaggtggcgagaatccgtgcgtagctactattgtgcttaagcccgggtagtctaggacccaaaagcatgctttactggtaatatttgcaatcttgttgtcaatttaaaatgcttaaaacataccgaacgtgtaataaatttctaaaaggctagacatcattttcttgacttttgaaagaaaaattgccctttcttggataattgctccttaataaattcttgattgactgtttgaatgtgtttatctattgtggaacaggtcgaacacctcggtagattaaatggatgcatttatagttcacgccattcgaccctctggcaatgcacattttattattatattggatcgggccatacgaccttggcatgatttgtgcatgtttgtattgcttgacttgcaaatttataaatgatgatattgattctctggcttgagataaatgtataaataatgaaaataaatttggagattccctattaataaaagaattatttatttgcttcatgctattgagttacaaccgtttatatgaaaaccctcgatttactattttatcggtatattattattggaccactagtaagtgtcaaagtcgacctttcgtccctacttcttcgagattagacaggatacttactgggtatgcgttatttgcgtactcatactacacttgttgtgcatttttgttgcacagacacatgtacctctagtggcccagtgggcgtagcaacatgattgatatggagacttaggtgagctgcatatctcaagacgactcgtagccagcagagtctctttcagagtattatatttgctttctgtccaaacttgtattccggacaattattgtacttcatttgatttcctaatgattgttcatgcacttgtgacactgggttctcgggtaattatcggatattcagtattaaaaattgtaagcacttttatttattatgtgaagattgcttttttactagttaaattataggaaatttatggtttcaaagatattaaaatgagagtttaattaattatttaatgttggcttgcctgaccgaggtatccgacgccatcacgacctttaatggattttagatcgtgacatagagggtcaccacctatcaaccactgtctagcatcaattatctttcttacaatccatcaagctttttgtggagtcttcattctacccacttctttgccttttatgcagaagctgtggatccacttgacctagagagtgtctttttttaggctactgcccaaagcaatttacatatggctaccctattcctatgaagaaataaattatgtttagaaccccggcagattttttgcatacacagtttttcccaagccactaatgctcttttagatgcttgagcattcccagtctataagaaagttctacaaacactagtaaacagttgtagaactttttttggcagtaggaatacctgagcccggcaagtttgcatttttaatagaatactcttaatcaattacactttgccacttatgataggaattttgttgtccaacacctgattttggtagtcattctctctaccagtggaatacattgttgtatgttgaccttccaagaggataaaggtgccctaaggtatttgaatgggatctcccctaatgagaattgtgtctcggacaaaatctgctccttcagtgcttgagagactccaattatatacaaggaactcttttcttgattggctttaagtcctgtggcatcagaaaagtgattgaatgcttgaagcaccaatcttatagaagtttcatctggcctgcagtacattaacaaatcatccacaaaagaaatgtgcactaactttagcttaccacatctagggtggtaattaaagtcagggttgtgcctcaattgcttcaatgatctgtttagatatttaattgccaacacaaataagtaaggggacactagttctccttgtcttagtccattctttgcctttaacgtaggattaagaaccccattgattagaatagaatagttcactctgaaacacatttcatgattaagttaacaaatatttctggaaaaccgaactccaccagaattgcttttaaaatttctcattcaatagaatcatatgctttccttatatccactttcaccagacatcttggatataaacctttctgggaatatcctttgacaagctcatgtgctactatgacattatctaagataatcctccctactatgaaagcaaattctgatgatccaaccaagtagtccacaaccagtttgagtctatccgtaagtacttttgctattatcttgtagagagttatacaccaatcaattgatcggaattccttcacaaatgtaggattgagtatttttggtaccaatgtgatcgtagtactattggttctttgagtagcctaccagtttcaaaaaattgcactcttgcctatgttaaatcattcccaacaatgctgaaatattctttgaagaattcagcagtaaaatgacgagtttgaaacacacacttaaatatgttctctagtcgaatatagtaaattataatattgtatccacatgaattggagttaaatagttattatcgtagtttgtagctagattgctattcaagatgatcaacaattgagaattatgtgatttaaaactaatattaactaagagtcaaactattgactcatgacaaacaacgcaagtagtaggcaaaggaagatattaattgggagaaaatatggttgataagataggtgcaagataaatgtttgggatttaactctagataatttacttctaatgttcaagtgaatctctcgaattcacttggttattagttcaattatttagtagaagctcctctctcgattaagtctcaacctcacaagataaaccaattttaagcatgtgaagatatacaagaattcgtagtggattggtctttaggagaacctctctcgattattctcctaactaggttcaatcaacaatttaactagcctttttcgattactaagaagaattaaaaacttcaaccaacaaaatataaagcaacaatattacaagttgtgcctctcttgattacatgaactagtgaatatagaagcaacgattaaaacatccaaaatgattcaatacataaactagagttaattatccacaaacaagtatcaatacactaaatccatcaaatcctaaagaagaattacttcatggatatggagaaattcgccacaattaagtttaagttaaaggaaaacataaaaaagtccaaacccttgtcttaagttgagatcgaatggtggattccttgtgctcttgcttctccaaattctccttagcctccttaggtctaagatatgtaaaaagtcctcaaaaatatcgtttttccatgtatatataccaagtagggtcgggcccaaacacatacaccttctactacgcgaaaaagaaaacctttttcggacaaaacatgtgcggccgagcacctgaaagtgtgcccgcgcacttttcacactattctaccccatatgcgcggttagtgcgcggtcaatgcgcggccgcgcacttgccgctcactattcaccctattttgttgggaatttgaaaaaaaaaacataaaacatgaaagttgtagccctttgaattagctttccaaaaatatattgtgaagtcagaacggagttctgagagaaaagttatatgtattttactagatagtgtgcagtatgcctgctcgattcttcgtttgttcttaactatcatccgttgatccccgaacacgatccctgtttaatttcttgggctttttcttagacttcaaagctccaaattatttgaatccattccatagcatctatatagctcggaatcactcctacaaggcataaaacacataattagtgcaaaatattagtgattaaagctcaaactcaactgaagtgcagtaaattggaatgtaataattgacaaaaatatgagattatagcctatcatcaacaccccacacttaaactattgctcgtccttgagcaatcaaaccacactttatatagacacgaccttactaaggcctcattttgtttttttaagattaaaacgtctgaatctgaatacacatctgaatatattaagatgtgtattaagatctgaatagaaataattaagactgtttgatttttacatctgaatgtataaaatttacctttatttgaaaattaataagcataaaattcaaaatgaaataactaatctaatactctatcaatagaatatagtttttaaaaatatgatagttgttggtagtgatggctaacgtataaatgacgactagagacggtggttggtagtagttttggttgatggtggtggttcatgctagtagttagtagtgattggtagtggtggttggtgatagttaataatggcaggtggtggtagtagttgtgattgaggaaggtggtgggtgagtggtggtaggttataatgatgggcactgccggctgtggttgttgatggtgatgtggtggtcagttgtggtagttgagatggatgagtattgattgtgggtgcgaatgatggtggtcggagtggtggggatagtgggtggtgatggtcgataatggtagcggctatgattgaggatgatggtggcgtggtggtgatggaggtggtggtggtagttgagtatgatggtagtggcagcatggtagtagttgataatgataggtggtggtggcagttaataatgaatatgtgatagcatcttaatgaaattaagtctctgttattgatcttaatcatacagacctattcagacccattaagtggttatgaaataaaataaacaaacacacttaatgattaagatctgaataattaagattcagactttaaaaacaaacgcacttaatgtttgagatctgaatgattaagattcaaacctccattaagtgcaaacaaatgaggcttatgcaactctctcgactcctcacaccaagaatatttaaaatagactaagcacaatagtgtaacatcttcacttcaagaattgactcacaagcaccacccattattcacaacttactcacttactctaacatagagatcaagaattaccttttcttcatgaatcaagtgcccttacacaacaaaagagagtagttccaaacacaataatatttaagaacgattaggaacttcaaatagaaagaattcactcactctcagaaacaacattcatatgccacaaaagatgaaccataggcttgcccgtagtgtactattctactaattgagctcattcaatcaaggatcaagtagaacttttaaccggttgtaatgtaggttgcaggacgggtaggatatatttagatataagagtgactacacctccctaagcactttaatacatacactttaacaattgaaatcccacacttatgtcaaaccatatctccaccttaacatcaacatacattaactcccaaattatttaagcacgtttacatcaagattcaccactatcaaagaatatttttcacaacaatacaacattttttctttctttttcaattcaagtggttcttactttttcaaaataatgtacttttctccttatttcaatagttccactcaaaaaccaaaccaaccaccccatacttcatcttttacaaagttcataacaaattcaagtgctcacgagaggtacaaggttcaaatagattgtcaattcaaataattgggtaaggattgtaatgtggttgccaaagaaacaggattacaagctcaaagggattaactaagatacataacaattaggtggtaaaagcatattactgactcaataaagaaatgactatatcacttcctagattgaacaaaactaccatttcgctttgcaaacacacggggcaagttctagacatcgaatacaatgcacagaatatacaaacctcacacacatgacacataactcactcaggattgacctcttaagacactctagtcaaagcagttaagcaaagttaaaatcatacaattaaggtacctatacaagagtcaaaaattgagcttaagcgtcacaactaaaacacttactattctcaaggcataacaaagtcaagagatattactttcatttcaaaccatagcacaatgtttcctacttctaacaaaaataaaaactaactacacccggttcaaacaaaacccttgaaaaataatcgcggcacaaagaaaaatcaaggggaaattaatacactaactacaaaagaaattttttttgtttttttctttcgacttaattcccttaagaaacccgtcgaatgatatccatcgctgggaaaaatcgaaaattttaaaaaaattatgttttttttcaattttttttctaatactcaaactagcaaaagcaaaaacaatcaagctaattaaagaaaaaactaagactaatctacatacaacatacaaataacccctaccccacactttaagttgtggcatgtccccgtgacacacaattaaaaagtataaggtagaggaaacttccctaaatctctagtcggggtctgaatcaaagtcgggctccattccaagcgcctgaactaatgcgcacatccatgcagacagcttcttctcagccttcttagggtacaccccacacttatctttttcactaacagcagcgttcttttcacgcccttcgccttccactcaacacttgcagttggcttctcctttttcactccagttactacattcatctcaaaaatcaccgtcttttcgctcactctaagcatgagttttctatcatgtatatcctgtatagcactacccgttgctaaaaatggtcttcctaagatgagggggacctccttgttctcctccatattcatcactacgaaatctacaggaaatacgaacttatccacccgtaccaaaataccttctactatcccctcgggtgttatagttgtttggtctgccagctgcaaagatatttgtaccgaccttatctctccaatctccttctccagtttcctgtaaatagacaatggcattagattaattgaggcaccagaatcacataaaagacttatcaaaatttagagtgcctaaagaacaaggtatagtaaaactccctagatctccacacttttgtgggagtttattttgtaagatcgcattgcaatgctctgtgagcttgaccactgaggtctcttctatcttcctcttatttgtaaggatctccttccagaatttggcgtaagctggcatttatgagagaactttttaaaatggcaagtttacattaacctgactcaacatatctagaaatctctcaactgcttgtccaacttttctctatagagcttttggggaaaaggtagagcagacatgtgcttgctcacatcgtcagattcctcccatcttgaagtttcctcctccttatttttctcagctcccttcttgccttttttcttcttaccatcttcaattttcagctccttcccactttctttttcaggcgcaacttctttttgaactagagtgggatctttcaacacttgtccacttctcaaggtcacatcatttaccgtttctttggaattcttttcagtattagctggcaaagtacctgggattatctcatataatataattgtaatttgtcccacttgtctctctaaattacgcaaacatgtctcaagttctttgatagcttgcgccgtgagtatctaatctcttatcggttttgacaatgaaggatttcattagatcttctaacccagaataaattggttgttgaggctgaaactgtggcctctgttgattcacaaaaccaagagctccttgaaatctggagttattttgttgccatgaatttgttgtacccccaggtgaactccacgaataatcggggtgcttctgacccattgcattgaaattataattaccaacagcattaatttcctccattgaagcttgacactcatgattagggtgtcctcttccacatatgtcacatgctgcatgaggctcattatgtattgaagctaaggttagcttccttattttttttgccatggcatcaagttgtacctacacagatgtgttagcatcaacctttttaacactagttaatcttcttctttcagtaatctcagagggccactgatttgcatctttagataactcatctaaatagcgactatctcctctggagtttcttcattaatggacctccatttgcattgctcaatgttctgcgtgaggttggtgtcaaaccatccaaaaatcctcgagttgcatccagagttctattccgctatgttgacactttcgcactatctccttaaacctctcccatgcttcaaacacagtcttaatctcattctggcagaagttatggatttctctcctaaacttgcccgctttagctgaggagaaatatttagcaagaaatattctggtcatctcctcctatgttctaattgatccctggggcaagcttcgaagccaatgctttgcatcatctttaagtgtgaaggggaatgcccttagataaactgcatcttgtaacacaccattgtattgaaaggtgttcatgatctcttcaaagtctatcagatgattgtttggatcttcgttcatctttcctctgaagacatagttgttttggagggtttgaagcaacccttgcttcaactcaaaattattagctgcaacaggaggtggtcttacactcgataagccttagttgtagactggtctcgcataatcaccaagttgtctcccttggtcgggagctatatttccgaactagtctattcccacgggctgattctgagctattcttcgagctctctcctcctcataagcaatttgtgcatctctgagtgttgcttcttcaacatctcttgcagttttctctctgagttgggctgcctctctcgcagccaaatcaacattctcatcatcttccgccatcttttctttagttgaggattgcccaatcgtttttgtattctcggagagatttctttcctttctcaattgtcgcctatgtttcttaatttatggttcgtatggttgcaattccttcccagaagatcaggtcatgcaccaatctaacctgtagcctgcggatagtcaaagaacacccaaacgtaaaaagagaaaaataaaataaaaagaaaaagaagaaatcctgaattagcactacaaactatttcaaacactattgattgtcaatccccggcaacggcaccaaaatttgacgagcttgaaacacatacttaaatatgctcgctagtcgaatatagtaaattataatatcatatccacagggattggagttaaatagttattatcgtagtttgtagctagattgctattcaagatgatcaacaattgagaattatgcgatttaaaactaaaattaactaagagtttaaactattgactgatgacaaacaacgcaagtagtaggcaaaggaagatatcaattgggagaaaatatggttgataggataggtgcaagacaattatttgggatttaactctagataattcacttctaatgttcaagtgagtctctcaaattcacttggttattagttcaattgtttagtagaaactcctctctggattaagtctcaacctcacaagataaaccaatattaagtatgtgaagatatgcaagaattcgtagtggattggtctttaggagaatctctctcgattattctcctaactaggttcaatcaacaattacactagcctatttcgattactaagaagaattaaagacttcaaccaacaaaatataatgcaacaatatcacaagttgtgcctctctcgattacatgaactagtgaatatagaagcaacgattaaaacatccaaaacgattcaatacataagagttagagtatattatccacaaacaagtatcaatacaccaaatccatcaaaccctaaagaagaattactccatggatatggagaaatttatcacaattaagtttaagttaaaggaaaacataaaacaatccaaactcgcgaagcccttccttccaatccaagccggcgattgtcttgagttgagattgaatgatggattccttttgctcttgcttctccaacttctccttagccttcttaggtctaagatatgtcaaaagtcctcaaaataccattttttcatgtatataccaagtagggtcaaaacatacaccttctcttacgcgaaaaaggacacttttcctggacaggacatgcgcggccgcgcacttttcacagtgttctgccccatatgtgcggtcagtgcgtggccgctcacttgtcgtgcacttttcatcctgttctgatgttaattttaaaaaacttaaaatatgaaatttgtagccctttgaaaagttatgtgtattttactagacagtgcgcagtatgcctgctcgattctttgtttgttcttaattatcatccgttgatccccgaacataatccaagcttaattctttgggattttactcatactttaaagtttcaaatcacttgaattcattccataacatctacatagctcagaatcactattacaaggcataaaacacacaattagtataaaacactagcgattaaaacccaaacttaattgaagtacaataagttggaatgtaataattgactaaaacatgagattatagcctaccatcataaaactatcaattcgtggggctttatcattaggtaaatccttgaggacctaagtgatatcctcactagtgacagactgtataagttccagctgttgtgctctagtgagacaaggtccatcccttacaatgttgatgtcaatacatggtaattctgcagcactagtacctagaagatcttgggaaaaattgacactctttttgcactctgtcaggatctgttagtgtcacacgttggctatcacaaatagtggcaatgttgttcctggtttatcttgctttaagttgtgcatagaagaactttgtattggagtctccttgcattaaccatgtagctctagattttttttctaggtaccctttcacgaatatctgaccatttttccagggttaataagacttctttctcttccttgatgagaagaggattatataggtcagtttctagcttctcttgtacagattgaagcttgccatgtaacttctctattctgtggtccaacttagacacttctctattcatatgtgtcacagcaattttaaggagtttcaacttcttgcatattgcatacacagtgtgaccagatacattttgtctctaaatagactgtgtggttgctgcaggtgcttcatattttagcaggacattgaagagtctgaaaggtcgaggcagtgtatgtttagccacttcagtagatattagaattggggagcatcctagttggtgataatataccacaagggtgttgtatttattgaaccagtatttattaccaaaggcccaatctataaggctgtaaattctatctttaggatcacgcttgttagaccaggaatattggtaccctcttctacagatttgaccaagccctatatcttcaacacaatcctgaaagtcttgcacatctgcctgttgcacaggtgcccccattaattctattattagttgtcaaaattatgttaaagactcctaatactatccaaggttcaatcatggtagtattgatcaacctcgcctgttaccagattttttcactacctgacactgtgttgaaaccatatacaaaggtggtatggcagctaaactgtgaccctttgtccttaacttgacaatggacaatttgggctccagttattaggattttaatctctacaggtgatggcttccagtataaccagatccttccatttggagctgagatgtaatcagttgcaatttctcactcttttcctagattcctctttaccttttcaacccctttaactctaactttagtctctagacatcccattagaaccactttatttgtaagaaggaaggatttaaattccttctgcttgaagggcttgttcagccccctaatgttccatgatccgaaaatcatgggggttctgtactattggagtggatgtccctcccactgtattagtggttacttctggctgaattctaagagcaccaaacctgttttgagtcaatatcctttccataacctcagtttgtgaaggctttcgaagttgatccatctttgctttccctctgtctttagagtggatttgaccctgttcatcctcaattgtagaagaggatggttgatcgacttggttgaccacttttgggatcacagctgttggttcagtctcctttggttgtactggttgctttggtatccattcctgcttcttctgccctttcttcctggtatgcttctgcttctcaataggggcatgatctgcaggtactgtcttgcaagcccctgtctttggccaattcgcaggcagtcttgataatatagaggtcgccattcatactccacagcttgcattctttccccctttttaggaatttaaattgatatctcatcaggtaggggttgggagatatcaatttgaatgagtatcctagcataggacaccctagccccttatgaagttagcttatccgcacatataggttttcccacacagttggccaatcttactagattttctgtcgcccaatattgaattggcaaattaggaaatgtgacccacagagggatgagttgtgctggttcattctccattagaaaatcctagtcccactgcttcaatatcaggggtctgtagttgaacatatagggtccagacatcaggattgcgctcttgtcttcctcattctcaaatcggaagatgaaataaccatcattatgcaaaaacagttgtggagtacagacaaagttccaaactccatagacatatttcaacatctccttaaatgaagggtcacctcctataacatagccaatcaaagccgattaccattttttgctttgttcctctatctctactaagtttaacttagcaactttgactacatcttttaagacagggggaagtaatcaattttcatactcgtttgctgagttctgtttcctttgacgatgtcaatcatggtagatttattagaagtccctttagctgagacattagcttccaattccggtgatacttcttgtgcttgcatcataggggccttttgcagaagaattggagcactctccgttccaatttcctccgttagactttctaattctgatgtcgaaggtttccctttcaaaatcgttggtgcactcccattcctgtcatctattgagtcagctgtagaggtgctagactctatggaataccagattcaggggttatctacctagtcgttgctgcttgcgttttaggtgaggtagggctcgtcgtcattttcattgagtcatctggatggtgcacgttagtaaaccctaactaaatgtgcgctcctacttagtactatacatttactaatatgacttttattaacttgtcaattggcttaatattttgacaataattctcttttaatataacatagatacatattgtcttaccctagaaatattcttatcttttaaatctcattttactaatattatagatttttttaattttgaattttagatataatcaaaatactatcatatttaaatcaaattataattttgaatttttaaaaaatataaacagataagtaatcttactattttgtcataaatttactgatattcttaataattgatatttttgcattattttccataaggaaatggacttttgttttatttccatctataaattcaaaataatatttttatttttaaattcgaaatcaaattattttctatataagaaaatatgtgtagtattttataggtatagactaccatattagaaagaaactactccccaatttgaattgacagttttgtttttcttatgttcattttttattttagaataattttaaaaatccaaatttgttaactcaaagagagtaactaattattagcagcacataatgcataatttaaatttttgaaaatataaattcagaaagaaaactaattattatctaacctaactaactttatcctaaattgtcaagtggcttattgtgaggttgtcgcttgacttaatgtgcaggctttttcctctccttttagtaatacatagtagatttttaattattgctattatgttacctaatatatagtatttcatgttttcatgtgaccttcattaacttttctctttatttaatatcattatccatttatatcctttaatataatataaatcaacatgtaattttttaatatatatataaaattatttaaatttattaatattatttttaagtattatatagtaaaacttctaatattttgatttacttatttataattaattaattaagaaataagttatatgtggctttttctggttatgacatatggctaaactaattattagttaatttgttatccaattgttatttaagatatcctagtaaaactttaatttgtggtcctattatagttgagtgtttttaccataattttaatctaatctcaagttcaaattatccttctcgtctatttctaatattaaatatttttgaatttttaattattgcgattacgttagtatttcatgtttttatgtgaccttcattaaccttcacgtgacctctaagtttctaataaaatcgtatcatccaacactattttgagaaatcttgtatgtcatttttgaaaaaatgatgatactttaacattgcaacttttgcaatttgttcggttcctttaaaaaattttgaatattttatactaatatttattttccaaagataaattaagtatgttcaagcataaatattagacatgtgaaagttgtgcatcttgtagtacgtaaagctctaaaatactatattgcaatctatacatttacaagtacttgtcaggttttatgtcaaacattggacaagtctttgaaatcatggagttggatgtttggtggactaccagaagaccctggatattaagagtttagacgactgtacaacagtcaaaaatgcaaactgatcatacaggcgagtttattgattcacttgtcacattgtacaacagtctaaaatgcaaactgtgacattgttacaagatttgtgtaagagtttattttctagtttctctgctgtggtcctatcccttttcctagctgcctccgtgaaaaaaatgactccgtttactattggctaataggcgatagctgttttttctttgttgcctcagatgatagtatgacatgacctaagtggacactgcgtacttcaaaatcccggtaaaactgagaaatctactattccccttggcaaatctgctattttcttcagcagagcaagccggtttgtcctgatccgttcgtcttcctgcaagatgcatacagaacaattaatatgaagaattagggaggcacagctatacagtatacttgtaccagcactggacaatcacggacaaactacacttttttaagattgagagaggagttatgttaacaaagataagcagatgggtgcatgcaccaagcaaggaagccctcccccaataggatgctgaaaagaataaactaagcaaagcaaagatgatactactctatccaatgcgcttataaaaattggttaatgcttcagaactatttaagtttttcaaatctaagaagtaaaaagaaatcagaggatcttaccaccattacaaagacctcgttgaaaaaatcctccagcggttctataagaactgacgatgcttcaacaaaatcatcaacttccatgtctgtaaatgaacagtcatacatgcacgcttcacttgcaaatatgttggtaaaaactcaatcaactagctaaatgttgaatgtatttacaatgcaatcaatctggataacagacagctatatttgtttgaatatattaggaaatgcaattaatctggaggagaggcaatacctggatgagttttacttcttagtgacaagaaagtgctccacaaagctttttcttcatttgtttcaaaagcttgatcatccacctgaatttacaatgagaatatgttttacttgataagaacgaacaacactaatagtcagccagctaaaatgggagtccaaagctacacatcgtcagatgaccatggagcttgacaatattaacaattgtattaactagtacagcagagcagatcagaaacaaattatttatagttgagccatagagaaaagcttctactgtcctacataacacctcagtaaatgccttttgcataaggaacaccatttcgttacaggtgcaattgacatgcatagttattctatacaggaaaatcaatggaatggcaacagagaatgttgcaaaacttgtataatggagtataatagcaattaaactatacaacgaaatttgttgagcatagaataagattcacctccgcatcgacatttgcatccttcccacgaacaattcttgttggacgagaatatgcttcaacaaccttaggcaaaagctctcctttggacaaggactccatctacgtatgatggcaatgaatatcaattacagtttaaaacatcacaatactcactcattgctccaatcagagccaattgtacactttatattcaacacgaaacgaagacaaagtacatgtttaactgcaatgaaacaatttccaacactcggccacattttgaagaattaaagctcagagctcctgggttatattttatatttcttgtttcttgataaagagtaatactttatatttcaattacacgatattcaaatacagctgaagaggtaactttcactatgagtacatgcaggaaaatttacgaaaagagggttaaaaagaacacatcatcctcccaatttatgtggcattctgatgcgtctttgtccaaggccctggatataaaactactcaagatatcatcttgccaccttacgtagaaatcaatgacttaacacaacatattgaggtccaaattgcacatatgcataaactcttttagataaattaaagaattgataattaaataggagtaattcaaaaaatacacaaaacactattatcatgattagattttcagaataattagtgacagaatcctaatgaacatgttctttttttcaattaatggtacaataggacatgttcaaaattacaaactttgctttgaaagtcgaactatggtgcaattggggagtagtacgaaagagtaagttcatataaaattagaaatccttaattttttcggattgtactattgtagagggcagcccagggggagagtaggggtgtttggaaggagacaacagttgaacatctagtgcagatataacatattgcagatgcatcatgggaacatcaaactcctgaacgttcagatgtatctctaacgcgtccaatttttcaaaaggacactgccctcgagcagttatgtggactacatgaactgagcaataaggagctttgaagagaaagaaaactcattagtgcatttacaaaataatcaaactactattatattttagatgtgctaatgaaatttcaacatgtatgttgaagtgtgtggccatctcatctaaaaacttaaattgttagagagagcacgctttatttacttaattgtctcttcaacaggcgccctcatgtgcaggcttcattcatttttttcattggccaagtacgtggaaattcattttttaaaatggtggtggtgagactcgaacccaggacctctgcctgctttgaaatcatattaaagataggtctaactcattcccaaaagctagctcgtgagtgagaattatccaaggccatataaggagacaaatggcctcccacacccaccgatgtgggactcaacgcctccctcacgcccaggcctgcaaattggagcgtcgacaatataaatgggggcccaacatcggtaacgataaatcgaggttaaaatggagtgggcctaccaatgttgaagtgtgtgatcatgtcatctaaaagcttaagctgttagagagagcatattttatttacttaattgtcttttccacaatgtataacggattgaatggagaagagaagaactccttgcaccttatggatagaggatattctgacttttgttgataaacataaatagaatttttttcaaattgccgtatgtaatagaagaaatgttgcctcttaagatatgaaagaggccaaaagtatcagcaaagcataaaacaaatgagtgcacaataaaaggaaagaaaggtagttaccttgtacaccgatttagttgccaaacaaggttgacttgcacgctcggaaagaacagaccttacgacttcagggcttatacctttgtccatctgtaattgaaacgcagaacatgtcaataaggaaataaggaatggtctttttcacatggataagtaatggaatggaaaggtctcaagactgtcaataaggaaatgatcatactcttcgtcacatggataaatgataaaaaggatcactgaagagatcaaaattatcccatgatgttcaaatactggacaaaaagaaacttagaactagttcacgtgctaagatctggaaccctagaggcaaagctaaatccaactccagataaaacagggacataatagaaggaatactaactgtgaaaagaaaaagaaaagaaaacgagaaaaacaaataacaacagcagaataataggtgttcatgaaaatgagacataccagaaattgctctagtcttcgtgatacaaattgttgtaccttaaatggaaaaaagaaaaagatgtatcttgtcagattatgactcctgactttgtgagaataagcaaaggaccgattgcatcatataaaggacgaaagacttccaatttatcattgaagtttaccaggattaacttagtattactagtatatagcatatttaattttctagcatacaggaccaaatagggctagtgaatttttcctttatttcaacagaaccaagtagggctactgctgcaattctacaaactaataaacgaatagggtgcaatcttacatcattgattgtcctgacatctacttcaatgggctgtattgcagcagcaaggtctaaagcctgtcttaagtctatatttttgttactttcaaccaagagttgcacctgcaataaaacaaacgcaagcattattttacagttctttaaatgaacaaagtttttcaaagattaagacatacaagaccatatgagatccttcgcaggccaaatggatcattacttgagcttggctgacagccagcagcaaataagccaacaaggctatccagcctgcagtagagatagcactatatgagagacgaaataaaaattgggaactgcacagtcaagagaatgagattcagggaaagacatttatcatagtgtcactaggatattaagtgcattggagttaaagcacgtagaagtattgcaatataaaaacaaccttgcatacgatatcagtggtagctaatttctaagaataaccaatttgaggcaagcaggttagtagagtacggactacaaatcagaataagattgcaagtacactacacttttcgatgcatttgcaaatttctccccaaggttaatgcaaaacacgtgcaacatctcaactacgaatcattctacactgatctcaagcaactggaaaaatatttgcaaaaaaagatgtcccatatttgtttagaacgctagaggcaattcatgtgacacgcagtgacatgaaccatacttttcataatcctaatgaccatctagaaaacttaaactgaaaggtgatcaacattagtcatacctgtcagtaatagctaaaacggccccaacttcagtttttgggagcatatctccagaaaatcgtggaagcgagatctcaaacaacgcctctgcaatctgtaaagcacaagacagcgaatcttttaatgtagtcaacgaacatgaaaataacaccaaaacaatgaaataaataacaaaagtttactttattataactgagaaatcccggaaggcaagggatacacagtttggaactcggtggataatgggtccaccctactacccttctccacttaaatatcaggcttttgtctcagtagagttcgacccggtgacgcgcgcctaacccccgcatcacgtgttgccctcttacaactagacgaaagccctaggggctttcacaaaaggctacatttttataatcaaaagagaatcaatgtaacaccaaaataatgaaataaaccacaaaagtgcgaatctacactcttcttaactacgttactcaaactcttcaaaaatgttgttgggtatgtgtcggatcctcaaaatttattgcatttttggaggacccaacacgggtgcggcagcacttttagagagtccgagaaacatagcttcttaatcaaagtgaagaatctacatacaaagttaaacaacaggcaattctttgaaatagtgaacctttgcctcagccaagtatatcattgggacttaattacatgataatgttattaaatagtaattaagcaatctattcaaaaatcactcagcaatattctgcatcaagcctgtaacatgtgatttgacaaagtagaccgcaactctctgtgaaaacaatccatattgcattgcctttgccgcatgaaactgacatcactatgctgttacaagagtgcatacacatgaatgcaaacatattaagccaatggcgaaagacacatctatgtattccccttaatttattttttctagcctgcagatacctggtcctcttctctgtactcgtccatattaaaagaaattcttctcttattcaaaataaaaggatagaacaatgaaccctcaagtattgtcaaaggcgaaaagctctaaaaagcgctataggtctactggggctttaagtgcaaatacaatttaagtgtgcgctttgtacaaaaaaggcacaacgaaggaaaaaagataaaaatatatatgtaattaaagaaaaagtaatgaattcattcataatgttttccttaaaaagaagtacacttatttgccgagtttgtgttatttagactgttcgattcaagatagaacttatgggcagtgaagtgcacgccttagttacttgactacatcgaattgcagcttaagcgaggggaagcaccctccctgagctttcctgagcttcaaggcttaagcacgctttaaatgagcatttgacaacactggaatcttctcagcatatttgctgcaaaacttcctctctttgaaataaacctcttctgatgttgattattgctgctaaaacacgaattaaacattgattccaccggaatttgatctaagtgaaggttaaaatccaagagaaccactcctgttaaaagagaaaaagatcggactaacttcatttcctcagtgctttggaagacactttttttgcagtggtgctaatataacgattaaaccacagaccagacataaggtaatgtacatttagaataaacacatatgtatatgatcaattagcaaatacaattagggatcgtttggtatgaggtataagaaggtataggggtgataaaaatttaataccaccttaatattctatttggttagcaaaccaggtataaattatcccggtgttaattttaacaccaggataacttataccttatagagggtggggtaattagcaccagtataacttataccttattcttagaaattatgcaattggcattcttaatacaacataccaaacagtgaataaacaacaatcccagcataacttataccggcataaggcatattccaaccaaacgaccccttagaagataattaacaacaacaacaacatacccagtattatcccacaccgtggacaattagaagataatcaaaaaccaaaaactaggattaatcgaaaattgaagtctcaacttgccacgaaaatatccataaaaatgtggttctaactacctcctctgaatagccatctctaagtgcatagtggcgccccattgtccctgagagagaggtaaactctgtaacaactgcggttgcaagatctgcattggctaatgaggctgcatcttggatgacttttagtttatcttcgcctattccaagagacaacccaacttcactaaccaaattctgaactcgtgacattttatctaacatagttcctagcttctcctgcatagacaacattatcattttgcaaaaactagatcagcagaaattaagggctaagaaccaacaaatttgcttcaatcactagccagatataccatgtgagactatggtctcataacaaaattgttcaaagcactagtcagatatacgatatgagattatagtttcatatgtatattcatttaataagtgagattcagtaattgcaccaagaaagtgctggtatgtccatcaaaaagactaatttaagatttgatatattatagacaattctacaagacttccttttcacagaataaagaattaaatactaaaccttgtatctatgtttaacaataaataagaattccctgatcagagagaccaacaaaagctgcaattatctaaaaaaaagaaaagtgttaagatggaaatctaagacttacatggaaaagaatccctttcagttgaggacgaaattcagaaaattttctacttgtgtccatctcgtagaaaaattttgcatcttcaaatcgagctctgcacagatgcatatgcagttcatatctttaagcacataccagttatcataaagaaagctgatacaggatcaaagtgaaatcataaaaggtgcaagtatcttatttgagcctgcttcgactcctgcatgtagcacctagatcaaaactttagaatgttcagggaaagagcccaactaaaggatagtaacctcagcacagcttcatttccttttctgactaccttgtcatcaattgatccatttgcaacctgaaagatcaaatccatatcaagttacagacacaaattaacatctcacgttcagctaagcatgccactgttttccacagatacaagatagtaaggatttctcaccgtgatgaagtacggcaacagtttaccgttctcatctgtcatggcgaagtatctttgatgcttctgcatcacctgcaatacgcgaaacacagcttttagataaactgactctaacaggacgaagagctccagaaatgctcaaaaatagccatatgcaatagcaaggaaaatgacaaacacagaatgtcattcttaaaccagtaccctcaatgaccctgcagtcaaggcatgcttgatgacagttactagcacctcaatttactaggtaggggatgataacagatatgcatggaaccatgtaattcttccctgcactgcaaccggtaagcagttatatatgaattaagctattactttttggatagtccgaatgaaagaacgagaagtagggatatgttattattttggtccaagaaaggactgttgagtgttgacacatatagtgtttaatcctaaagaaaagctcttatagtatttcagcctacactagcagaaatattacataatcttcccagaactgtagcatctaaatttctgatcctgagagagagatgggttaaaaagggattgcccttaagtagaatttcgaaattcttattcccatcaccagaggcattagtattttctgctcaaccctaataaaatcacaaaatgacaaaagggacaaaacaatttaaagttccagagagtactcgagtttaccattataagaagctcctttggaagctctaagaaggagtcatcaaattcgccaagtacaggtagtggtgcctcaacaagatttacaacctaagcatccaggaaaatgcttaaatactattcgtctgacgattgaatagaaaaagtctgaaacttcatctgttacctcatcaagcaaatcatttttcattacaatatggccatgtatactttttgctaaatcatttgactgctccataattgtcttcttgcgttgctgatatttgataaaggttgaatatttcgaaaaatcatcaacaagcataggaaatacaaatggaagttcatacaaaacttgaattaccttgacatcaacaagaatcccagcatcctgcattacatttgcataggtttctgcatccaaaatctgtagtattttgttgagagaatccatcagagattttgcttccaaaggtaaaggaagtagtatagtaattctccttagaaagtgaagctatgaatttcaataaaatatttaaaatagagacaaaggaaacaagaacttgaattgaatgattattaaaaacatatataggataaggtgtattgtgggccgggcccatcccgggatcggcccgagaccgcgggccaaacgggctggtctcaaatgggccagtctctaatggtgcataagcccgaagcgggccggtccaacccaaatagcccgtgagtccgggaccgttaagcccgggaccggcaggcgggcctgggccggttcaaccgggcctaacgggccccaatggctatttttaaaatctagccgttggtcttcaatttccaaccgtttgggagtttaaaaatagccgtttggttcctaaaccttgtccgactagatggaattacatgtatgaaagtttagttgttgcatatgaatataagaacccaataagcgcaacatataatgctcgtgtaggtgatggtgatgatgatgatgagcaccttacaaatcaagattggagtaatgttaaaatgcttgtagactttttagaacaatttcatgttgctataaatgaattatctggccaatattatcctactatttctaactgtttagtttatattgcagcacttgtagatttatttactcaattttcagagggtggagtaatttatcaagaagctattaattctatgaaagctaagtttaaaaaatattttttccctatccctctatttttggtgttgctgcattgttaaatcctacaatgaaattaggaggtcctcacttttggtattcaaaaatttataacgctttatcactttcagccgaggaatttgctatacttggagatgcaaaagcctcagttaaaataaatgctcaaacaatttataatgcttatcaacttgtcttagatcatgctaggccaaatgttccaactcctacttcgtctagttcgcaatcatctaaaagaactgcgggcctaaaagccctttgttcttggatggagttcaggggttctcaaggtgataattttggtgatagttcacaactaaatgagcttcaagtttatttgtcgcagggacttgaatcagagaatcccgacggctctttcgatgttttggaatggtggaaggacaaacaaacacactatccggttctttcaaggatggcttgagatattttaagtgttcaagcttcaacagtggcatcggagagcgctttcagtcaggcgagacttcaaatcggtgatcatagagcgtctatgagggagagcttggaaaaatcagtactcttcagagattggatccgttcagaaagaagaaattttggacttgcagaatcacaaccggagatagatgaagcttatgaagaaatactagcggaacttgcgcaggatgctgcttcgcccggaagcggtgatgaacaagcttcttttctaccaccaccaacagaaattcctccggaccttgaaggatttatgagatttgttagagataatacatagactaatatgtaacttgtattttggcatatcttccttagttttttttcctttgaatggtggtattagtaccttgttgtgctcattccattgggggaggaagactaaaatagatattgtcattctttgttaatgtcgtaataataaaaattataagacattcccttgaatatttctttgcaatttattttgtgtttaaatttgatatagtatatatattatatatctaatacatacaaactatatatatatatatctaatacatatatatatatacaaggcactatatatatctctaatacatatatatatatatatatatatatatatatatatacaaggcactatatatatctcaaagtgtaaataaactatatatatatatctaatatatataaactatgtatatatatatatatatacatacatatatataaggcactatatatatctctaatacatataaactataattttatatatatatatatatatatatatatatatatatatatatatatatatatatatatatatatatatatatatatatatatatatatatatatctaatacatataaagtgtgtatatatatatatatacatacatatatataaggcaatatatatatataagctatatattatataaggcaatatataattatatatacacacaatacacccttatatatacatactatacatactatatatatttatatagctatatataagcaatttatattagtatatacatatatagtttacaagaaattgccttagataaaaaaattaaaaaaaaaaaatagcccggaacaaaaaagctcattaggcccgtttaggcccgtgggcccggtccatttagcccgggaccatgtgggcttaggaccactgtgggccggttccacccattgggaccgtgaagaccgggactatttggcccgggaccgccaaagcccggcccatcaaggcccgagaccgtttggctcagcccgtttaggcccaggcccggcccacaatacagccttaatataggagtcttttaggctatgtaagacataataagtaattagtctctacattggtaaatattttttcttgatggtaacataattaacagtgggaaaatctcgctattaagaaaatgtgtcttgggcttaactcaacctcaaaagacaactcatgagataaggatcatccaagaccatctaggatacaacatcacattccctcaaccaatctaggacacttcacccgtcctcccctggacgtccacgagtggacatctagtgcggggacaacataacgtgggagcctaatgttgggtaaaccaagaatagggatgggtttggctctaataccatatgaaaaaatctaaacatccaacccaaaaccttaaggcaacaaatggcgtagtccaaaaccattaaaccccagtggaaactcttacataaccgatgagggacaagtatagaattccctaaccccctcttgcacatgtaactttgttcaaggatttagacatggattaaagacttaacatattgtttctttacttcatcctttttttaaaggagatataataatggaccggatgtatagatagacagagagggttagagagtatcaaaatttcaactgattggaccactaccctggatgtcaaccatgttaaaaagcatatattttttggaaccctagggatccagctgatgggtgagaagccagattcctcactaataaaaagcttgggataatacgccataactatgactagtccatgctcccgtactcacgcctacttgtcctggctaacctgtattataatgtgttttatagagcatttcattcagaattctacgacctcccaaatggaagtgtgacattttcactatcacctcccttcaacaagcatgcctctcaatctcaaattttcatagccactttcccaatagggccttatcataaactttaagatctttcacctcaaggcctcaccatctctttaagaatggtaaccgcctttcaacataccaaaaagaggctttcttgctccatcttctatgaaaataggaatttcattaggagtatttccaaattccaatttacttaaaaagctggcctatacacaatattcaaacactaaagacattctaaaatagtcaaatattgtggaagaaacagaaaagagctgtgacaccgaaccgaccaccagaagagacgagaccagtgaaactatgaaaagaacgaaaaactctgtctaggcaggcggtgtaaggctgactgccgaaggcaaaagctacttatgcctttaacaaaaacgtaacggttctaaccttctcaagaaaaaacacaagatcgtaatggttctaacaccacgtgaaaatagagaaaaaagaaaagagcagttgtattaagttggatatcaacaatgtacaagaaagatttcttttctaataagttatataacttcctaatgttcagacataatatcctatgatatcttataaaatacaacggaatattgtataatagtcgcatactcaaattcaatgactctaggcatattttgcacatataacaatataaattcccttgatattcaatcgtaataagagagaacacatggcagatgcaacaaaaggataaaaatatggtgagaaaggcggaagcgaaatgtctacaattttgttcacagaccttaactgtagctgatggagtattgcgtagaccatgagatacatttccactgtaggaaaataaacaaataagtagtaactagtaagagacaaaccaaacgccataaaaccagtaaaaaactaaaaatgaacactgaccacataaaatcgggaatactactgataaatgcacaaaaatatatgcagtccaagtttttctcgaaaaaatgtgcccccggtgtgtattttgaattaccaagggctgtggcacaaattcaagattttgaatttcattaacaaatctggtgaactccaacaggatgcattctgaagtaatttgaaaaatgaaaatcaaagctaaaattactgcagcctgctgagaatgtaaaattatggtagttgtaaaataaggaaatactggatacatctacactggaagtttcacaggaagaaagaaaaagacaatcaagtgtatcacaaagtcaacttcaagaaagacttccctgcaagtgcgggtgcactgccctaaaatagtcggatattgaaagaaagctgagatcactcactagtttcttctactaaactttcattttcccttcaaataaccacatccaacagagcttttttcattctatttaacattttactgaagtcacttgacaaaaattctcgagactttcttgacagaggacatcaaacagagaattagctgcctttcccccacctgcccccctccctttggtgataggtgagtgcaataggaggagataaatcaatgccaatataatttaggagttgataaattactgaaacctcaaccctcctgttaggcacatttggaataaagtaggaatggaacttcttttgaaccaaaaaaaaaaagtgcaagcaggtgctcaaacttgccttacaactccagcataaatgaatggaagaactacatctccatgaagggccaaaatccaacggatgggtctgctgaatgcaacctacataacaatatctcaatgcacgctatattcatatagaatttatacattcttttatagttatagattttaacaagttaggagctgtgaagaaagaattcaagataaatttatgaatacattttgaagaaatgccaattatagcaattatagcaccagaaaatgaaaaagatttgctcccatggacataacccaagttgattactttgtcgcaatactaaaaaggagaagagagaaagttgaaaggacaccatataatatatacacttaatattcagggttgactgtactttcctttcttttactaatttcaggagggtaattaggactacgaatagttcaagggtgtcaccaataatccgtgccaagtttgggggggtgggggggtgggtgggtaggtattttgccttttgttaggggggaggggggtggtaggtattttgccttttgttaggggggggggggggggtttaggtattttgccttttgttattggaaagagagaaaaaggggggaagaacgggaagcattccaaatgacaaccacgaaaagcagaagttatgtagatttttccagaataatatgttactattgccatatttcaatgccataaaacatataaattagtcttttttcctaacatcaaaaaaatcgtggacaaatagattatgacaaacctctaacttcaattcaaaaagaagaaaggatatgaaaaatcagaaaagaaacatgattggatctctatctacaagaacacacatacgtgctgaaaattggagaaagttcctttaaaagggaaaggacaatgaagaaaacacaccccccacaatccccaaagaaatggaacagaatatcttattagcttaattaggtgtgatattgcatatcaggataaagcaaaacgtctgaacattccaagattgatttttttttccagcaacatatgctatgacagagtaagtattcaagcgatgtaaagagataggtcttcttcatgaataattgcccgctcatgactggaggatttcttttatctggcgtatctcttatttggcctgagcagaattactcctcttcagtatatcctgcttctctatcaaaaaatttcttatgaatgaaaacaaaggcttcttttccttttgacaacaatagggacaagatagctgctaaatgcatttgaaactaactttctggtgaaacctcaatttctcatggtaacagccaaagtgtttctggcattagagtttagttccaacccaactttacatcctaatatctacttgccatctttttcccttgccaccctgcaagcttgataggaaggttaacaagaagacaaattattctggttatagaaaccggtttgccgcataatattccttttttttaaggatcaaacaaggcaataaaacactttataataaaccaactgaaaaagaaaaacacaaatttggtcacgactcacgcatattccaaagacaaagggttagtcaaagtgatagtacatacatccgagttccaacgcatagacttggggaatgatatgctggagattatgacaggtagctcttcagacaaaacctgtcgatagtgactcaaacaatgagatctaagaaaaactaaggaattaaaaataaaaattaaaacatacttgttagtatattataaatttatacagagcaacagaagaactgcacgtagcaacttttaagagattgttcagggacacaataagcatatgcaaaaggctataatttccactggaacggcttaaggttttatgtactattggtgaggatggcataaacgaaactgcaaaaattaacttgaactagtaccaaacagaaaaggttaaatttttcaggtgtcagttaaagatacaaatgaaaagggagaaggtccagatttgcccttccactatgtgaaatggtctaacttaaccctccgttaataggtggggtcaatcatgccctcattataaaattggaacatatttacccttatttgccaactcagcattcggaatcattgaaaatatatttaaaattataaaaataaaaagaaaatagaaaatgaaataagattgggtccttggacgaaagccagcccaagttgaacaaatagctctttgtcaagatttactaccgaattctccaattacagtggtcatttctcttaatctgtcccggaacttgacaaccagtgaccagcaaactgccacaatgtgctacacgtttcttataggtggttccattggtagacccaggtacattgttaagactgatccacccttacaattaagtaatgtgcaaaagctgctcaatgttctctacctctccctctagaataatcgcacatgtattgagatgaactttagatctgaaactacctgaaaccatagcattatgtgcttgaaatgtagtagttgagacacctctgcgtcagaaaacactaacgtatgatgaacaagcatatgatgagatatctatacacttcctacccaccagtcacttcttgagggaacatagtgttgcagcctcttattccagctatttcaaaatggtaattctcagtcctatgacctcgcgttactgcaaatcacttgaagcctcagcataaactataaaaatagtgaacttctttaggagggtgagcttcatcctcggacaaatcaaagtgaaagaagaattttgagtaacagtatatctttggttgcatgcaggatgcttatagacagagaaatgcaggattgacacacaaatagacagagaaagcttcagaagaaaagaagccacaccattttgatggagcttgacgccaatcataaacattaaatgtgcgacagaactattttgcagccaattcgcttacgtggacttgaacaaaggtaatatacacatttccattatcctgttcatacaatcgttatcaaatacagccaaacatcacaaggaatctcaatggttaactctgcaatttgtagcagtagccttggtcacacaccctactaaagttagctagttgctgaaaagggaaattttactttctgatgaaaacatacacaaaacacttattttctcagtgtacctcaaatgcaagccgtgctggctccaccaaacgagcatacacatattctgttttccctgcaatcagagatacacattgaaaacacaaacattgttagcacaaacggtgttacactaacaagtaacatgcaaactattgacacaaaaacactagtatattagcaatgcaacaacaatcttgtaaattaacaagctctgcataagttgattctggctatgtatagtttacacatgagtggcatatttagaaggcctaatcgggatcattaatacgctttagatctatgcaaaattggggagaaaaaaaaagacaaaaaaaaggcgctgcctctttctcggaattgttgtcattttcacctcccaagttaaaggagcaatatttgaccaaaataatgtaatatatcctcattctgaaatggaaaaaagtagcaacttatagtagttttcatgtatttcaaattttatttttataagtgaatgactctttaccgatataagatcgaaaaatccatcaaattagcctcgaggtcaactggagatacatctcctatcaatttttctggtcaataatgataattccaaacttcaagtccatcagcagaaagtgaaaaaagattcaggcaaaataatttagaaaagcattgccaccaatcaaaatggcggattctggttaacacacttaggcactaagatcaagccgacacaagtcatagaatatcaatgaatacattccaagacccaatatttgcttttagtgttgacaaccttcaaataacagatccttttgtcagacattttaacaaatatctgctaagacattgaaaaggtaccataggtttttgaaggtacaagatccttaaccagacactgaaactttgaaataaaaagataaaatggaatagaaaattcagagaaagttatcagattttttagtaattaattttcaggttgacacagataacgaatagcagatcagacgtcacaaaacaaatctaagcagttttccacatttaagcgcaagtattttctatgaatagcatatgatagactaaatgaacaccagaattcacatgaacaaacactgacatcgaaagaatgttcatctgatgtaacgtaccttcagctcgtctatacatggagtctaaagggacattatttctgcgacaaaaaccttcagcagcctgaaagttgtatgagttgataatatcgactatgaattagcaaacacaaactgatcttgcattcatcgaaataagaaacttgattaaagctctgctcaaaattaaatcaaagtctaacaaacaagcaacatatgccaatatagttcttaaggcacattgtaatacggaataaactaaataaaacaataaacaaaattcaattcactccaccttggtaggatttccttccttatcaaaagcttttgaaacaggaggtccacgaacctcaacctcattttccacttgcttaggaaatagttcctcaacgctaacctgcaaatgatctttatcagcatctataaggtgaagagaaaccaatgaatagcgagaattttgaggaactaagttaatgcatggaaaagataaatgctccaaggtcagcacaaagcctatggtgccacttgaaaagacccagaagtgctataaacattgtaattacttttattaacccgattcatttagcaagaaatcagtcaaggcactgctggaaatggatagttaggttcattacatcccttgcataaactataccaaaaaatacgagaaggtcttggatactattttttttataaggtaaattgtattaatcaaaagggagagaactcccgtattcaggaagtatatcaaaaagtagagaatttacatcagaacatgattctctacaaaaggcgcccaatcttttatacaagtaggggctatatgagtgcgcaccaaaaagcgatcaaagataaaagactattcttaagatgtgaaaaaggagactcaatcccctcaaaagctctcctatttctctccccccaaactatccacatgagagctaacggggcgaacctccacgctttttgctttcttcttctacggaaaccgacccagctatataacatctcctttacagcgcttggcatcacccattgaacaccaaaaagattcaggattgccctccacaaagccgaggacacagggcaatgcaacaaaagatgatcaacttcttcccctgagcttttacacatgtagcactaacaagtgtaattcctctctttcgaagattttcaacagtcaagatcattcccctcgccgctagccatgcaaaaaagcacaccttcgtgggcgccttaggaatccagatcgaggagtatggaaaagtggcctcctctctcaccaacatactctggtaaaaggactttacggtaaacaaaccatcaccacgcaaaccccatctccaagaatcacaagatggtcggggcctgtcttgcccatatagcagtatcaacaaatcttggagctccgcaatctcccaatcttgcatgttccttctaaatgagaggtctcatactaccccctccatgctcgttacgaatctgttggacaatcaattccttctggtttgaaactctgaagacgtgagggaaggagaccctcagagtatcctctccacaccacttatgattccaaaagctgattctcctcccatctcccatgccactgaatgcttccaaattcttcatgatgctcctccacatgccacacccgaaaggtgatgtgattgccttggtcctccaaccccctcccgtggaatcatacttttctactatgacctccctctatagggcatgctcttctaccccgaatctccacagtcacttccccaataaagctctattgaataccctaagatcttttactccaagtccaccccacttctttggggaagtgactgtctgccaattcactagatgaaactttctagttccatccgccgcatcccaaagaaaattcctttgaagtcgctccagtttttctgtgatgctcaccggcgcttgcaacagggacaagtaataggtgggcatactcgataaagtgcttttaataagcacttccttaccgccttttgacaaataccgtttctgtcagcctgctaatcttttttcaaccctttcaatcactggattccaaacagtagtatcgcgcccaatgggagacccaggtaagtagaggagagggagcccaccttacatccgagaacataagacaaagcatcaatattagcaacctcacccaccgggaaaatctcacacttgccgaggttgattttgagtcctgatactatctgaaaccactggaggacctgcttcaggtaagtcaactgatccatatgggcatcatagaaaatcagggtgtcctgatactatcttggacactattgattatcagattaccgagactccataattaacccagtgaatcatgacaaaatggattaactaggagacagtaagagcatggaccggcaatatgttcgaaacatacacaaggcacagagcaaggaaagcgacactgagtcaactccaagttggactaaatgaacgtcgcaaagaccggccatcggcaacgtcttccaactatggaaggtgcaggaggccctctaagaagggaaaattgaagtggtgatgaggagaaaaagataaagaggatgacgatgatcacgatgataaggatgtaattgtgtggacctcaggaatcacagtgttggatgaggtggaatacatagacatgaaggaacttcgagatgatgctcacgtaaagatagaaactaagggaggaaagaatgaaagtccagttgtgtgagttcacggattttcctatccagacattctattttcaaaaaaaaggagcttatgtttgtaatttctgaaacttgtcttactctttaaaagacattagacgttccataaaaacagatccggaagaaactggctttgtactattttaagaactcttgtaaagttttatgggatgagttccaacttaactcaaaactcaacttaggaagtggaacactcatcaaggtttggaaagacaagtggctgggaacaatggcactaaaagatgaatttccaaatttgtacctactagcagtagatcaagaatccactgtagaacaatgttcgcagaacagctcttggtaccctcaattcaggagagattttcaagattgggagataaatgacctaatggaataactggccaaactagcacagattactgtcaaaccccagctgaaggacaaactggaatggggggacgggaaatttacaatgaagaaagtatatgcacacctatgctccaacaatgatctgataaacaattggccatggaaactaatttggagaacaaaactgcctcctaaagtgatttgtttcagttgggttgccttaaatgaagcatgcctcactcaagacaatctcagcagaaggagtataccaatggtgaataggtgctacatgtgcaatttggattctgaaagtgttagacatctctttttgcactgtcctttagcatgtgatatttggaacatgttcctctctatttttggactagcctgggtcaagcctaacagcatcaaggaagcatatgaatgttggtgctcatggagagttggtaaatccatcaaaaaaaattgggtaatggtacctgctgctatcttttggtgcatctggaaggaaaggaaccgtagatgttttgatgggatctcaactctgatccatgtagtcaaagcaaaatgcttattgaatttgtttagttggctaaatcaggcacctgtaactagttctgttcaattttttgattgtgtctgatccttagtgatagaatagtttttttgtgtatatgagcagacaccatctctctcaattgtaatcttttgcctgcatccgctggatgcttttaatgaaatctccttacttcatcaaaaaaaaactattttaagaactcttgtagcattaatacaagatttgatattggctttattcttattgagcaactcatgtaacatataaccgctttggcaaaggtttcaacaagaagttgcatgtattggagctcggctcaatcttttccttttttaagttacatggatctgagaacaatcaaaaaagtttattgagaatgctagataaaatgttcaaagataatgcactccttttcctactacctcctttctcgtagacatttcgtacagcttttcaaagcaaaccagactaacagaatatgtaaaggggaccaaccataatgagacaaatcctaccactaatcttcgtggggtgccatgcgtttgtacttccccatgaggcaacctttgtttgtccagtaactgaacaaccagatccttgagctgcaatgaccagcacaaaaaaacagatttaacagagcagtaatacgaccaactaagcggaattgcttgagaactcacaccggatgacatcaaaacaaattaaggcaagaaaatgtagccctggtttctcttttcccacttcccttaccatatttacaatataaacttcagtaatagagatttgcaagtagtaaaaatgaaaatcacatgaaaaagaagatatatacttgcttgcatgcactcgatacatcatttggaggcaactcctcagtcccaatttcaagaacaagcaaccgcggctctgaaggcacctgtatggccggaaaagggtgtgcaagcaaatttacataatcctttagaaacatgtataggttacaaagagaatgtgaaagaaaatctggcaagttatgaaagtcaatgttccataaatatattctggatcacatcaagaaaccataaaaaaatatgcacacaagtactcagtcccaactcgggtaaattaagagaaagtggagatgtttatcctattgagcaaagaaccaaatgggaaaatgagaaggaaaaggaaaagctaaatagacccaatagaaaaggatgaccagtatagttcctgaggattaaccaaagaatatagaaataaaagaaacgggatgaagctgcaactcttttggcagatacacagcaatttatgggcccaaatgatttacgctaactagggaaaggatgagacgggccaaaagaacaagagaaaagaaaagagtacaaagcaaggaatatcagcttctttgcattgttttgttagctagaaacatcagaaaggaaagagattttttatttattttcttattgaactaaaattgtggggcaaaaaaaagggctttctctattatataaacgaagcaatagaaagcaaatttttaacatatccttgctttctaatttccaagcgaagcctaaagccaaaaaacatacctttcgtgctgcctcctccaagacttctctttgaacaagaagatgatcacactgagaaacaacacccagtggatggtcaagagactcccttgtcttcaaccaaaggtgtgcgcattgacgggctaaactgcacagtggaggtaaaaatcaggcaaaaaaagtgtcatttgaaaacttccaatctttttagagtaaagtaatttggcaccgtagttctgatctctttgtaataaagatttactccctccatttctttttacatggcggtgtttgactggacacggaatttaagaaataaagaaagacttttgacacacaccaaaagtaccactagaacttgtggtcttaaatatgtgacatttttgtggttataagaacatgtaattaaatgtaaaaaggaagtttagaagttaaagcttttccagacattaaaagatgaccttagaacagactaaaaaaagtgctataaaaatggaacatagggaatatatattaagcacgatactagaaattggaacttgcgtgagcaaatttttagatgtgactgaaaaggtaagctgctcgatcatcatgccaaaccttaagaaaaacctacaaactctccaacaagatcagtaattaaaagaagtgataaaaatgtctacctacgcatacgcccaaaataacgagcacgttctgtcaccccaacaaagcctctcgaatctaaaacattgaaagcatgagaagttttcaaaagctgatcatacctagcacagtgagggaatattgttattcaatgtagaagttaacacatgaagaaaaaacacaaattcttcttctctctattccgtgaaaaataataaaattattaagatataagtacatacgcaggtattgcaaggcctaaatcaagcaaacggcgagcttctgcttcaaagagatcaaaatgtttttgtatatggtcaacactagcatgctccagataatacgcactcatttccttcctgaaacagaagcaccaattagaatctcttttctaaaaatgacagatttatcacgcacacatactccaaattttattatcgcatagtaaaccacataaaaaaacccttgagatacagataattcagagttccaaattaaatcggaaataacaaaatcttggcaaaatagtctagacattgcctcaatcatatgctattcttagagcatttatttgaaattacattcgtcccaaaggaatcaccatgctcgacttcgcaaggttaatgttgaagatataattaagcaaataaaaagtgctctctccaatagtttaagcttttagatgagataatcccactccaacatggtatctgaacttgcagatgtcttaagttcaattcaaatattaatggactaaacagaaaaggtaaatatttcatttgaaacaaagagaacagttttatatgcttttccagtagaccactacaaaatactaatctagataatagtctaatacaaatcagtttgaaaatttcatgaccaatccgcaatttcaaaaagaaacccatgctctagtgctagtgtctatatctgacatgttgatacacttaggttgccagtaaatatgcctagtccaatttacattcctcctctgtaactagtgctttttttcagacatcataaatgcaaggttcctttacttgtacagttagaacttgggaaagcaacatttatgctcaacaaaaagaaaatgaagtagatattgttcaaatattgaagatagttagagcctaaagaaagaccagataataacagttctgaaagagcaaaagaaaattaatgagaagcaacatgatctatccaaatagtaaggcagtcaatacgcagaaaaaagaaaacgttttggctggagtaggttttttactcattttccagaaaaagctctccatatgtaatgccatctgcatactgaatctttttaaaatgatcaacaccctgcagacaagtaataatgggtcataacaagcaaaatattggagaaccagaagagaaatgcttagttagtttatgctcttcattttctaagatgccggcagtaatgacctcctacatgaagatttttctgctagctaagagacatagtaaatgtagctatcatgctggaggctctggtgcaaaaatagatagataaggcctttttctcctatggtgggagaagaggatgcagaatgtatacaatgagcctcatcatatgtttgaagaagaaaaaggaaagaaagaaatcataagaggagaaagaacaagcctgaaagtgatctcaacaggcaaaattaacctgaagtgacataaggatacgttcaagcccataagtgatttcaaccgatactggcatcaactgtatacttcccgcctggaaaataaaagttaaataactgtatgcgctcaaaaatagaaaaagaacagaatagaaaagcagaaggacaagttcttataagtcattagtagccaaaagcaaatgaaaaatttgagacttgttcttgttgggaaaaaaaggactctaaaactgcagtacactttttgtcagaagagagagaataacctgctggaagtaggtgaattgtgtgatttccatcccatccatccacacctcccagcccaatccccaggcaccaagcacctactagtagttcaagtcaacagaacatttaacaatacagctttgtttcatgcagcaaaagacatcattaatgcaatccaaacaaaaagttggaaatttgcctgaacaaggaaataagtacaaaggaaatgaagtacaaaggagatgcactgttcatgaaacattatatgtgcatatataggaaagttaatcaagagaaagaataatcttacagggctctcccagttgtcctcaacaaagcgaatatcatgtgcattgacatcaatacctgtcaacacaacaaagtaaaatctcaagccagaacggtatctagagctactataaaatatatatatacacgcacacacacaaccgtgaaacttgcacgaatccaccaagtagaaggagaaataacaaaccgtaaagggtatccctatttggttaagtatggttgaatctaagcataaagtcacacaattcttagttatataaaaataagaacaagaaaaggagaaaaagactaatccatttattcaactaacatagaactttaaaaccttctaaactgctcttcagaagaatcccatttaccatttaagccacttaaacagactcaaaaaaaaaaaaaatcatacacttttagttgaagcttagaaggtaagtaaatggctgactatatagagccagtgtgataaatttctctatcctgtcttccttgtatataccaggcttgaattccaggatcgaagtgaaatgtttaagcattttctaggttagcaataacttgtatcgggaaatttgtaaaataaaagaggatatgaaataaatagtcaataggtgccagatgattcgacatgggagaagatgtctaggaagtcaaacttataacacattcagcacaatctcctcctataaagtggacaccacgaatctaccaggtcttgttcttgatgacaaatcctcaccttgctcatgtaaatctagccccttctagaggaactccaagaactcctcaattgccctagacatgttctgcaccctcattttcttccgggatcttatggtacctaaaactccctccccaacacccactgaatacccaaacctgccgttattgtggacatctcttccctatatttgtccatacaatccttcaaatctctgctcctccctattgccctgatttctaatatgagctgcaagtaaaaattctcctttcctcacctccaatttccacatgtcccacacaaatcctccaccttcttaaagaactcccaagtaccgtctgccctctcaaagtcttcagctatcttaggggcattttggatatctctaagaacccaagtaatatcaataacaatgaagtcttcaactgcctcgggttcaacacagactagctagtcacagcctagctagtcttcaactgcccctacccattctccgtcctcttgaagacttttgaaacttgctcttcatttgcggactgaaatgggaatgtggcatcacccaacggcgacaccttcaaatcaaagctacgccacaaggcttttcctcaattcccttttaacatattgttggatatcccacgttggtgaagtgttggtccttcggtctccttatatggtcttgggcaatcctcacctcttgagctagcttctggggttgagttaggcctaaaagccatttctttatcatggtatcagagccgggttcatccacttgtttcacctgatgttgggcccccatcttatgttttctacgctgcagtttcctgggcgtgcaagggggtgttggatatcccacattggtgaagtgttggtcctttgatctccttatatgaccttgggcattcctcacctcttgatctagcttctggggttgagttaggcctaaaagccatttctttatcacatatcaaggcctccaatatgaagcaaagtatgttctcttttatgtgaataatgaatagaaaaaaactctagtttcgttggcctattcaagcaaggatgctcaatcacctatatggcacatgtttccttcagttcatccttgcaattcttcctaatcacattttccagcaacaggttctttgcctcaaccttatattatattttaatcctacttcgaactctaaatttgtgctctatttctaaaaaatggttgccacacatgccttttaccaagcagatcagagacatatccaaattcagtgaccacggcattctagccacaccacaaaatcaaaaaattagaagaataaaaaagaaatcatggaataactcctccattcctccaatgcttcaaggcttaaacatgggatagtttgcaagtctttgttattggtaagccttacagtcttatcacttaccataagtatcaaattgacttatcccagaaataacatcaacttgaagttgtttttaccacataaattagtccaaaagacataatgtaggaaaaagaaaaagaaagtagatataggttgcaaaacctaaagctgacaagctacggatgaacaagtcctgcgaatttcctggatcaggcttcaaaatcacctgcattgcagttcaaacaggaaaggcatctggagtagtcaaaagtacaataaaatcatacaatagtactaaacaatcaactgtgattcaaaatgttagacaataaattgaaggcaaactaacctgaaattgagtatgcctttgaagcctatttggattttccccataccgactatcgtctggacgaatactaggctccacatacctgccatcagacacagttacaattgatagccatacaagaaaacaaagtaatgtcttcgcttcattgctaatatgacatcattcttcttgctcattatcaagattatgagaaccagaaaagagaaaatgaagcacaaagaactagatagtgaatcagttacaacaggcacttccacaggcacacctcaacaaaataagacttatccattctctgtgccgaatttattttcatctagttagaatgacaaaaattccaattcttctgagaggtgggaaaagcatgataagaaaaccatctgaaattagcaagaaaagaaatgagctctgcatcccaaagctcctgtccgattttataggggactcaatatctccagattctaacagttaccatgtccttcaacttaatttttctgcataaatgatttattgtgtgcagaacttttggttcaggatagagaacatgacatgtattcgtctttttagattaagaagatcatctccaaatatcagaagccctaatatttaagtcagcgtgtagcccatgttcaatcaatatttactgactcgtgacatgaacagcattattttagcttaaatagagctagatcaccacggaagatgcccccccccccctactttgctttaggtggcaggagagagtaatgacctaataaaactttgatttcttttaccttacaaaggaggaacaaaagagaatcttactaaagagtggcaccaggcaatgccaacccaggagcaacaagagaacttattgatgccataggtcccccgtttcttcatgggaggacaagtaacaatgactaatatgttactttgcattaaagagactatctaagatgtgcacgacttccctacgcatttactctcttcttctaaagaattctggtcaaatatgagaatgataattgtattcaagaactttagagatgaaattatcaaaaaatcttacgcaacattccatggttctggtccaagaacccttaagtatgttagaggattcatagtcccagcgccaacctggtcaatgcaatttaaacttaaacaagttagtaaagtagatgcaaaaaactctaaagattgtaagttcaatttaaacacttaaagatctaataaccactaaaagcccattcatgttatggctgtacaaagcactatcatcaccaaccatatgtaagtgcaatacatatctaatccagattaagtgcgatacacattacatataaacatgcagtcccaaagtacggaaggagaatatgctcagcatttcctttcagttttttttcggtaattaaaattatcattaatcaccaaagaacagcattacaaagcacagcttagctactcccagctagctagatctcaaagaagatacacggaagactatatctaccaagatgcatttcctttatgttgttatcatagaaaagttacacactacctatcccaaaaaaaaaaaagtatgcaaggaagataatacttagttcttgcaacttgcaaatcaccatttacgactttgataagatatcaagtttcattaaaaagaaaagcatcaattccagcagaaaagcaagttcatttttttcctgttatgtgctagagtatattttttgagccctaaaaaaggatgataatcatacctcagtgttgctgcattgcatcacggcacatcctacagaaccccaatactcctaccatgttaaaaagacaggttaatccataaataattttaaaacagatatgaagtgtatctacaccgagtggcaaggttaaaaagattaaggaggggaagttgcttgaattcattagccatctacagaattgaactttctattatgaataaaagttttaccttatcaaaataaaaataaaaattgaatggcttattgaaaaaaatgttgttgtttttttttttgcatagcttcttgcttgtggtaggattaatgctaagacttaaaacttgttgacttggtacaatcttgaaatactaaagatcaattttttagcaacaaataaactttgtccaagaaaaatgaatgaagcttctctacattagttattcaatgtatattttgctcaagaaaggaaattgtaacacaattacacaaccccattaagtagaaaaatacctggagcctttgaatggcttgttggaaagttggaacagatggtttcttttgatgttctgtattgtgagacacagaagaagtagaagaagaagaagtggagagtgcagagacagtggaagatttagagagaaaacgcctgtgaaaaatgataggaagaggcttagtggtggttaggagaaaggagaagtgagtcttgtgaggtttgagaatggaagtgactaatgggagtgcaagaatcgccattgcgaaacctcacaagtttctgctttctgaattctgggtggggtttatcctagactagagtggcgataaagagattacagaaagcaggacattttcattccattcctataaatacacaaattagcaatcacttacccttatggactcggggaagggttgagattagttatagaatgtttggccaagcatctggataggccaaaattttattttattttaaaaagcacttcttttttttcttaacttaagttatttggtcaaattttttttagggaaaaatacttttggaaagaagcagaagctctttatgagaagcaaaaaaaggtagctttttctcaaaagcagaactagttttgacttttctttttatcaaaaatatccttaacaaaatttagtatataccaaaataaccgttaaatctaatacttaggatataactaaggacgatgatggaaactatcccagaaaggtgagcaagaagagtcttcacttctcctactccactactttcctcattcaaggcgtgattaatgcgccttaaacctctctcttaaaaaagagcattttttagtagagccttagcacgtgaacccataggaacagggcccttcttctttacaacctaggtattcaaaaggagggttattacataaaaaaatcacataagtgattagagcgatgcccccttgctttggaaagagttgacttcttcctctaatatatagcaactttaggggtgaatgtttttatatttgttgaatatttttaatatatttaacttatattaaaagaattaagtaatttttaattttattgtcatattttacttaaataaaatgaaaacatttaattattgcatgtaataacaaatttttgagattatttatttacttataatattaactattaagtaaatctattcatatctttattcgtaatttgatacttaaaagcactttcttaaaagcttggtcaaacacaaattattgctcaaaatttttttccatagtaattagccaaacacaaaattcttctctcaaaaagtacttttttcaaaagcacttttaaaaaagtacttttttcaaaagcacttttaaaaaaaatacttctcaaaataagttgatttctccaccttggccaaacaggctattaatgttaagcaatcactttccctttgggactcggagaagtttaaaatttgagttaagttaaatgttaggaatttttacatcatatagcaaaggttgataccttatttattttaaataaataccgttttaaaaaattatattccatagctaccttttgatttttatagccaaatatctatttatggtcacctcatactcttaagccataaaatacaccttgtattatttttctctctcattctttcagatttttctccaccctatctctcttaactccggtctttctccatgaatacaaccacaattctcccaaatacagatcgaaacgggcagctttgactctcaatctggaatacattcagggtgtaaaacgtgatcacactttgggatcaaatgcagcatttcgtcatcttcaaactcgttcaaacatacagtgcattcttgttacgacccgcaatattacgtcgatattacgtcccgcagtattatattacgatgatgttacgtcctgcaatattatagtacgatgatgccacgccttgcagtattacattacgatgatgttacgcttcgcagtattaaattacgacgatgttgcaccctgtagtattgtacgttgaaggattatgatatttcacaagtgatgagtaaattcgtgaagataaaaggggaagcaagtcaaaaaataaattttcgttcaagtttggcatgttgggataaaatacgggctgagcgttaatacccgatatttatggactagtaccatacaaggtagcatatgaccatgatcgtatgatgtataaaatatattaaaaatgagtaatattttaagtaattttgagataattcttaattatgtgggtaattggttaattatctgtaactacccggccggtcattttaggaattaacgccctgatcacctattaactactttccccgtatttgtttctgctatttggacttgtcgggatgtttggttttgagtttcggagagttttgggacacttagtccctaaatgagggtttaagttctagaaattggaccgtagtcggagcagtgtgaagacggcctcataatggaattatgttggttccgttagctccgttgagtgatttggggcttaggggtgtgatcagattgtgttttggaggtccgtagctaatttaggcttgaaataccgaaagttgaatttttgaagtttccggttcgaaagtgagattttgatccgagtgtcggaatggaattccggaagttggactagctcagtagtatcgaatgtgacgtgtgtgcaaaatttcaggttcattcagaaaaggtttgatatttgatcgaaagcataatttatgagtttttgaagttcttaggcttgaatccgatgttaaattggtgttttgatgttgttttgagcgttccaaaagttggaacaagtttgaatgttgttctaggattggttggcatatttagttgaggtcccaggggccttggatgagtttcgggtgcttaacggaaattgaattagacttagaaagaatttgaattgatgaacctgtcataaccgcacctgcgtgtgtgggaccacaggtgcagcaccgcaaaagcaagtttgggccaaagatccaggaccgcaggtgcggctgggtttcgcaaatgcggtgccgcagataggggtgtgcattcgaaccggtttatcgataatcgaatcgattatttgttatcggtttatcgatttatcgattttgattttgaaatttctcttatcgagttatcgatttcgatttcgattttgtcctcttcggttatcggtttatcgataaaccgataagatatactaaaaagacaaaaagacaaaaaaaattatccttattctataataccctttcctttaccctaaatgcctaactctattatttctactaccacatttaaggaatgatcatatttaaagctcaagggaatgaagttcaaactaatggaaaacagaattagctgtgatgatgtattttgttttgttttttataccgttggagtgttggtggcatacatttgatctcttactttagtttcgttgcatgtgcttgttgacacaatttttatattatcaatggtgtttgtcttattttagcttctttttgtccatattagttaggcgtgtttatagcgatatactttccgtggaattccgtaaattttcttattggtgtaatcgataaccgaatcgataagccgcaaaaatcgataaatcaaaaccttatttaaacgataatgataagcatatgtacaaatcgataatcgataaataattattgataagggtcaaaatcgaaacgataaatcgaatgcacacccctagccgcagatgcggccaagcgaccacagaagcggacccagtccgttaagtgattttcgcacatgcaatgccttcttgcgcaagtatgggaccacaggtgcgctcccttgaccgcagatgcggtaatcgctgggcagaaatataaaatttcgagggtttcgttcaaaacttggaaaaatcaaattggagctcgggagagggcgattttgggaggaatttgaagaggaaatcattgggtaataattccttaatcctttctagttgtattccattaatctattgttagttttgtcatttaatttcggattggaggtgaaaattggggggaaattgaaagagagttcttagacctcaaattcgaattttgattgagaatttgaccttggatttggataatttgggtatgcatgaactcataagagtatgaggattctgaaaatataaattttacccgattctgagatgtaggcccgaggggcgttttggtcattttacctaatttcgcgtattagcttagaatttatttgtagaattagttacttgaagtgttatttatattatgcaattaaattgaatagattcgggtcatttggagtcgagtactcgtggtaagagcgtggtttcaggttgaatttgagctgtctcgaggtaattggcttgcctaaccttgtgtgggggacattacccttaggatttggtgatgtggtaattgaaatgccttgtacgtgaggtgacgagtgcgtacttgtgctaattgttgaaaaatatgttcttactaaagtagctttaattgtatttttcctttcctacgtactctacttgaaatttatgcctgctgttagcttagaaaagcatgcttaatcgacttaattcttttattaactaccttagttgtattatgtgaagcatgataggttagaattacctgttttatttggtatgaaattgagcttagttgagtattctttgtattgttgctgtgtgttttactttgggactacgagacgacatcccgggagatcccctgcacgtatttataatttgagctgaggtgcgggataccgagatatctctagcacatatattgaggataccaagagatcctagggataccaagagatccctagcatatattgaggataccaagagatccctaacttgtattgaggataccgagagatcctcgggatatcaagagatccttggcatatatttagggtactaagagatcctcgggataccgagagatccctggttattatccttgtgaagagcgatatttccttgtgattgtttttgtctcagttctagttattgtattccttattatcatgtattaaattcttactattagctttcaactgtactgcttatcttattctgtcataccttatattttatttaatctcagtagggccctgactttcctcgtcactacccgaccgagattaggcttggcacttgcagagtaccactatggtgtactcatgccttttctgtgcatatttttcatgtgcagatccaggtacctccactcagacttatcatgcttgagacgaggcattcgtagagactccgaggtatatctacagcgtccgcagacctaagagtccctttctactctcccttttgtattagcccttctgtactttgtgtctttgttagatcttctggagttagatgtttgtagactttcaaaggtttgtgatcatgagattccgggttttgggaaaagttattagctttcgagagttgatattgtatatgccaagtggtactttaaaatactgtttcatttcactacttcgggttttaattttttcttacgcaaattggtttatttcccgcattgttaggcttacctagtcgtagagactaggtgtcgtcacgatggttcacgtagggcgaacctgggtcgtgacaaattggtattagagctctaggttcataggagtcatgaatcataagccggtttattagagtctcgcagatcggtacagagacgtctgtacttatctgtgagaggctatgtaactgttaggaaaaatttccatttcatttgatttccttgtcatgcgagattttgatatcacaaatctaaacttctatcttctattctctcacagatggtgaggacgcgtgctacccgagatgatcatgtacccgcgccccctacgacagtcatcagaggctagggccggggtagaggccgaggacgcgcacgtggtgcagccagagcacctgcacgagctgccgccgaggtaccaccagtagttccagccagagtccaggcacctgatacgcctaccgctactactactccagcacttcaggagactctagcacagttcatgagcatgtacaccactttggctcaggcagggttacttccccttgttgcagctacatcctaggccgggggaggaacacagactcccgccgcccgcactcctgagcagcgagtgcatatggatcaggttcgagagattattccagtatcgcctgcagccccaggtcagcctgaggacagggcagcggttttagaggatgagcagcggaggcttcagaggttaaggaagtatgatcctcctgtatttagtgggttagcttcatatgacgccctgggatttctggaggagtgtcactgtatcctccacactatgggtatatcaagatcgagcggggtttctttcactgccttccagcttcgaggagccgcctatgagtggtggcgcacctatgagttagacagtccggatgaggcagcttcactaacttggactcggttttcagatatgttcctgaaagagtttgttcctcagagcctcagggatgcatgtcacgcagaatttgagtatttgcgccagggtgttatgaatgtcttggagtatgctgtccattataccagtttggctagacatgccccagccttggtttctactgttcgcgagagggttcgctggtttattgaggggcttattcccaacatcaagtctagcatggctcgtgagttggaaatagatatttcttatcagcaggtggtgagcattgctaggaggattgagggtatgcatgctagggaaagagagaggagagggaggccaagaggtctcgagagttgagctattattctggtgcccgtgccccagctacaggtcgtcatggtaggggttatatgagtcgccatgttcattcatctcttccagcagccagtggtattccagctcctcctaggcctcaagagccttattatgcaccttgagtttctagcgtgcttcctgcgggagtgctttcagaggtcagtctagcagacctggatcaagctagtcacagccgtcacgtcctcccagagcttgttttgagtgtggtgacacactccatgtggtgagggattgccctagacttgggaggagtgcgcctccacaaacttctcagccacagcgtaccccgtagagtactcaagctatggttacagcttcagttgctaccccacctgctcagctagctagaggtggaggtcggggaggtagaggtcgtcctagagggggagaccaagcccaatactatgaccttcctgcccataccgaggttgttgcctctgattctgtcatcacaagtatcgtactggtttgtcacaaagatgcatcggttctattagatccgggctccacttattcttatatgtcttcttattttgctccacatttgggtatacctcgggattctttgagttcccctatttatgtttctacccctgtgggagattctcttattgtggaccacatttatcagtcgtgtttggttgctcttagtggtttgagaccagagtcgatttattgttactcagcatggttgattttaatattatcttgggcatggactggttgtcaccccactatgttattcttgattgtcatgccaaaaccgtaatgctggctatgctaggtgtatcgcgtgtggagtggaggggtgatttagatcacactctcagtagagttatttctttccttaaggctcaacgtacggttgaggaaggggtgtggcgcgtatctagcttatgtgagagatgtcagtattgataccacttccgttgattcagtactagtagtatgggatttttttgatgtgtttccatctgaccttttgggcatgccgcccgatagagatattaattttggcattgatttgttgttgggcactcagaccatttctattcctccatatcgtatggctcctcctgagttgaaaaagttgaaggatcagttacaggaattgcttgataagggttttattcatcccaatgtatcaccttggggtgctcatgtcttttttgtgaagaaaaaggatggttctatgcgtatgtgcattgattatcgccagttgaacaaagttacggcgaagaaccgttatcctttgtctcgtattgacgatttgtttgaccagcttcagggcgcacaagtgttttctaaggttgacttgcgctcaggttaccatcagttgaagattcgggagccagatatcccgaagactactttcaggacttggtatggtcattacgagttccttgttatgccttttgggctgaccaatgccccaacaaactttatgcatttgatgcacagtgcgttccgaccatatcttgattcattcatcattgtctttattgatgatatccttgtatactcccggagtcgggaagatcatgagcaacacctaaggacaatgcttcagacattgagggaaaagaagttatatgcaaagttctcaaaatgtgagttttggttggattctgtggctttcgtgggtcacatagtatcgagtgagggtatacaggtggatccgaagaaagtggaagcagtgcagaattggcccagaccatcctcagcgatagagatccgtagttttcttggcttggcaggctattaccgttgatttgttgaggggttttcatctattgcagcacctatgaccaggctgacccaaaagagtgctccattttagtggacgaaagagtgtaaggcaagttttcagaagctcaagacagctttgactatagccccagttttgatattgcctataggttcagggtcttatactttttattgtgatgcctcgaggattggccttggagcggtattgatgcaggacggtagggtgattgcttacgcgcccaggtagttgaaggtacatgagaagaattatcatgtccatgatctcgagttagctgccattgttcacgccttgatgatctggcgtcattatttgtacggtgttccttgtgagatttatactaatcattggagcttgcagcacctgttcaatcaagaggatctaaatttgtgccagagaaggtggatagagttgctgaaggactatgatatcattattttgtatcaaccgggcaagaccaatgtggtggctgatgctttgagtcgtcgggaagagagtttgaagagtttagcttatttaccagcattggagaggcccatggcgatggatgttcaggccttagccaaccagtttgtgagattggatctttcagagcccagtcaggttctagcttgcgtggtttctcggtcttccttatttgatcgtatcagggagagtcagtatgatgactctcatttgcttgtcctcaaggacaaggttcagcatggttatgctagagatgtgactattggtgatgactgggtattgaggatactgggtcagatttgtgtacccaaaattgatgggattcgggagttgattctagaggaggcacatagttcatggtattccattcatccgagtgtcgcgaagatgtatcaggatttgaggcaacactattggtgtaggcagatgatgaaagatatagttggatttgtagctcgatgcctcaattgtcagcaagtgaagtatgagcaccagagaccgggagggttgcttcagcagatagagatttcggagtggaagtgggagaaaatcaccatggacttcgtagttggactcccacggactttgaagaagttcgactccatttgggtgattatggatcagctgaccaggtctgcgcatttcattactatgtgtactacttattcttaaaagcggttggcagatatttatatccgggagattgttcgtctgcatggtattctagtttccatcatttcggatagaggtactcagttcacatcacggttttagagggccgttcagcatgagttgggtactcgggtggagttgagtacaacatttcaccctcaaacggatggacagtccgagtgcactactcagattcttgaggatatgctctgtgcgtgtgtgattgagtttggagggtcatgggatcagttcttgccattggcagagttttcctacaacgacaactatcagtccaacattcagatggcgccgtataaggctttatatggtaggcggtgtagatccctggtgggttggtttgagccgggtgaggccagattattgggcacagacttggttcaggatactttggagaaggttaaggtgattcaggatagacttcgtacaacccagtccagatagaagagttacgcgaaccggaaggttcgtgatgtttcctatatggttggagagcgggttctgcttcgggtttcgcctatgaagagcgttatgagatttgggaagaaagggaagttgagtccgaggtttattggtcctttcgagatattgagacgtgttggggaggttgcttatgagcttgccttacctcctagcttggcaggggttcatccggtatttcatattttgattctccgtaagtatcacggtgacccgtcgcacgtgttagatttcagttcagtccagttggacaaagatctatcttatgtcgaggagctagtagcgatattggacaggcaggttcgaaagctgaggtcaaagaacattgcgtcagtaaaggttcagtggtgggtcagccggttgaggaggcgacctgggagaccgagcaggatatgcgcagccattaccctcattttttcactacttcaagtatgtctctacgctcgttcgaggacgaacgaatgtttaagtatgggaggatgtgatgacctggccggtcgttttaagaattaataccctgatcccttattaactgctttccccatatttgtttctgctattttgacttgccgggatgtttggttttgagtttcggagagttttgggacacttagtccctaaatgagagtttaagttctaaaaattggacagtagtcggagcaagtgtgaagacggcctcgaaatggaattttgttggttctgttagctccattgagtgatttcgagcttaggggcatgatcggattgtgttttggaggtccgtagctaatttaggcttgaaatgccgaaagttgaatttttgaagttttcggttcgatagtgagattttgatccgagggtcgaaatggaatgccggaagttggagtagctctgtagtgtcaaatgtgacgtgtgtgcaaaattttaggtcattcggacgaggtttgatagactttttgatcgaaggcgtaatttgtgagttttcgaagttcttaggcttgaatccgatgttacattggtgttttgatgtttttttgagagttccgaaggttggaacaagtttgaatgatgttttaggattggttgtcatgtttggttgaggtccccggggcctcggatgagttttgggtgcttaacggaaattgaattggacttaggaagaatttgaattgctaaacctgtcataaccgcacctgcatgtgtgggaccacaggcgcggcactgcagaagcggctaggtggctgtagaagcgagtttgggccaaagctccaagaccacaggtgcggctgggtttttgcaaatgcggtgccgcagatgcggccaagcgacctcagaagcggacccagcccgttaagtgatttttgcacctgcgatgccttcttccgcaggtgtgggaccgcaggtacgctcccttgaccgtagatgcggtaatcgctgggcagaaatataaaatttcaagggtttggttcaaaacttggaaaaatcaaattgaagctcgggagagggcgattttaggaggaatttgaagaggaaatcattggttaacaattccttaatcctttctaattgtattccattaatctattattagttttgtcatttaatttcggattggagttgaaaattgaggaaaaattggaagaaagttcttagacctagaattcgaattttgattgggaaattgacattgatttggataattttggtatgaatgaactcatgagagtatgaggattttgaaaatataaattttacccgattcctagacataggccctaggggtgttttggtcattttacctaatttcacgtattagcttagaatttatttgtagaatcaattacttgaagtgttatttacattatgcaattgaattgaatagatttggtgcatttagagtcaagtactcctggcaagagcgcggtttcgggttgaatttgagctggttcgagataagtagcttgcctaaccttgtgtgtgggggacattccccttaggatttggtaatgtggtaaatgaaatgccttgtacgtgaggtgatgagtgcgtacttgtgctaattgttgaaaaacatgttttcactaaagtagctttaattgtgtttttcctttcctacttactctacttgaaatttaagcttgttgttagcttagaaaagcatgtttaatcgacttaattgatttattgcttaaattgccttagttgtattatgtgaagcatgataggttagaattacctattttacttgttacgaaattgagcttagttgagtattctttgtgttgttgctgtgtgttttactttgggactacgggacggcatcccgggagatcccgtgcacatatttatgatttgagctgaggtgcgggataccgagagatccctagcacatatattgaagataccaagagatcctcgggataccaagagatccctagcttatattgaggataccgagagatcctcgggataccaagagatccctagcttatattgagcataccgagagatccctagcttatattaaggataccgagagatcctcgggataccaagagatccctagcttgtattgaggatactgagagatcatcgggataccaagagatccctagcttatattaaggataccgagagatccccggttattatccttgtgaagagtggtatttccttgtgattgtttttgtcttagttccagttattgtattccttattatcctgtattaaattcttactattagctttcagctatactgcttatcttattctgtcataccttatattttatttaatcttagtaggaccctgaccttcctcgtcactacccgaccgaggttaggcttgacacttactgagtaccgctgtggtatacccatgccctttctgtacatgtttttcttgtgcagatctaagtacctccactcagacttatcacgcttgagacgaggcgtatgtagagactccgaggtatatctgccgcgctcgcagactgaagagtccctttctactctcccttttgtattagcccttctgtactttgtgtctttgttagatcttcatgagttagatgtttatagactttcaaaggcttgtgatcatgagattccgggttttgggaaaagttattagctttcgagagttgatattgtgtatgctaagtggcactttaaaatactgttttatttcactacttcgggttttaattatttcttccacaaattggtttatttcccgcattgttaggcttacctagtcgtagatactaggtgccgtcacaatggttcacggagggcgaaccggggtcgtgacattatcggataatgggacatcacctaattaattaattagttataagataagatttaaacaatcccccacccccacgtggctgcaagccgctactaagacatatgactcttaatcatattgtcttaagtggccatcttaagtaaggcacataaagccacatacatataagacttattcaagtttggtttcatttatacaaagttcggtttcatttggtttcatttgatttcatttatacaatctttcttcctaattcaaatgctctaaaaacagacacaaaaacttggcttcatttgattttatgtatgcaacttttcttcctaattcaaaacctctcaacaacatacgctaaaacccaaatccaacaaccttccaacaaaatttcttgcgagcaaatcaattccagcgagaaataattagcaccttagcaacgtaaaattttacggttctaaaggagtacggtgtaaccttttccaagaatatcgtacggattttcccctactccaggtatgttaaggctatccttctttctttttacctatgcatgacataacattcatacgcatatgcgtgacactataattatttcatgaattacagagttatccagacttacaggctgatcatttactctatatttcttccatgtctgttatgtacttatttatgtgccttacatactcggtacattattcatactaacgtccctttttgcctggagacattgcgtttcatgcccgcaaggccctatagacaggtcgagagccctccaagtaggctatcagctcagtggaagatgctggtgcgcttcatttgcttcggagttgcttgtttggttagtatgacttagacatgtattgtttggtatggtgggactctgtcccgacctttatgaaaattatgtattcttagaggcttgtagacagatgtcaggtacgtaaatattgtatggccttgtcggcctatgttcagtgtacgggtagttattttggccttataggctcgtatgtcttatgtataggttggtatcacatgttgtattctacttatctcacggcagccttccggctcagttatctatgatagtatgacaagaaaagatacgttatgttggtactcggttgagtaaggtatctggtacctatcacgacccgtcggtttgggtcatgacaaaagtggtatcagagcagttctgtcctatggagtttacaagctgtgtctagtagagtcttgtttatgggtgtgtcatgcaccacacttataagtagggggctactaggcatttaggactgccactctttcttcttactctagatcgtgtggtagagctcaattgtaaggaatcaatttcctaaactctatcttatttgtaatacaacgatgtctacattcagaaagacggtcggtaagagatatagttgtggaagtgttgagttagaggaactcgattttgcatcatgcttatgatgagtaaatgtgaggtcttcaacagaccatgcgtgtactaaaaggtgtaagattcttgataaggagttttaaggcaagaatacttatccactcttacgttaaaaaggaataacggaatcggaaggtagacacaagtttcaacaagtaaaagaagcaaggttaagaagggtacgaggtgcccagttaataaagattatcattatttactattcaggaagggagatataagcattttgagttaccttcaacagtaacagatgtatgtacaatcggccacactgatctcagttatgccctatgggatctgacatatatagtttaagagaaagacgggttatcaggatctggctggggttaaagtaacccaaaatagtggatggattggtagagttagttgacatttctgaaggatagtgcaaacatgataatggatctccttgtgagacaactagacggtgcactctaaaatagtacaactagatatgactactataaagataggcattggaagcctagaaaggataaatattatcttagtataactcccgtccctagtagagagataattctaggcaacccgaagagctagtagatggaacaaaggggagctaaaagcaaaagaatatcttgttgaagttttcagaataaagtgatagacagaaatattagcaagaaataagaaaagagctaatgaagcattaagagtaagatgtgatgcattgatgacaatggtaggtcagaaagatgacagtattacagagactatagtcaagtaaaggaaaaatcgagaggtgacaggccttaagacaacaaaatagtataggccataaagtcatatgctcatttcgagaaataagtttgcaacgctgacgcgattaccaaaaggaaagttagacccccacaataatagaaactagtatggattggtgaacaggataagctaaacatgaattagggattgagtgatttgataatagtcggcatcatgacaatttcagatttcgttctggcaataatagaatggacaacagaagaagatccatgatgaattaagagaatgctaattcaaggagacgcttccctagagcaagcaatatgagcaaagttaagcttaagggactatatgtgccagttacactaagtgtcactatcgcgagtgaggaattttgttatccttggtacaaaaggattaccgcaaggcgagtaagggttattgatgatgtgaaaggacgctagagatgaagaggaaaaacatctataggcaggtcgtcatagctccaagtcttagtactcccctaaaagggggaatatggaatgataaaggaagaatgcgataaaaatgagaaagagatgagattgaacctatccagatattatagatatgatatgattccagaatgttatgtaagcacggcatcaaaaaaaagtaaaagttcatgcccgagatgttattgatagataaggagctagtacacgaggtaagttaagataaggaaataacccaagaaagattacgctgaatatggatatgagaatgggacgacgagtagttagtagttgattcaggaagagactagtcatgactagacaagaagttacagacaaattagcagatcatgcaaaataaatatagtaagccccaacatggagaattcagcctcgtagtaatatcattataatacttgagatatattcaaatatgagtcgggatagttaaaggtaccgtatgagtgttacgggaataaaagaaagtgccgctgggaaggcagtaaaaatattagttcagaagcaaccctacaagcacaagggcacggaggtaagcaacttcggacgattatagacaaggaaggacatcaaaaggtctgtaataagctcacaactttatgagagtcaagggttctccctaagtactacaattaaacactagctgagtaaataaggaagaaagcttcaaccaaagcacaatgacctaaaaaggaaagggttgtgtaacaacaatctaactaaaaaattgtatgcactccaaagcacctatcatggctaatgagtggagagtaaaaaccaaaagtaatattcaagaccatatgagttgcacaaaaacttcgacatgcgtgagaactcagataagctaagtatgcacgcaaaaaaggggcaaaaagaccaggaaaagcaattgcttacatttcgaagaaagctgaaatagaatgaaaggaattattcgattaatgatcagccgtagaagactctggtatgagctaaaagaaggaattgggtccaggtcatagacaaatgattgaatcattagaagattatatcatggttttccatagcgtccataaaaggctaaagtaatacctaaatgtcatgagccatagatcggaagatagcttgagcctacataaaggttaatcagaagaaagaggaaactaaagagttacatcaactaagtaaattaggagactgcatattggacccagaaagttacaaacatcatgattgagaatattgtaaaatcactcataatatctgaggtacaagagaaatagtacagtagccatattctataagagctctacgataaagccagttagaagactaccagtatggagctaccaccagattgtgtatgcactagaggtgcaaatattataagagagcttcaagttgtggatgtgattatacctatgtggaagggagttcatgaaagagataaaagttattatgtgagactttaagataagtaaggtaaggtggacaacgtactagattctcaaatacagaaggttgtgaatagtccttacttctgatagaaggctagaagtgcggggattcaatatctaggaataatagcggcatcgtcagtagcatatcctccagcctattgtctaggtatttagaagcctgattaagagagtaaagaagagtcataaacgatgcgatgtcttgcttgatattccagagggacataaggaaatctatgatacaaccaagttgaaaggctgcaagttatataaatagatatgtgtaggtcacaagctattgtatggtgaagcaacaaggttgtagaaaacaggagtaaggataagaaagggcgagtgagaaggtaatgaaaatggataagtcatcaggattaagcccatgaaaacaaaaaaggtagatggtttctctaagttatacaaaactcactatatcctaaatgagctcaaaggagtctaagactaatagcatttagaagagatataatgttgccctagtagtagaataagggtgtgattgtgatagataaagaactacgtttgggccttcgattgagtaatggtctgacgaagaaaagaaaggggttccatgaattagacaagattaaaatagccacataaggtgagtcacattgggatgctatgaaatccaattatggaagtatagtatcgtaccacccaggtggatcaaaaaaatcacttcaaatgttccacgatgcaagatgagcccaagtgattacgtaagaggttccaagttatcagtggtatattgtagatcaatattgaggtgaatcaacaatagatgggcccaagtcacaaagtgtgaggtgagattaggccgtcattcttaagataaacaagtaatgaggaagcactaaatgacctagatatatacatacgagataagtaacgaaagtaacatgtagttcggtagcagacctcagtaatgataaagtcatacggatggataaccagatctatgaaataagatatggctgtgagcacctaatttttgccctgcatgaaaataactcctaagaaatagaccaaaaataattttaatggattttaggagtttttctttatttagttgcatttttaatattttaaaaccatagaaaaaatgataaaaaatgtcatgttttaatttcatgtcatcttaggtccaatttgcatgtaggcattaattttattaagaaaaatctttaaaaattgtcatttttacatatttagcttttagtctttagaaaatagtgtttttatttagttctaagttaattagttattttaatagatacacaattttaatttttacaaattagattgatttaggattaatttaggattttattagattttaaaatcaaagaaaaagaaaaatgaaaaaaagattttgatttagtcttcctaccccaaagttaattagcctaaattcatgacccaaattccttcaagcccaaaacattgagcccatacccatttcccatttgacctaacctaatttcgacccctataaaataatgctaactcctaaaatcaaggggatagacctaagacttagagctaacctaaattcctaattctaagaagacatcacccggattccacaccaagacaaaacactgccaccgcccttattttcctaaaaagtttcaatttctactcaaacaaacaaacaaaattgaaaaacaattcctacataatcaacgtccaatttgtgccagcggggattttcttgtttccctttcagaaccccaccccaaccattgttaaacccattaaaaatatacacactcacaaacgcatatgggatagaagatgggatcagcttcaataaattacaagataaaaaaatccagcaaactttgccctattgctccacctgaaaccaccagtttccgagcccaaaatgcagccaaagggagcatcaaaactagatctaaaacctctaaattccagcccgaaatcacccccaaaacacccccaaattccagctcaaaaacgaccccaacaaagcccatagctgctgcaaaatcagccatgaaacaaccttgaaactagctgcttttccttcacgaaacctaacgaattctaaccaaaacagaatagatcgagtgaagctttctgttaagcctggttttcgattttcgagagcttcgtctgagtttttcggcgaggttttctggcaagtttcttgtttcaatctaagttgtagacgtgtgggattattgttgctgtgttgcggctttgctgagctccgtagctgattttattgcttcttcagttaagccttcatttggggaccgatagtactgccctcttttctcaagctaggtaagttcatgtaatttttattttatttttttagtaatgaaatccttgatttggtctttgattttgctgaggaattctgttaatcaacccatttgatgcttgtgtgataatgtggaaagtattcagatctcacctattgtttgttagaaaacttttgacttagtctaagcttcagaagcactgacagtagtcatgctttggattaatccatattaaaaccatgtagttgatttagatttataaatttgaagtttattttattttatttttttaattttgtcgtaatgtgtaatgggctaaagttgcaaagcaacccaacaaagtgggtcaggaaagcttgtttggaattttgtggtaattatagcatctttggtgaatcaagtttgtttttgttaaaactcgctagatcacttgaattattgtttaattttttgttaattgagactagctttcttttatttattagttcaaggttgtgattttcatggatagattatgtgaataaaatattagtaataaatttatttgtaatatatttgattatactaacatttagtagtcaaagccacactttctttaccatacttacctgtgtcccaagaactcaataatctcaaagtagtcttagaaagaataattcattgaacatcgtagcttgctttaggcgcgattaaaaaaatcatcatagctacgggtacagtttcccgtaacgtagttgtgatacctaatttccaaattcgggggtacatctatgtgacccggccacaacttctaataactttaagaaattaaacatgttgtagatcgtgggtacgagctcccgtgatatagttcacaatatgtatcaatcctaaacccttcacccctatgttctttccaatcctaaaccctttccaattccaagtattaattcccagagcttcatccacctcctcaacatccccgtatcccatcttctcacatattttctccgccgtcttatcaaacaccgccgccacattcaccgttgttttagtagaagcttcaataaacaaacatctattactcttcgcgaattcctcgccttcctctgcactaacagtcataatattttctccggcgtcacactcacttattccccaccactattactgtcgtgtcgcgttgttgcaatatatcttcaagccaactcgacaaccgctcgaaagtgtgccttttagtcacatcgtaaacaagcaaagctcctgcggcatctctgtaatatgccctcgtaaccaaaaggtgtagaaggaaagcaatttcaaattagcgaagctcccgcgacgtctttgtaaacaagcaaagctccttctaaaaggtgtaggaggaataataaaagaaataaaataagaaggaaattttaaataaattaattataaaaaaagacccctgatgacacgtgtaaaataataaatggctttagtatttgacgtggtatttttgtcaggcaactaagctacacgctctgaagaaggggtttatttataatcaactggttgagttgaggtgctaaaatgggaaagtcaaaagtttatatatcggctttaaaattcggtacaagtttaagtggctaggaggccatttcgccttcatttattagttcaaggttgtgattttcatggataggttatgtgaataaaatattagtaatgaattcatttgtaatatatttgattatactaacatttagtagtcaaagccacactttctttaccatacttacctgtgtcccaagaactcaatagtctcaaagtagtcttagaaagaataattcattgaacatcgtagcttgctttaggcgcgattaaaaaaatcatcatagctgcgggtatagtttcccgtaacgtagttgtgctacttaatttccaaattcggcatgtgtcctacatggttggtgagaaagttctattgaaggtttcacccattaagggtattatgaggtttaggaagaagggtaaattgagtcttcggttcattgggccttttgaggtgctttggaggattggggaggtggcttatgagcttgctttgccacccagcttgttgagtgtgcatccggtatttcatgtttctatgcttcagaagtatattggggattcgtcttatgttttggatttcagcacggttcaattggatggtgacttgacttatgatgtggagccaacaactattttggagtgtcaggtttgaaagttgagatcaaaggatatagcttcagtgaaagtgcagtggagaggtcggcttgtggagaaggctacctgggagaccaagcgggagatgcagagcagatatcctcacctgtttgaggcttcagatatgtttcttgacttgttcgaggacgaacgtttgtttaagaggggaaggatatgacgacccggacagtcgtctcatgagttactgctctgtttcccctatttttgcttcttattactttgtttatcgattttatatatgatcgggttggatggatcgggttcagaaaagttttggtaagatttgagacacttagtctcttttaggaagcttaagttggagaagtcaaccggatgttgacttaagtgttagagggttcagaggtgagttccgatggttcggatatctttgggaggtgatttgggacttaggagtgtgatcagaatgtattttggaggtccagagtaagtttaggcttgaattggcgaaattaaatttttggcgttttccggttgatggatgagattttgatataggggtcggaatggaattctaagagttgcagtagttccgttgtgtcatttgggaagtgtgtgcaaaatttcaggtcattcggacgtggtttggttggtattttatcaaaagcgtaatttagaagattttggaattcttaggcttcaatctgatgcgaatttggtgttttgatgttgttttgagcgttctgaaggttagaaaaagtttgaatgatgttatgggatatgttggcatatttggttgaggtcccggggggccacagatgagtttcgaatggtcaatcggaccatctcatgttttggaaaagtgcagaaaactgatgttcagtgttgtagagaaatgaccttcacgttcgcgagtaggccctctgataataggctatatatttgttatttacaccataattgcccatgctttgttgttggtttataatgtaagttgccaataaaatgctttaattaatgctatttggtttcgcagggaatataagatgtgaggaagcaacatgaagtgtttagaggcaataacgtgaagaaaacactcactcaagaagtacccaaatacaaaagagcaaaaagagaaggaacgcgaagacaaaaaggcccagcacacacaccgcggttgccaccgcggtccgcatcgtggttggaggcagtgttctctgcggtcagcgccgcggtcaacgccggggccacgacggcaggttcacagtccagaaagttaaggggccaaagtgtcaattcgaggaaacttttgtaaaacccttataagatgtaggaaactcacccaagagaggagagagcttattttgagataattttggcaagaagaacaagtgtgagagatcacccaaaacatcatagttcttattctcttctatttttcttgcaattttccattatgaatattttcgtagtttattcttacgttgtcatgagtagctaaatactctaatctaaggttttggtgaaacccgttggggatgacttggttgttatattaatatagtttgaattggttgttaatctctatttgttcatctacgttttgattgtggttagttgaaagtgccctcaattatccgttcctatttattatgtatcttcttgagaaagagtgcatatttaggtagttgtttgaacaacatcactcccggagtatagacgagagtcataaccgagggtttagagattggattagagataacgatacctcgggtgcaatttaaaataacggtaatgtgaatctagctagcgtagcttgagagagtgcatctagtaaattatcataattgcttgagagagatttatgatagccggagagttcttgattgatagagacaactaaggcatcgctataagaaatgtacaaccaaggaaatcaccaacgggggaaaccattaccttagaccttattccatttgtttacacatcaagcatagttaattttcagttgttaattattttcagactttagttgttagaaatatcatcaattgtgaattacaaagtttggggaaaattgattctatgaatttagtaaatcagtcaaaagtaattgataggttaattctctgtggttcgaatctgggcagaattactcagattatatttgctacgtccgtgtgtgcctttgtataaggcatagtttggcgttatcaaattttggcgtcgttgccgggtacttaacggtgttatcaattacaattaagagatgtacaaaaattctaagtgtagtcagttttctctatacccaatcttttcattgaaattctaacgtttgaactcttatggaaagcaggtgtatgcctagaagttcttcgaggattggagaactgctagaagggctctcagaccctgagaaaacattcagggcattgaaccgtgccaacaaaagacttcaacaatctcatcaatcacaccaactcgaatttgacatgggtgacatagataacgtcaacggaaacgtcaagaatgagccaactaacttaaatgtcagaagagtggcacctcttgtgcccgaagctgcactttatgactgggcacaacccacaactgataatctggccactgtcatagctgtgcccgcaattcaagcggagacattccagatcaccaacaacatgttgcatctgctgcagaataaaggactgttctccgggtcacacattgaagacccgcaacaacacttgaagaattttttgtcaatttgtatgacccaaagtcagccaaatgcaactccggaagctatcaagctgctactatttccattcttggtaaccagggaagctcagacttggctaaattcgctccctatcaactctattaccacatgggaggaattagtcaagcagttcctgaacaagttctatctgcctaacaagactgcaaaatagattgataacatattgcagtataggcagcaggcctctgagtccttgcaagaaacttgggaaaggtttaaagggatgttagtgaagtgtcctcgccatggcattctagaccagatgctcggccagagattctacatggggctagctgacaatttgaaagcaaatgtggatgtgtcagttggaggtgcatttttaagtaaaacattcactgagtgcaaaatctttctcgataagatgccacaaaattcggggtggatgactagaggtacaacactggcacccatagtgcattcagttcctcttgacccaaataatttgcatgcatagaacatggccacactcatgacccagatgagcatattgacaaagaagattgatgatatgggtacaaaacaggtgcacattgttgatacaacaaatgagggactgtgtacacctcgtataatcagtcttatgtgtgttcatgaagcagagaaggtgaaaatcaatgggcaagggaagatatgaattatgtcaataactatgggggtcagaggcaaggagcatagcagtggagaccgcagcaaaatcagcagtacaagcctaatatgtagcagcctgggggtatgcaccctcaaaaccaattggtgccagtaccatatcagaaaccacagggctatccacagcaaaatcagcaacaattgacataccaaccaccccctcagcagcaagataacaacatggtggaaattaggggtatgcttcagcaactcattgggacaaataataaagtgcagaaaaaattggcagtgcatgattcagccataaagaatattgaaacgtagctgggtcagctgtccatggctttgaacaaccgtcctcagggaactttgactgcaaacacaaatataaaccccaaggaccaaaacccgaatcagctgatggtagtaagtctctggaatgggagagatttagacagagagcaggaaattgcacaagccagcaaagacactacaccagccactccagttcaattagaggtagaggaaccaacagaacttactgaagtggtggttgagcagagtcaggaggaaaaagtcaaagaaaagatgaatgagcaagttgcagaacaggtggcacctcttgtgcctgaaattctaatagagagaatccaacaagcaatgcacaaagggtgatacctacacccttccctcagagactggtcaaacaaaagaaggcataccaatataagaagttcatggagatgttgtgtcaaattcagttgaatattcctttgatggatgccttgagggagatgcccggttatgctaagatgatgaaagatctaatgtcacagaagtttgattttcaggatctatccactgtaactttgacacaaacctgttgcgcagtggtgacaaaactgatggctcaaaagatgtcaaacccgggtagcttcactattccatgcacaattggaagttatgcctttgcaaaggcgttgtgtgatttgggagccagcatatatctgatgccactggctgtgtacaccaaactgggcattggtagagctaggccaacttcgatgctgctacagctggttgaccgcacaatgaagaggcccactggtattcttgatgatgtgttggtacaagtggggaaattcgtgttccatgcagactttgttatcctggattgtcaggtggataaggagataccccttattttagggagaccatttttagccacggggagagcactgattgactgtgaaactggggaactaaaaatgggattgaacgatgaagaagtcatattcaatgttcagcaatctatgaagagacccagtgaatatgctaattgctctctagtggaagcagtggatgtaatcctgcaagaagatgatatgaccctaactgtaaaagatccattggaggcatgtctgatgaatttagaagaaatggatggtgaagggttagctaaatgggtcatggcactggaaggccgaggattttggtcaagggaacctcagttcgagtcccttgagctagaaaaaagggccactcctccagcaaagccattaatagaggaaccacccaagttggaactgaagccactcccagatcacctcaggtatgtattcttaggccctaattcgaccttgcttgttatcatatcatccggtttgttagatgtgcaggtagaacggctcgtacaggtactacagaaaaacaagactgccattggttggaccacggtagacacaaagggtatcagcccagccttctgtatgcataagattctcctggaagaggggcacagaccttccagggaacaccaatgaacgttgaacccaaacatgaaagaagttgtaaagaaagaagtaatcaaatggttagatgcgggaatcatcttccccatctctgatagtaattgggtcagcgctgtccaatatatgccgaaaaaaggggaatgactgttgttaaagatgagaacaatgagttgatctcaacttgtacagtcacagggtggcgtatctgtatggattataggaaattgaacacagccacccggaaggaccatttccccctacctttcattgaccaaatgttggacaggctggttgggcgatcacacttctgtttcttggatggatattcggggtacaatcagatatcaatagccctcgaagatagagagaaaacgtccttcacctgtccgtatggcatctttgcctttcggagaatgccttttgggctttgcaatgcacctacgactttttaacggtacatgttagccatctttacagacacgatggaggatattatggaggtctttatggatgatttctccgtggtgggagattcattcgaacactgtcttcacaacttaagaagagtgtttaaaagatgtgtggagacaaacttagtgctaaactgggagaagtgccattttatggtacaagaaggtatggtcctgggtcattgagtgtccagtaaaagaattgaggtcaaccatgctaaggttgacgtgattgagaagttaccaacgcccacttcagtcaaggcagtgagaagttttcttggacacgctggattctaccggcgtttcataaaagatttttccaaaattgctaacccattatgcaaactccttgaaaaggatcagccctttgtgttttctaatgattgcaggttagcatttgagaaactgaagaagagattgatcattgcacctatcattgttgcacccaactgggagcaaccatttgagctcatgtgtgatgccagcgactatgctataggagcagtcttggggcagcaaaaatataagatgatgcacctgatttactacgcaagcagaatgctaagcggtgcataactcaattacacagtaaaggagaaggagttgttggcggtggtgtttgcgtttgacaagtttcgatcatatctgattggttccaaggtaattgtatacactgaccatgcagcactcaagtacctaattgagaaaaagaagtctaatccacgcctgattcattgggcgctactattgcaagaatttgacctcgaaattcgtgaccgtaagggcacagaaaatcaagtcgctgatcatctatcgcgacttgaaggagctaaaaaatcagtcaaggtcgaagagatcctggaaacctttccagacgagcagctgctcgcagccagtcttgaggaagtgccatggtatgcagattttgcaaactacctgacctgcggtactgttccctatgacctttcatctgtccaaaagaaaaagttttatcgtgattaccgcatgtattattgggacgagccttatttgtttagaatctatgttgataatatgatccggaggtgtgtccccgagatagaacaatcttctgttttgcaggcttgtcacgcatcagcatatgaaggacattttggaggagccaggacagctgcgaaagtgctagaggccgggttcttttggccaacagtgtttagagatgcacacctttgggtgaagggctgcggcgaatgtcagcgaaccgagaacatttcccgtcgccacgagatgcccatgcacccgattcaagaggtagaggtgtttgatgtttgggggattgacttcatgggccccttcgtgagctcatttggcaataaatacatacttgttgctatggattacgtgtctaaatgggtggaagctgcagtgttacccactaatgatgcaagagtggtgaaaggttttgtgaaaaggaatatattcacccgatttgggataccaagagcgatcatcagtgatggagtcactcacttctgtaacagagccttcgagaaattgcttgcaaagtatgatgtatgccataaggtggctaccccttaccatccacaaaccagtgggcaggttgaagtgtccaacagggagataaaaagtgtactaaccaaggcggtgaatgccacacgaactgattgggcaaagaagcttgatgacgcactctaggcctatagaactgcattcaaaacaccaataggaatgtcaccatacaagttggtatttgggaaggccttttacctgcctgtggagctagaacatcgagcttggtgggcactgaaacaattgaacatggattccgaagcagctggacaaaatcgactgacagagttgcatgagctggaagaatttagatatcaagcctttgaaagcatgaggctctacaaggaaataatgaagaagatgcatgataagcacattgtggacagaaatttcaaaccgagtgacaaggtattattgtataattcaaggatgaaattgtttccgggtaagttaaagtcccgatggtcaggaccatttagagtggtgcaaatgttcgcaagtggagctgtcgagattgagtcagaagatgggacaaacaagttctcagtaaatgagcaaatgttgaaacattaccttggaatagctaaagaaaaaagaaatacaatggtaatcaatttgaaagaacccccgtacgcgaatgaggagtgaaggctcaaccacttgcgttgtgccgtgacgttaaatcaggcgttgcgtgggaggcaacccacgaatatgttgtaagtgtagtatgtaactttgtgtaaaaaaacaaaaaaaaacaaaaacaaaaacaaaaatttttgccagtcgcgaccgcagccaggaccgcggaccgcggcgtcgaccgcggaaatcactgagcgattcagtttttcactgcggccgcaggtcggaccgcggcaacgactgcgggagactctgtctcaaaccgtggcgtcgacgtctgctgaattgtaatttttttattttttatttttattttacttttttttcccactcttctttttaattttaaaacccttccctatatcaaaataaacaatcccccctcctaaaataaccacttccctctctctctctctaaccctcccctccatactctcttcttcttcctccttcacaacacccctcttcttcttcccccccaaggaatgtttccgaccccccttcttctttccttctattgtttttgttgcattatgctagttcatgttattctaatgtagtgttagtgataggattttgttttgtttagttcttcttctttttagtgtaatttcgttttaagtatatgtctggtgaaggggctgtgtttttaatgtttggaatggtgttgttggtgggtgatggttaacaaaaagtgtggaatgtgagggtgtagaagatagttgaattgggaaagttttcttgattcccttggggccatgaatatgaagaaaatgccttgcccacaatgtgtttgagaaattgcctcaatggtgatataaggagatgttgtgacatggttgtggtgaagtctgagtaaccacccatagtcacacattttaagctcatcctaatacgtgtttctctttttgacaggtattatgagttctgcccgtaagatacgaaacaccgggtcctttgctagtggcccaggaggctcctcacgagctaggggccaaaccagtacaccacggtttgatagcactcgattcgtctttgcagaagcagaggcaaggtacaatcaaaaacttgccagaaagttactccatgaggtccaaatcgacaggaaggctttggtgagggaatgccccaatatgtttgatgaactacggaggtgtcagctggacatcttctttgagactcccgaggaagcaaatattcagctagtgagggaattctatgcaaacctgccagaacacgaggacaaggttgtgactatgcgcaacacccaagttaatgctgctatagaggtcatccgcagagtgtatcgcctccccgcattcacgggtgatgatcattacatcatggctagtcgcccgatggttgactgggatagaattctggaggttatctgtatacctggcagacatcccaaatgggtagcacaaccgacgactctgcattccaagtctcttacttgggaggccaaatgttggctcactgtcatcaccactcagtttctaccatccagcaataccaccgatgtaaatgggccacgggccactatgatctactgcttcatgactcaccaagggtttgatgtcgcctgagttctctctgaagaaatgttcatccgatagcccgaactaagcaaaggccactacttcccttcgtttgtcacccgtatattccgccttgctaatgttcctgagaactcccgagttgatgggaaattacctataaaaaacctttccgggcgagaaaaattgggcaagagggacgagagccagtacgacgcaataatgactcgtctgatgattctgagtctgaggatgattctgatactgctgaagctgttgagatcacagcccctcctagaggggacgaggcaggatcgtcacagccatgccggagcactcaaatggatgctttggagcgggaaatgactagactgcggacctccgtcaccgacttgggatcctgcatggatgttgtggctgaccgacaggtgaagtcggaaaagaaattcatgggttggttgagagcactgggttgcgcctgcaacgtgaacccagacacagtttcagatcaagagtgacccttcacggaagtttctttacctcactactttttatattaccaagccatgaggacatgttttaattttaagtgtggggtgggggaaacttcgttgtatgttttacttgtgaatattatctgtttgtttttgttttgtgttagttgctttagaaatagagtaacagttttttttaggaagttaaaatagaagcgacttgtcccgacgatggatctctttcggcggggttcttgagggactaagttgagagaaaaaaaaattgaaatataaagactcttcctaatgacggattctttagacaaattttcttgagggaagctagtctatagaaaacaacaaaaagatttttttttatttcttaggtagtgtagtaactcccccttggtttttctttgggccacggttcttttccaagggtttagcttgaaccgggtataggtagatttgtttttgttttaggttaggattaatgggtgacgagcttaaaattgaagaagaaaaacccttagcgttcttacacccgaacacgatagatgctatagtgtagcgcttagcttcaagggttgaatcttgtttaagtgccttaaaaattgtatgtttgtacctaacttgaacactcaaaagagaatgttttgataaactaatctggagtgagtcatgtgccatgtgggtgtgagtatcattgtattccatgttgtacatttgatgcctagaacttgccctgtgtgtttataaaacgaaatagtagcttcattcggttttagaagtgatataggcatttctttgttgagccaaacatataaagtgaacccacctgaatgcattacatcttagttaacctcgttgagcctataagcatgtttctttggcaaccacaatgtgaaccttaaccacttgtttgaatagcctgttgtttgaactaattttcctccctctcactaagcactagattggtattgagattatgtgaaaacaaaagtgtggggtggtggtttggtttttgaagtggaaccgtggaaatagagaaaaggtgcagaatgtgaagcgtaaaaagaaaagcaccacgaaaaaaaaagaagttcatatatattttgtagtgattaataagtggtagcttgtacaaattacacctaatgtatggggatgattaaataaatgtggtggagtgttggattacaaaatgatgatttttaaattcaacgtaattgtattaaaagtgcttagggaggttagtcactatatccaaatgtatcctacccgtcccttagcctacattacaaccaaataaagtcctattgatcttagactgagtggggctcgattagtcgagtactatactaggggcaagcctatggtgcatctttgtggcatgtgaatgttatttttggagagtgagcgaattctgtctatttgagttcctaattattatcactatcattatatatatggaactactctcttgtgtgatgtgagggcatgtgactcacaaaggaaaggtgcattttgactattgtgtagagtggtttgagtaagtgcaaatgttacagggtacgaaaaacttgattcttgaggtaaaagttgttcactactaggtgtaactcttgtgaaatgttcatggcgtgagtcgttgagggaaaagcataggaaatgaatttttatggagtgtggtgaattgctcgaggactagcaataatttaagtgtagggtgttgataataggctatatagttgttatttataccataattgcccatgctttgttgttgttttataatgtaagttgccaataaaatgctttaattaatgctatttggtttcgcagggaatataagatgtgaggaagcaacatgaagtgtttagaggcaataacgtgaagaaaacacccactcaagaaatacccaaacacaaaagagcaaaaagagaaggaacgcggagacaaaaaggcccagcacacgctccgcggttgccaccgcggtccgagccgcgattggaggcagtgttctccacggtcagcgccgcagtcgacgccgtagccgcggcggcaggttcacagtccagaaagttaaggggccaaagtgtcaattcggggaaacttttgtaaaactcttataagatgtaggaaactcgcccaagagaggaaaaagcttattttgagattattttggcatgaagaacaagtgtgagagatcgcctaaaacatcatagttcttattctcttctatttttcttgcaattttccattattttcgtagtttattcttacgttgtcatgagtagctaaatactctaatctaaggttttggtgaaacccgttggggatgacttggttgttatattaatatagtttgaattggttgttaatctctatttgttcatctacgttttgattgtggttagttgaaagggccctcaattatccgtttctatttataatgtatcttcttgagagagagtgcatatttaggtagttgtttggacaacatcactcccggagtatagacgagagtcataactgagggtttagagattggattagagatcacaatagctcgggtgcaatctaaaagaacggtaatgtgaatctagctagcgtagcttgagagagtgcgtctagtaaattatcataattgcttgagagagatttatgatagccggagagttcttgattaatagagacaactaaggcatcactataagaaacgtacaaccagggaaatcaccaacgggagaatccattaccttagaccttattccaactgtttacacatcaagcatagttaattttcagctgttaattattttcagacttcagttgttagaaatatcatcaattgtgaattacaaagtttggggaaaattgattatgtgaatttagtaaatcagtcaaaagtaattgataggttaattctctgtcgttcgactatgggcagaattactcagattatatttgctatgtctgtgtgtgcttttgtataaggcatagtttgacgttatcaccctcgcattcacgaagggttagctggtgaggctgagattttagccttcacattcacgaggaaggctccgcgttcgcaaagaactggggttgttgtgcatcgcgttcgcgagagaggctccacgttcgtgtagaggaagttgggcagctggatttgaggttgatttgtcatcgcgttcacgagaaggggagcatggggatgaggaaccatcgccttcgcgagggattggacgcgttcgcgtaagagaaaatatggtcagttagattgtgcttcgcaaacgcgaggcgttgaccgcgttcgcgaagaaggaattgaggcctgggcagaatgtttaaatagtcatcttgtccgcgattttggggttaacttccaccatttttgagcgattttggagttttttgaagaggattgaagagggattcaaggggaaacacttggaggtaagatttatggacttaatactcgattctaatgtgaattttacctaattaatcatggaaattaagtctattattgaagaactagggcttgtaattggagacctagaatttgggatttgagaggtcatttgtggttgaattttgatgcgtttggtatgaatgaactcagggagtgataaggagtccatattgatgtaatttttatcggaattcgagacgtgatcccgggggtcgggtttggccaatttcgggatttatgttacaatttgatttttttcgaggtgcctttgttcccttagcatattttgatggttttgcactgattttggttagatttggagcgtccggaggccgattggaggggcaaaggcatcgcgagctagagatttggaccgggtagaggtgagtaatgactgtaaatgttgtcctaagggtatgaaaccccatatttgcacatcgttgtgctatattgaggtgacacacatgttagatgacgagcatggggtcgttcactattggggatcatgacttagtccatctcgaatgattgttttaccgcgtatttgactgaaaactatttgctatcatcatgttttgggttgaatgccatatttaacctcgtgccaactatttgaacccctttatgggatttttactgatctttcctcactgttttgactttatacttgaactcagtcatattatattctactgttttcataactcagtcatgtttactctactttaacactttaaatgacatttaaaatgatattttgggctaagcatctactgttgcccgagtggcttgtgagattctgactaaggccaagggcctatgttgtgaggaaacactgattatgttatgaggccgggggtctgatatttgtacgccacgagatggcttgttgaaatgagatcgagagcctagtgatgatgccacaagatagcttgatattgcgcttgggccgtaaggagcccctccaggagtctgcacacccccagtgagcgtgaatacccattgtgatgtgagatataacccgtgaggctggtgttatttatgatattgcccgaggggtggatttttgttgactttgtgccgaggggcgattctttatgtgtttatctttcctagttgactgtgacttacttgcttaattgttaaaaaagcatttttaagaagtttaaactgagctaaaatgacttcttatattttattgcttcattgttttactgtcttttactgcttctttacagcctgttgacgtgcctttgcatggtttcttattactcagcctgcatttattattattactcattgagttggagtactcactttgctccctgcaccccgtgtgcaaattcaggcgcatcaggtcctgcttgtgagggttgagagctgtccagcaaatttcggagattcactaggtaactgcccggcgattcgcatcccagtgcttctccctctatcttatttcgttctgttttagttatataatagtggagtagacttgttcatacttttagtattattatagatgctcatgactggtgacacctcgatgtcgagctatgtctttttccgcaaactgtattatttaccttattttgggttttatgattatgattaagacttagtttttttacttaattgcttaaaaatgaattgggaacgcatcggctggccttgtcttcatgagaggcgccattacgaccgggttcgggtttaggtttgtgacagctgcaagatagaaggtagcaaccgttacgagattagaaggaattagatcacaagtcatggcgtgggaaataggcttaaaggagggaatgccctggactttggatttattcacagaacaactgcctaaatggcaaggagagtaggtattcacaacacctataagttatgaaaatgataagagcatcagtcaacattcgaggacgaatgttccaaacaggggaatggtgttacgccccacaatattacgtcgatattatgtcccgcaatattatattacgatgatgccacgccttgcagtattacattatgatgatgttacgcttcgcagtattaaattacgatgatgttgcaccctgtagtattgtacgttgaatttgtcttaaggtaattgacatccaaggggaagcaagtcaaaaaataaattttcgtccaagtttggcatgttgggataaaatacgagccgagcgttaatacccgatatttatggactagtatcatataaggtagcatatgaccatgatattatgatgtataaaatatattaaaaatgagtaatattttaagtaatttgagataattcttaattatgtgggtaattggttaattatcgagtaacgggacatcatctaattaattaattagttataagataagattaaaacaatcccaccccatgtgacagcaagccactactaagacatatgactcttagtcatattgtcttaggtggccatctcaagtaaggcacataaagccacctacgtataagacttattcaagtttggtttcatttatacaaagtttggtttcatttgattttatttatacaatctttcttcctaattcaaaagctctcaaaaaacagacacaaaaacttggtttcatttgattttatatatacaacctttcttcctaattcaaaacctctcaacaacagacgccaaaactcaaatccaacaagcttccaacaaaatttcttagctctcaaaaacagacacaaaaacttggtttcatttgattttatatatacaacctttcttcctaattcaaaacctctcaacaacagacgccaaaactcaaatccaacaagcttccaacaaaatttcttgcgaccaaatcaattccagcgagaaataattagcacctcagcaatgtaaaattttacggttctaaaggagtacggtgcaaccttttccaagaatgtcatatgaatttttccctactccaggtatgttaaggctatccttctttctttttggcataattcatacgacacgaacgaaacgagtaaatgcacaactttcataaatgactctattcatagaaatactagagatgctcatgttcttgattccccatgtgtcatattattctatcatctgttcatgggtctcagaatatacataagttgagaaagtttgtttcatgatattaatcagaggtatgatgatcttatgacgtatcgagagattttttattaacgtatttcatatgcatttcatgtatttatacatgcacattgtctcatgaccagatgatgttatacgcgtatttatatgtatatatatgtatatgggatatgggaaaggttatggcgttatatacgcaccaccacctgatcagctggtatacgtacgttgatgattttgcccacgatggctgagataatatgatgggatgccctcagaggcttgatgatgttatgagcacatgtacctatacacggcataacattcatacgcatatgcatgacattataattatttcatgaattacagagttatccagacttacaggttgagtcatttactctatatttcttccatgtctgttatgtacttatttatgtgccttacatactcggtacattattctactgacgtcctttttttcctgggaatgttgcgtttcatgcccgcaagtccctatagacaggtcgagagccctccaagcaggctatcaactcagcggaagatgttggtgtgcttcattttcttcggggttgcttgtttggttagtatgacttagacgtgtattgtttggtatggtgggactctgtcctgacctttatgaaaattatgtattcttagaggcttgtagacagatgtcatgtacgtaaaatattgtatggccttctcggcctatgttcagtgtacgagtggttattttggccttataggccgtatatcttatgtataagttggtatcacattttgtattctacttatctcacagtagccttccagctcagttatcaatgatagtatgacatgaaaagatacgttatgttggtactcggttgagtaaggtaacgggtgcccgtcgcggcccatcgatttgggtcgtgacaattccaaaactcctttatcaatatgatgatcctttacttcaacgtaggtaaaagtggggaaagtttctatcaccaaattatcgagtccacgtgtagcagcagcagcactacggcggtgcatagaaagtgtttgacggatgctgttatcgttggcggcgctgtgactgcggttgtaaattgagaaacaaaactctatataaatctctgtcttcctcttcgcttcgtcgttctagggttctgcccaatctgggatattctgtcccaatccacaagcgccattcaaattcaattgtaaagaatagtttttttgaagcgtacgtgaggctattatggtaacaggaacagtgacgtttcgagtcaaaatcgcggccctctcgacgagacgacattagggttgtttttgaacaaagacgacggagtttgggctgagcaactagaattttctcttaatatatttcaatgtatttcaatgtattccgtgtattttattgtattcactgtctcgttgtattccatgaatgtattcatttatttttttaattaatataatttatgtattcagatgtatatatgtattcaaattgctttgttttgttgtatttatcggctgggaaaaatattcagcatattttctctgaagattgctatgttttcggggtatttttcggttgagaatcttttttataactggaaatacaaattttatgtgttataattgagtttgttgagttatattaggagtctattatgttaattgattcactttccgtttaaaacggttgaatagactatgaattgcgttatttacattattgtattcacaaatacatatcgtgaatacagtcgaatacaataatctatctagttgtaatccattgtttcacgccgtgaatacagtcgaatacaaaaatttgtctagctgtaatcacatgtttcacgcctaaaaatgctactgtattcatgaatacaataacttaaatacatcgaatacattctaaaaaacctaaaaatatagctatataaagtaatataactagctaataaccactaaaacatagtggtttttgaaagtttctcaaaatgttatcatctcaacaaaacaaaaaaattgatttcgagttaatattaacagtttgaatcaataattattttctttaatgagaatgaaaaattaagttattgaattaattaatttagcaaataatcaaatttaattatttttaaattcatcatatacaaaaattatttttcaagttgataaaacttttagggtacataaatttgttttaccaagaagaatattggcgtgtaaagaaatcaaaaacaaagcaaaattaattatagtatagtattaagagtcacattaataagaatacgaacttgaagcaatgaaacaatagaaataatttgaattatgaattatgaaaaaaattgattattagcacacaaaaaattgaattatgaatgaattgccgttaattattgtttttctttttacactcgttccaacaatttgacagttcgtcgtaattttttacatattaagttagtattctatattaactgaacattagttatttttatactttaaattgttacttatcaattctttaaagttatacgtcaaactcttcattttcaaattttaaaaaaaataaaagattctgtttttaaatttattttatttcacaatttcttaaataattataattaaagtattttcatattacttgttcatttttactatttgtcacaaaaataacagcaatattttaaggatactctcgcataagtcatcacgaatcataataagtacccgaggactaatgtgaggcaagatttcttttttattaagctggttaaatgagatcactgttaattattttcgaaaacttagacctttttaaattttttattttttaactcaaacacattgtttaatttaatatttacgtgcttttctcaaagttgtatgctgattgttatgagccacatgtgcaaagtgtgtgatgccgtacccaaaagctgttaaattgaacagtgttaaatgcagagaaaattcgaccaaaccatttttgaatgccactgttaagatgcttagcaaagcaaatggttatatatttccaactcaggcctaaacccctatagagttaaattgccttgtttttcacctctttgtattcaaatttattgagaacctgctatgatataatgtaacgccattgtgcatcatttcacattgtttataacataatataggattatgttgcactcaagggaggttcaataaaattagtggcctaatgccaaatttaataagaggtcttatatttttttaaaaaaatattaaaattcatacatgtatacacaacaaatataaaaaagttagtgttgtcattttattatagtacttgtttttgtaatataatattctcaaatgctgtaagtcatttaacttcccgtagtaatattattgtttgtattagtaagaggttattgaaataaataagatgttatgcatgtatttacaataatagtttttttgatatttttgtaagaaattatatttactagtataaaaatttaagtattttaattcaaagttttgaaatatttctatcgttaaaaagtaaatgctcttttatttttacaatttttttgtacttttttttttcctgcaaactttaatattgtctaaactaaaataaaaccataaatttactgtggagcctcaaaatctcgagggcctagatcaaagctttattgcctcctccttgagccactcgtccatccctgacattctcaatcaatttttatagtctcaattaacataagacaataatgataaaaaacaatgaatgtatcattcagttaccaaatgtgaataacattgtttgaacagtacgtgcataaggcaatggtcttagggccaaactaaaatttattaaaagacatttaaccctttttaataaaattcatatgataataagagaccaaaaaaactacatggctttgatctagtggtgagagtgcaacacttgatgtgtgggttaggcacgtcatggtattaaactctcctttatacaaaaatatggtattaagtaaaatgataaaagggtgacccattattcatcaagttttgaaccttgcgacacttgctcagaaatttcttagttaaaaaggtaagacacaaacgaacttgctttttgatgtatgaatcaatcaagtgggacaaaaatgaataactaaattagagaatttgagttgaaactaaaaaagtaaaatcgtgagaaacttgaaaatagactattcatagagtaagaaaaatagaattgatgaaaaggtaaatatattaattgatttaatgatagtgaaaatttatcgtattaactcacttgatcctaactagaccaaatttaaaacaatatttaaacttaatttgtttactaatatatatatatatatatttgggggcccaaggcaagtgctctaggcaaggacttgccctacccaaaagccgcccttgtttgcactatctatttaaatataagtgttcaagataaataaaaaaaatcagtccgcacttcgggtacgattttggcatgcaagtgctcatcgctgtcacaacaacaatatatccaatgtaatttcacataatgtatacgcaaactctacctttattgtagaagcagagaggtcaactgcttagagaaaataggcatggccatttacaatgttacaattcctttttagatctcttatgtgtaaaagatagatctctcatatgtaaaagttaataacccgactggtcattttgagttttagcattttgtccagtggttctaggttttgagtggcttcataatgtgcattatgacttgcgtgtacggttaaattcgattttcggatttttcgggattgaattggataagtggttctcattttagaaacttaagttggaaatgttgaccgatatttgacttttgtgaaaataactccggtatggtttttttgatggctctgataggttcgtattgtaattttggaattgggcgtatgtccgaaattgaattcggaggttcctaggttgattggacttcttttgtcgaaagttggcaatgtgaaagtttaaaaattccttaggtttgaccatggtttgaatttatggctatcgggtttgaaatttagttttgggacttggaataggtccgttttgttatttggaacttctacaaagtttggcgtcattccgagttgatttgataggaatcggacacgcgattgtgtttataaaagttactgagtttcatgtaaatttcatgtattttagaggtccaactcatggtttcatatgtttttttgattgtttgatcgtgtgagcgagttcgtgttatgtttttagacttgtattgatgtttggtgtggagccctgagggctcgggtgagtttcggacgcatttcggagtgcttgaaggagttctatcttctggtggtttctgcacatatgctttaggtctcacgaatgtgagcctgtgttcgcatttgcgatatcgcatttgcaaggtgggacattgcttgtgcgatataggctgggactattgggtttgcatttgtgaacttattgttcgcatttgtgatggggtctaggctaggcagtggtcgcaattgcaatcatttgtcgcttttgcaaaatattcagtcttcacatttgcgatgttagtgttgcattttcgacattaccagtgttgtgatggatgtcgcttgtgcgatcattcttcgcatttgcggggtttgtatttgcgaaccccatatcgcatttgcgatacctgcaccagaacataaggcctgaaaatcgggagtttggcctcatttttcatatctaataaccctagactcggtaggaggcgattctaaggagggattttcatttacaatccttgggtaagtgattctaaccaatttccaactgtattttatgattatatataatattgaacatcaaattcatgagaatctaacagaaattttggaaaattttgtctatgttttgaaaaatgaaattttgggatttgggagtcgatatggactcaaattttgaaataaaatacatatatggactcatgggttatgagtaatgaagacctacccttagacccggattttgaccggacacgtctgggttaattgtttgggaattgtatgaaggtcatagctttacttattagtacttgttcctcttgcattatttgatgttatgaattgattttggttagatttgagtggcgtggaggtgaattgtaaagggaaagctatttttgagagttgattgggcctagttgaggtaagtatcttgcctaacttcgtgtgcgggaactaccccctagggattagtttgattatattatttgtattatgtgaaagacgtgtacacgatgtaacgagtgtgtacacgagctatatgttgtattttgactggtatagacttctagacttcttccatgcacttaattgaacttgttattgtcacacctcctttttcatacaccccccggaagagggatgtataaaggagtttttccaattaaaggacaatcgaaacgggatttatttattaaaaaatttagagtcgccacttgggataatttatggtgtcccaagtcaccggtttaaaatcccgaatcgaggaaaggttgactctgtattacagtccgcgaacatagaaatccgggtaaagaattatgttaacccgggagaaggtgttaggcattcccgagttccgtggttctagcacggtcgctcaactgttatattcggcttaattctctgattttaaatacattttagcctatgattcaattttaacttttataaccgctttatttaatttttaaagaaaattgcaacgttattaaaacacgtttcgaaccacgtcacataaatgcacccgcagctcttgacatattctatctaacattgttgagatttagatttgggtcacataaatgcacacccgagtttaggaaggtagattattaaaataatgcgcctaaagcaactacgcatttattttttttgttatcaatttatcagaaatggtcatttctacctattagaccgatacgtaattaaactatgacacaaatccaaactaatgtgatttaatccaaatagaatagtctcgtcattatctcttatagtctatttatcactcctacgtgttttaaacattaaaccgacgtctcaaattattgttatggcgtatacttatcctggttccacacaacgaaagttaattcacagaaacaaccaaacaccagcagttaaggcatacactactaatgatatacgttattctaaaacaagcatcaatgaaaaagaagcagcgatgcaccagcaaagtccatcaaagctatttgaaaatggagtaatgtcatgaaggaaggaactgaccttttaattaaaaaaactgaagtcttctagtacagaggaatctaaaatagtgagaaggatcccaatggaccttgaaaggaaagtcaacaactgactagcacccgaccggaacatacgtcggcgattctagcaggacctttactgaccggaaaactcgatgatgacctcagcggcaaactcgaatctcttactcaacgactaaatggaaagcttgcaccagggacctcgacgaacccgacacttcaatatatggccctgtacggatctcgcaaacgaactccaagatggattcaacatcgacaaggaaccagcagaatagtcatcgaaacacgaccagaaaaactcaagactcgccggaaaagtgttaaacgagcttttgaactcctcactgttttcagtgtgtacgtgtgtcgtggttgttttctcgtttgagctggtgatggagtttggcagctatggaggagttggttgttgtgtgtcattggtttcaaaggctgcgtctggagctcgtaaatccgacgagctgctggagctcatttttccgacgagtttcaggcaaccgtggtcagcgttgtttgcctttttcgttgttgggtgttgccggattttccggcgggtttggtagcgaccgatggtactggtgaagggtgtgagtgaagagggttatggggtctgttggtttttgggttatgttgctgaagcagaaaaatgaaaagaaaaaacggggaggaggggaggttcgaagaagacgacctcaaggggtggtggtggttttttttttcaaaagctgcacagccttttctgtcagctttcccttcagcgtcctctcttcttctttttgatttttaagcattaatttatagctagagtctaggtttaggtgtatttttgtgtattttgcccattagtccctaggtcttttgtgtattaggtccttagggtctttttgtttgtttttattccaaagaagagtctagaagggtccctaggcttaatggactaatccgacttgggccaagaactaggttctaaaactcttaaaattatgatccaacaccttaatcgactccttttaaaataagataaaaatactacataatgcaaaagctaacatgaaactattatatatttttttgtattttcaagatcatgtaaagataaaaataaggtactatttttgtgtatattttttatttaaatttatgaaagatacgcaagctaaaatattttttgtaattttccatttttatgacgaaaataaagtaaagaagtcaaaatagttgaaatagctatattaggcctaaattaaatatttacgcgctaaaatatgaaaaatcttagggagagtcaaaaatcacatgtctacagctgcccctctttgactggaaagacgtagtattttcagacaaagaatgaccagacaggttttttgacccgacccttatttggagaaactaatactaagagagaggggaatgtgaccgagctatggtatctgatctgcctacatatccttggctataaaggaatcaggacacgtgtagttcagaggtgagtgagatgatggagtatgccaaggtggagagccggtcgaggtgccgttccgccgaagttccggtccgcggtcctgttattacatcaaaatcaaaaggaatgaaaaagactaactaagtctgtcaactacgagttataagattcctatctataagtcttctgaagcttaatcttgagtcttgaatggttcttcatgcagactttggatttgaaccttggcgcttgttagctgcaggtgctagctcgttcttctatagctttttggatcaagaccgaacatgtagtgcttgtgacttccaccatgtcttaagcagttcacatcttccatcaacttctgcatttggattcactttttgcctttctctctttttcctttattatgactaacttctgttgatcacctcggactgttgactcgcatttttgccgcgagctccttttgttgctgacttgaattgtaatttgagatgctttccctttctccaggtggatacctgattgctgaactcgaattgtactttgagatgctttccttttctccaagcggacgcttgactgctgaacttgaatgtattccctgctctccaggcgggctcctaacttcaataaaatagacaaaaataaagaaaatttttctgccccaaattgggtatctgggcacatatgtaagtgtaaaatgaactacattaccaaatatcaataagaacttgaaagctaaaacttgagttatactcctttgttctccaggtgggctcttgattgctgacttgaaatgtattccctgctcttcaggtgggctcctgactgttgaacttgaatgtattccctcgttctccaggtgggctcctgattgctgacttgaaatgtattccctgctctcctggtgggctcctaactgctgaacttgaatgtattctctgctctccaggcgggctcctggctgctgacttgaaatatattccctgctttccaggcgggctcctgactactgactttaaatgtattccctgctctccaggcgggctcctgactgctaacttgaatgtattccctgctcttcaggcggactcctgactgctgaacttgaaatgcttctccctattctccaagtgggtacctgattataaaaaaatgacaaaacaacgaaaattttctgccccagtttggtaattgggcacatatgtgagtgttgaactgaatcatattaccaaatattactaagaatttgaaagctagatcccattatccagggggtcctgacaactcttaactaaacgacaattttaaatctaagctatatcctttaaaggtgtgacttctgctaaatcttgttatctaagaaggtctttaaactattccccattatccaggagggtcctgaaaatcaaaagtcaagttttatcttaagagtgacaactattatggctgaattatactaccctacagcaaaatttacgctaaatgttgctatctaatcgaaattttaaagctaagtcccattatccaagagggtcctgaaaactcttaattgaatcctatctcgaacatgcaaacttttaagccaacttatattcctttgggatgcatttatgctagattatgctatttctgaacatttaaactaggtcccattttccaggagggtcctgagaataaaaaatcaaacctgtttggtgactgcctttctttacggagggtttctccgaaacaaacgaaattttcttcccctgtttcaaatcaaagaaaaatcttgtcagtttaaaaatatggtggttggtttgtggccttgactttgaggacggttgctccttcaattcccatgataactttgatttccactcgaagaccttgcttgtttattgattaaccactttctctgtcacccttatcacggaaaatacttctgatctgttccaacccaatacccttcatctattgcattgtgctcttgcatgtactaaacctttgtgtttctcatgaatctcaaagcacgacaattgccacccactcattctgcatgttgtttttcttgacttaaatcactgaccctggccttgaggtctgttgctccttcacttgccacgataactttgatttcttctcggaggacctcgcttgtcactgattaaacacctttgtcaatcttaccacagaaaatacctttgatccgttcaccaaacccctccatcttgttgcattgttcatgaattgatatgcaccaaaccctaatgtttcaccataaatacctttgatccgtttacctagcaccctccatctgttgcattgttcctgaatttatgtgtaccaaacctttgtatttcacaagggccccaaagcatgttgattgttaccagctcagttcgcttgttgttctttcctgacttatgacactttgatgtattggccaaatcccgttttgtgcaattggaaagccggtggcaaattttgaagtcatttctcacttattttgaccaaacagactcaggaagaggaagtaaacaagacaaaaggaacagagtaaaggacaaaggaaaaagatgattcctaacaaaaaaactacaaagtagaaacctatcagatgtggacaccaactctaatgaccgtagcatgcacctgtgacctattctgtcaagtaggtctgatgttcaactcctattataccccaaaccgtgaaactggacttccatgctccgattatccaatctgattcacagtccttattcgatatgtagtgctcgaggggttttcaccatcaagcctctctcattctgttctttctctcaacttaccgtcgccttacgatgcccgcgagggttttcaccaataagactcttcatttttggatttctcccagctcttgtcgccctacggtgcccgtgagggttttcaccaataagactctctcattttcattatttttctgcttgtaccagagtgttgctcctgatatgaattacctctccttgcttgacttgtcatctctcgaaaactgatcggaaggtttttctttggaccgtaacgtgggctttttgatagggttaaaaagaaaggatatcaaaggctcaaaacaattcacatgggttcaaaattacaactttcggaatcagatttcttacaacaaccacaacttctgccccagtttcttgcttggggacttttggatttttattttgatgggaccgaaccatgaggctgcctacatatccttaaaaggaatcaggtcgaacgtagttcatgtcgtaggattgctctgttgttgtgatttttcttttctctttctcttttcttttctcttttgctttcttttcctctttttgttgtttttcttcttcttttttcttttcattcttttctttttcttttttttctttttttttttcgattttcatttttcttctctcccttttcgttcttttcttttctccttttcctttacttatctttcacgcttgtgtttctgatctttgctgctaattttgaaagaggggtatgaaagaaaataaacaaggctcaaaggggtaacgaaggataatgtgtttagatagtagaacaaaatgcctttatcattccaatcttcaaaatatgccaagtacaaataacacaattaaacaaaccaaggaagacattcgtaacatcttttgattgcgccagacttgatgaccatatccacacattcgccttctacatctgttacagacaaagcaccattggacaacactctcactctcactaccacgaacggccccctacaaatttggggcaaacttgccgttatcttcatccgatgcaacatgatgcatttcaatagtgtatttttatgttctatctgccccagtttcacacaattcgggcttgaagtgatctcaaaatgccttcacttatttccctccaatgtccctacatcttcaacattgtttcgttgcttcgtgactaaactaactttttaagaccatgatgagaattacgcgtgcgtgtcatgtcactagagtcaataggaaaataactataaaagtaaaagacaactaaacaaaaatgactaaaaataatagaaaacagaaaattgcattagatagatggtgaaagggtttggacaacaaaacaaataaactaaactggggtcacaaacctagaacaaacctagagaacactagtcgggctactatgactaaacaaactaggtaaaataaaaggatagaagggtttgagtcacaagacaatatccggattacaaccctgaaataacccggacaacagaaatgacaacaaaataaaccaccaaaattcctctccggctaaccaagaaaggagcgtctttccaattgccaagctcggcatcttagccactgaattccgcctcaacattactaggaccttcacaaacttccatcacattattcttaataaattgcttttaggttccctttgctggctcgttcttaagatcaacctctgatagcactgaaaactttatagcgcgtggaccttcgaggatctcagaagaattctcatattccttttcaaagcaaatcatactcaccatatgcgtctcattacgaacaggcgatggactttagctagtgtctgctgcatctggattttgcacgacaatgtcacctgcatcaataagcttttgaattgctttattcagattccaacacttctctatgtcatgccctggggctctgagcaatatgcgcacctttgagaaaaatcaaacttctttgacagagggtttggcatttttatatgaatcggcttcaacatgtccaattgcttcaacttttggaacaaactggatatgattctccaataggggtgaaagccttttcttttttcagcaacctctcgttcttaaatgcttgattgggccggaaacctaatctagggggttttcggtaggctcgtaggggtggataggcatttggtggagatgggtactgggaaagtgttgtacgattttaggagttccgtggagagaagtggcattggggaggatcatctagcgcacaaggatatccatagggacgatgtcaaggctggaattgttgatcgggaaagcccatcggatcatcttttctgtttctctttcttccacccaaacttactggggtgttctgaatgtctttcgaacaactcatgattttgcctgacttgattccctcttctactagcttccccatttttaacatatctttgaaaggccttcccaaggccgggatcaaatggctgaagtaggtgggcccctgggcttgtaggaaaagctcaaccatttctttttcaccaactggggtattgactcgagcagcctgctccctccatctgagcccaaactccctaaagctttcctccggcttcttttccattttagatagggaggagcgatctggggtaacgcctgatttgtattgaaagtatcgaacaaaatcttgagccatgtcacccaacgtaggccacttaccaacatcttagcgattatgccattccaacgctaccccaatcgggatctcactgaagtacgccatcaacaaatcatctttctctccaatacttctcattttactgcaataatccctcaaatgggctaccggatccccacacccatcatacaagttaaactttggcactttaaaccccgtaggcagacgaacgtcgggggacatagacaattctttgtaagacatgctaccctggtctcccgttcattgcttgttatttaaggactgttctatgcctttcggccccctaggtatcccatctcacccctttcttcctgtgaacttttcatcttcaacatgaggctcatctcgcgggccctgcttgtatgagttaggaaccttgtgggcaatctctgaggggtaatattgggcatcgtgagctttgagtgggtgttcattgttgggaatggtggataagacaagagggcaatttttgggaaaggtaattggaagatgggtgatagagctactagggtggttggaaaagccatgataagcgggtggatctggagagtatggggaatcatctggtactgtgaccggtgtttgggtaagggcagcatttaggaagctaggtggtggcgggggtggtgccttcccagtcatccaagcctgatacatgtccgccatgtgttgtcttaacatctttacctcttcaaccaacctattgtcctgttcaaccaactgctttcgggcaccggtatcaaccaactcagttctgttattgtctgtcattaccttttgactttatgttgtagagaagagttacccctttaaaaccagaaaccaaccacccttctactatgaatataacaaaaatgaagccatcacgttagcgttagggcatttaacataagataatctcacattatgtgcaatgcacctagccatagttatcggttctaaaatgacttcgagggtacaaaggtcagttgacatcatcccaatttgttcatttcaacctctcttttctttgcttttctagcacttgctagatcattttccttcctccttttctaattttactcttttctttcctctcatttctcacatcccacaatttcatctcttttttttcttttttttttctttttttccttttttcttttaacagtaaaaaaatgattcgatagaaccctatgtaggttgcctacgtatcatgacgccacatgaatcggatctttgcgtagttctggaagatcaggaataaaggaaataaactgacgttctctgtttctttttttttcttttctttttaccttaatgactactctgctgagaaaagagaaataaatgaagcaaatccttttttttgaattttctaaacttaatgttctataacctattttatactcaagcttaacggattttttttcttttctttgaaacaaaagatattttttgattcttttttttttttggaagaaaatctaaagagtgaaccacagaaaaatatttagaattttcaattgatatcctgatgcaaggtttcgaaacaagcaatgaaaaagataaaacaaaatatttttggatttcaattttgattgcctaaagaaaaaactctgaaaataaaccaaagaaaaagtattgttgttttctttttcttatatgtacaatgtcctaaagttctaataaaaataaaagaattttttttcaagtcatttttcatcaatttcccaaaaaaaaacctcaatagaaaatttttttggatttaatatcttaaaagaaaatttttaaagaggtactaaagaaaattctcttcgtttttttttgaatttttggtcttaatatactaaaggaaatataaaagcaatttttattttgacattaattgcctaaaggaaaaacaacctcaaaggaatttttattttattttctagaataagcattctaaagaaaatgtataacgaaaatataaaaacgcaattttttttttgatttttgacttgtaacacatttccaaatgcaaaataagaaatacaataacaaaagactatgcaaacttaactagacaatacaaaccctaacatcacctaaaagactaaatactactatgcaggactagaaaataaaacaaaaacaattgactcaaaaacataaaatggctcctcgagcggctcctgaatgcagtgatcctggggtatctgtcatgctcaaactccagtaagtagatccacacctgtatgagaaaacttaaaccaacactatgtgagacaataacattctctactaaacacatgcaagacatgattgaggctatttttgcaaaatgacttatttggccaaaaggtggttagaagtgcaaaatttggctaagatcctgcaaagccaagaacctatgatttactaggaagaccggaccctatgtgggttgcctatgtatcacgtcccgaaagacgagaatcaggtatgcgtagttcgggcagattggatacgggcaagaataataaaaaaaccactaatttatagaaatcacattatttttgttttttttttgaaaaatgacgaaacatgcaaaatctttttggattttttttcttttttttttgattttcgacaaatgatgaaaaagtgcaaattgtttttgaattttcaagcttttttttaacataattgggcccaactcgctttatcttcacacttcaccctctctttttctttttttttcttcttttctttcattttcattcgccctcaactaatattggtccgccaaatgacccttttacccttgaataaatgcaacatgtagcacataagatgcatcaggatgatcttttattttctggggtatacctgtcctagacggacccaacccctgtgttgagtcccctaagtcaagtgcacatgatggaaacaagcgttcctactagggatccggcatgaaactgagttattctaggttcaaaacctgggcagttgttctagacttgtgtaccccagcggacaacttgagccgaggatggggctacgtaccgggaaccaaaaggccatccgacttagtaacttgtccgagcctctttcttatttcaaggtatgacactaacagaatagggagtcttgactagcgagcacatcccgaagatgagaagagaagagtttcgtagcagtttatatacagttcagataatatcaaagcggtaaaagcaacatttagcacattaggcccaaacatgtgataaaatcagataacagataaaaccaaatataacaattcatctaagctcgaattttgaaccctaaaccagagattctgggttcgttccccatcagagtcaccagagctgtcacacctcctttttcctacaccccccggaagagggatgtataagggagttttttcaattaaaggacaatcgaaagatttatttattaaaagatttagagtcgccacttgggataatttatggtgtctcaagtcaccagtttaaaatccctaatcgaggaaaggttgactctgtattaaagtccgcgaacacagaaatccgggtaaggaattctgttaacccggaagaaggtgttaggtattcccgagttccgtggttctagcacggtcgctcaactgttatattcggcttaattatctgattttaaacacattttagcctatgattcaattttaaattttataaccgctttatttaatttttaaagaaaattacaacgttattaaaacacgtttcgaaccacgttacataaatgcacccgcgactctcgacatattctatctaacattgttgagatttagatttgggtcacataaatgcacacccgagtttagaaaggtagattattaaaataacgcacctaaagcaactacgtgtttattttttatgttatcaatttatcagaaatggtcatttctacctattataccgatacataattaaactatgacacaaatccaaactaatgtgatttaatccaaacagaatagtctcgtcgttatctcttatagtctatttatcactcttacgtgttttaaacattaaacctacgtctcaaattattgttaaggcgtatacttatcctggttccacacaacgaaagttaattcacacaaacaaccaaacatcaacagttaaggcatacactactaatgatatacgttattctaaaacaagcatcaacaaaaatgaagcagcggtgcaccagcaaagtccatcaaagctatttgaaaatggaataatgccgtgaaggaaggaactgaccttttaattaaaaaaactgaagtcttctagtacagaagaatctaaaatagtgagaaggatcccaacggaccttgaacggaaagccaacaactgactagcgcccaaccgaaacatacgtcagcgattctagcaggacctttactgaccgaaaaactcgatgacgacctcagcggcaaactcgaatctccgactcaacgactaaacggaaagcttgcaccagggacctcgacgaaccctacacttcaatatatggagctgtacggatctcgcaaacgaactccaagatggattcaacctagacaaggaaccagcagaatagtcatcaaaactcgaccagaaaaactcgagactcgccggaaaagtgttaaacgagcttttgaactcctcactgttttcagcgtgtacgtgtgtcgtggttgttttctcgtttgagctggtgatggagcttggcagctatggaagagttggttgttgtgtgtcgttggtttcagaggttgcgtctggagctcgtaaatctgacgagctgctggagctcgtttttccgacgagtttcaggcaactgcggtcaacgtttattgcctttttcgttattgggtgttgccggattttcctgcgggtttggtagcgaccggcggtgctggtgaagggtgtgagtgaagagggttatggggtttgttggtttttgggttatgttgctgaagcagaaaaatgaaaaaaaacggggagggggggggggaggttcgaagaagacgacctcgggggggtttcaaaagctgtgcagccttttctgtcagctttccctacaacgtcctctcatcttcttttttatttttaagcattaatttataggtagagcctaggtttaggtgtattttgtgtattttgcccattagtccctaggtcttttatgtattaggtccttagggtctttttgtttgtttttatttcaaagaagagtctaaaagggtccctaggcttaatggactaatccgacatgggccaagaactgagttctaaaactcttaaaattatgatccaacactttaatcgactccttttaaaataagataaaaatactacataatgcaaaagctaacatgaaactattatatatttttttgtattttcaagatcatgttaaaataaaaataaggtactatttttgtatatattttttatttaaactaaaatatttttttgtaattttccatttttatgacgaaaataaagtaaagaagtcaaaaatagttgaaatagctatattaggcctaaaataaaaatttacgcgctaaaatatgaaaaatcttggggagggtcaaaaatcacatgtctacagttattgtcgcgccccctttttccttcgcggagtccgggtttcgacattcatgggggaacaacttgttttcttttgggaattgggtgtttgaagagtcgccacctaatggattaaggtgcgttagggaacctaaagtaattaactcatgtaaccagtttgcattagggttcaaaataaccttgaggggaaggtgtttggcacccctcgcggtccacaacggtgggtcccgaccaaacttaaactatgtgaattagtcatttaacaagtaagcggtctcaacacatatttgcaaataaaggtagtttacacaatctaaacacatatacaatcaagaaagataagcgtaaattaaggaggtttgaacagctcgagcatacataaaccaaggaagtttaggaggtctgagtactcatatgtgattgggaaaaaggaagtcctaagttgattagcctataggatcaatctgtgcattgcccggtaatcctcctcaattagaggggctacatatgtcattagcgcgtatgtcatcatatccttttactacccactaccctccccttagtggttatacaagcgaatttgattaacgaactctaagcgtgttgttacccgtccctttcttgtggtctcggaggagtttaagacctctagacttaggtagttctagacaatcctaaggtgtttaaaatgcaaaaatctaggcgacaacaaataacatgtaggactgtcaaatatgaagcagatagaaggctcatgtttacttccacatatatataggcaaataagcaacacgtctcaaacacagatttttaggtaatttctgagaaatcctagaacagggtatctaggtgagcatcaaaacacagaacatgcaacattattcttaaaacgaagtggtagaaccttaatcagtttgcctactgattttaaaaacctgttaaacctgagcagtttataaataattagagcatagtttcttagtttttacaaggacattaatcacctaaggtttgcctaggcgtggggctatacataatcttagttatagggacgtttaaacaatttgaagttgtttcaacctataggcatgttgatttaagtgaacaagtgattttatacagattgctgctgtaacatgatacctatgtgtgaaactattttaacccgttttatttgagcgacataaagcaaatgcacgtatagtcctacaacaagatcactaatgcacatggagaaggttgtttattaagtagttttaataatctagtgacacgatttctaagtgatcgtgaattatacaaaatcagaaatagagttatggtctacctcatgtttctagtattcaaagtagtaaacgtgagtgctaaaaaaataggatatctaatgcacagatttagcatgatttaatgcaaacaaccatatcaatcctaagcatggtatctagtgcatcacacagatctaaacatgatttctacagcaggtcaacatgtagcacaacctagaaacatgatttctacaacaagtcatcgtatagcaaagactagaaaacatgatttctacccagttttatcccacataagcatatatctaccctctcttttcactatttgccccaatatatgtatacaaagaattattacagaccaggattgcataaattacataaatgaaatataaattagactatcgggagcctgttgcaggcccaaaataatactgggagtaccaggccttcaatggtagtctcaaatgccgagaacctcatagccaatgaatgtccaggtgtgtcagagttccctaaggacctcaaggatcccgggcagtgctcacaccaagaccttctcacaatagggactggttatgtgcagtgtggaaaggccagccccgttgtgccagagttcaaaggaatctcaggaattccaaggcagtacacacactaaaggggcagaacctaatgatttaaaagtaaagtgagagtgtttgacatagtttgaaagattcggtgaaaacagtgtagagacgactctaggagtgaaaaaggctttctaaaacagaaactagtttggtagtgaaaaatagtttgagaagagtaccaaaacacttttgaaaatagcaaacaatcaattggtcataaaacacccagattcataaatacttaataaacagatctcatacatggataaagggattggggacacatagaattcacattaagagaacacatgacagggctttgggaggcatatagacaacaaaatgcatagaacacttaggagcttatagaattaataggttagtcatgatggtaggtaatggagccatgttgaaagcaaagaagcactagacaaaatcagacacacaactagagtcagtcgaatgccttaaaatattaggtaactaacatgatttccttagtgaaggagaatagacaagggcgaatagacatgctggacaaatatcaaatggacaactatagtttgtacatgctaattacatattgaacaaagcaggattagacatactaagcaagggagtaaacagaaacacgaattaaattcataactaatgagctagtattgtaatgaaacacatagagtttaggtttcaaaatttaactaagacataccagccaaggaagagagcacagaatgtaaagcaggtgcagttcaatatctagccttggcttatagtcggctagatcagtgattatcacaagtagtagagaagaaaaaagagttttgagtgtaagtgtgtgtttttgaactgatgttcgtgtgttaagaactaaaacagaggagtttatatagtagttcaagagtatggcaaataaggtaaccgtaccaacttcagttaatcaaaggaagattgcagaatcaattgcacaaaaaatcagcatagtcttcccttaattaagggtaattaaccaacggtaaggatatgaaatatttaaagaaagaaattcaaatcagacttaggcaaagagtgaataattaggaatctaattaaggaaataaccgtgcaaggaatcagtagatactacatgcaattaaataaggcaagaaaaccaattaaagtcgtaaacaaggaaataatcaagaatcatgcacatgaattttttaacagagcaagtcattcaacaattctggaaagaatatatcaattttcataaataaaatacgctgggtaaaactttaggaacacagagaaattagacgaaaaataattcaaaaaaccctaataaagattaattaggataaaaattacaaagcaagaaatttttactaagaaaagcgtgtaaatcagaatacaaaatgaaccaatacgactagtaactttgaaaagatcagaatcgaagcaaaacatcagacagttagagttttagcataaatcaactagggtttatgcaactttagcataaatcagtcaagaacacttaagaacaaatagttaagcattcaataataagaaaaccttttgagaagacgacttaggataaaccctggtttaggaaaaatggaaaatcagttgaaaaccagaaaacttttaaagaaaacatgtaagatatgttcgattcgtctcagatctatatagatctgagaagatcggagataaaaattagggttttcgaaagtacaacagagacgagaacataggtttagaaaatcacggattcgtaacaaaaattcttactcaaggtcgagcaaatagcctgaaacaggcaagaaatacaaatgtgcacaacagacgtgcctaggtcccttgaaatctcctcaaggatctaggagacgaataagccatagcaaataggaggccggtagaggcctgaggtgaagaagaaacaccatggaataacagtataagcctgtgacagcggggaaattagggctctgctagagagcgtttgagagagaaggggaagagtgacggcgaagggaagggggtaagtgattagggtgtgtgtgtgtgggggggggggggttggttagtttaattatggtaggaaaatcctcgtctgttgataaaaaatgatcaacgaccaggattggctaagcattgggtcgggtaggtaaatgatttgggcctaaggttttgggataatttataaagaggtgttgggctggttttttaggctaaaattgaaaataaaagggctatttattaaatatccaaaacaattgaataaaattaatttgtaaaataattaactaattataaaaataattttcatgcgtagaaatgtttaaaaaataatttttagtattttgaaatataatggactaatttctggtaaaataacccaaaaattgcatgcatgggctaaaattgcagagttattgcaattatacccaaaaggtgccaatttggctatttgtgaaataatttggacttaataggaccataaatagtaatattaaatcaagaaatattttaaaatcatttgtgattcaattttgtaattatttatataaataaaatactagagtaaattaatttaaacatataaaaattatagaaaaatatccattgatgctaatgcatagttttgaaggtatatatacactttaaaatattatagggaaaaattgggtatcaacagttataacatgttatatctttctttgttgaatttacctctgataataggctagatttatgtaatttggcgattgtttatgccccaacttaattatgtttcaatgttataatatagttaaatgatgaaaaatgggctctaattgtgaatgtcacatgttgcaggagtgaggagcttgtatgaggccttaaagctgtgattggagctacattgaagcaagaaaaaaacccttaggagctgagtacgcaagaagacgagaaaaagaatagttaaaatgaaggtttggactagcgcgaccattagcacgtccactagcgcgacactagaccagatggtcgaggcagaatgatagggcattagcgcggccattagcgcgccactagcgcggccgcgctagcccagtttcggaatattaattttcaggggtaaacttggaagtctggggaaaattcacttaaactataaaagttcaagctcgcccaaggaggggctatgcagcttttcatagattagtgcaagaaaaggggaggcaagaggcaaggaggagaattcaacatcaagttcttcctttcttccttttgttttataatttgtgatgaatttgattattgttgtgttgaacactagtatgaatagctaaatatttagtctaaggtttgatgaaacctattgaaggatgaactttttgattatgttaatataatttgccattttaatttctatttgttcaactacgtgcttgttgtagttaattgacaggatcctcaattagctatgcctatttaatgtacataactcgggagagagtgcatatttaggtaattgttgaacaacaccacgcccaaaatatatgagagatcaataattgcgggtttaaaggttggattagggataacaaagccttgggtgtaatctaaagtgagctgtaataaataaaccagctagcgtaactcttgagagtgcgtctattagattatcgtgattactcgggagagatttacggtagtaagagtgctcaggattgatagagatgatttagtgaatctatgtgaagcataaccggaagggagtccatcaatatgggaaatcatagccttagaacattctcttaatagtttacaactcaattatagttatttttcagttgcttatttacattcattcgtagttagtagaaataccctcaattgttatttacaatgtttaagaagttgattccgtggaatttagtaagtctaacgataagtaattgataggttagttccttgtggattcgactctgggcatttgcaacgtctgcgtgtcctttatataaggcatagttgggtgtgatcaaattttggcgtcgttgtcggggaatttaacggtgttatcaattacaattgaaagaagtaaaaaaaaaaatcttagtgtagtcaattttctctatacccaatctttacattgaagttttaacgtttgttgacttggttgcacaggtgcatgcctagaaactcatcgagaactggtgaagtatttgaagcattatcagatctcgagaaagttttcaaggccttgaactgggccaaccggaaaaacaaacaacaacaaacaagtgaacacttcgagacagaaatgggagatcacaaagataacccagctataccaatagcgcaagtggcacctcttgtgccagaggcagctctctatgactgggcacaacccacaactgaaaatatggccacctcgattttagtcccgcagatacaggctgaatcattccaaataatgaataacatgctgcacttgttgcagaacaagggactattttcgggatcacaagtcgaagatcctcaacatcacttgaagaatttcctgtcaatctgcaaaacccaaaggcagcccaacgtaactccggaagaaatcaagctcctattgtttccattcttagtgacaggagctgcccagacctggctaaactcactccccataaattccataacaacttgggaggagttagtcaagcaattcgtgaataagttccacgcacccaacaaaaccgctcaacaaattgatgaaattttgagttttaaacagagaccaatggaaacactgcatgaaacataggaacgattcaaggggatgctggttatatgtccgcaccatggtatttcagatctgatgttggggcagcggttttacatgggattgtcagatagtttgaagaacattgttgatgcttcaactggcagagcattttttagcaaaacatggagagaaggccagggtctgcttgacaagatggcacagaattcaggatggataaccaggaatgcacctatcactccagtggtgcactcagggcccttagatctatccaactctatggctgaaaatatggccaccttattgacacggatgagcatactcaccaaaaaggtggaagagtcagggcagaagcagcaagtgcacattgtagatactaccaatgggggtttgtgcacatcgtacattagtcatccaattcgtaaccagtggaatgcaaaacatgatcatcatcactaccctgaagacatgaactatgtgtcgaattatggaggccagatactgggtggtcagaattggggccagcagaatcagtagtacaggccagcccaaccacaattcaacaatgggaacatgggaggtatgagaccccctaacaatatggcaccttacccaaggccacaaggatataataatcaaaatcagcagcagcatgatggaaggcaggaagatgggtttgctagacttgaagcaatgatgtgtaggttattgggtctaatgcaaagattagtgagagagtagatgaacatgattcagcgatcaagaatattgaaatgcagatgggccaaattttgatgtatctgaacaatcgtcctcatgggacactacctgcagacacccagataaatccaaaaaatcaaagctcgaagcagctgatggcggtgagtctacgtaatggcagagatttggatgtagagcaagagagggatcgagaaactagacaagcggagacactcataccagtgctcattgagttggatgagtcaacgaaactgacagaagtgacagtccagcctgcccaggaagaaaataacattcagattgagaccgagaaagaagctgagacaacccaggaaccagtagttgaggtggcagctgataaaaatcaatcccaaaggattgggaagaagagaccttctgcacccttccctcagaggctggctaagtaccaaaaggaggagcaatacaagaagttcttggagatgctgaaacaaatccaggtaaatattccattaattgatgctttgaaagagatgtctaggtatgcaaaaatgatgaaggacttaatgtctcgaaaatttgatttccaagacttggccacagttagtcttacttagacctgtagtgcaatggtgactagaccaattgtggaaaagctgtctgacccagggagctttacaatttcatgcactattggtagttttgcttttgctaaggcactgtgtgatctaggggccaacattaatcttatgcccctggcgatttataagaggttgggcattgaaagagctagacctacctatatgttgttgcagctggctgataggactataaagcaaccctcaggtatcctggatgatgtgttgattcgggtagggaaatttgtgttccctgcagattttgtgatcttagactgcaaggtagatgaagagattcccataattttgggaaggacgttcttggacactaggagagctctcattgattgtgagactgtggagctcaagatgagattgaacgacgaagagataacattaaatgtgcagaaatctatgaggcaaccaagtgaattcgccaattgctctcttattgatgtcgtggatgtaattgtagagactgatgatgagatgctgactattgaggaccctcttgctgtatgtctgatgaatttagatgaggtaagtggagaagaactggcagaatgggtgatggcattagagggtagagggttctgggatggaactcttgaatttgagcccttgcacttggaaaatagagaaactcctccagccaagccatccatcgaagaaccaccaaagctggagttgaagccactgcctgcccatatcaggtacgagttccttggacctgactccacattacctgttattatctcatctagtttgttagatgtgcaggcataacaactcttacaggtactgaaggagtgtaagactgccactgggtggaccatggcagacataaaggggatcagcccagtctactgtatacacaaaattctcctagaagagggacacaaaccttccagggaacaccaaagaaggttgaaccccaacatgaaggaagtagtgaagaaagaagtgataaagtggttagatgcgggaatcattttcccaatatctgacagcagttgggttatcccgattcaatgtgtacctaaaaaggatggcatgacggtagttaaaaataataacaatgaactgctctctacgagaaccgtcacgggctagagaatttacatggattatagaaagttaaatctagacactcggaaagaccatttctcacttcccttcatttatcagatgttagacagattggcagggaggtcacatttctgtttcctggatgggtactcagggtacaatcagatctccattgcaccagagaacaaggagaagacttccttcatgtgcccgtatggcatttatgcctttaggaggatgccctttgggctatgcaatgcacccgccacattccaaaggtgcatgatggccatattcactgacatggtaaaggacataatggaggtgttcatggatgacttctccgtagtgggtaactcatttgatgagtgcctgatatagtgggtaactcatttgatgagtgcttgataaatcttactcgtgtgctgaaaatgtgtattgagactaacctggttcttaattgggagaagtgccatttcatggtacaagagggcatagtcttggggcaccgagtgtcaagcaaaggaattgaggtggatcatgctaaagtggatgtgatcgcaaagctgccccctccaacttcaatcaaggcaatcaagagcttccttaggcatgccggtttctaccggagattcataagagacttctcaaaaattgccaaccctctctgtaagttattagaaaaagatcaccctttctcattttctgataattgcagggtagcatttgaggagctgaaaaagaggttggtcacaacacctatcattgttgccctcgactgggatcagccattcgaactcatgtgtgatgccagtgactacgcagtgggggcagtgctgggaaagtggaaagacaagttgatgcatccaatctactatggtagtagaatgctgagtggatcccagctgaactacactatgactgagaaggagatgttggctgtggtgtttgctttcgacaagttcagatcatacctgattggctctaaggtaattgtatacactgatcatgcagctctcaggtacttgattgagaaggagtctaagccgtacctgattcattgggtgctactattgcaagaattcaacctcgaaattcgtgactgtaagggcacagaaaatcaagtcgctgatcatctattgcaacttgaaggagctgaaaactcaatcgaggttgaagatattctggaaatctttccagatgagcagttgctcgctactagtcttgaggaagttctatggtatgcagattatgtaaattacctggtcagcggtatagctccctatgacctttcatctgtacaaaagaaatttttttatcgtgacagtcgcatgtattattaggatgagccctatctgtttagaatatgtgttgacaatatgatccggaggtgtgtccccgagatagaacaatcttctgttttgcaggtttgtcatgcatcggtatatgaaggacattttggaagggtcaggacagctgcgaaagttctagaggccggatctttttagtcaacagtgtttaaagatgtgcaccaatgggtgaagggctgcaatgaatgtcaatggaccgggaacattttccgtaaccatgagatgcccatgaacccgattcaagaggtggaagtgtttgatgtctaggggattgacttcataggtcctttcgtcagctcctttggcaataagtacatacttgttgctgtggattacgtgtccaaatgggtagaagctgaagtgtttcccactaatgatggaagagtggtggtgggatttttgaaaaagaacatattcacccgctttggaacaccaagagcgatcattactgacggaggcacacacttctgtaatagagctttcgagaagttgctcgcaaaggatgatgtacgccacaaggtgactatcccatatcatccccaaactagtgggcaggttgaagtgtccaacagagagatcaagagtgtgctaaccaagactgtgaatgccacaagaactgattgggcgaaaaagctagatgatgcactttgggcgtatagaaccgcttttaaaacaccaattggtatgtcgccatataaattggtgtttggaaggcctgccccttgccagtggaacttgaacataaagcttggtgggcactgaaacaactgaaccttgacattgaagctgcaggcacaacgaggatcactgaattgcatgagctcgacgagtttcgacatcttgcttttgaaagcacaaggttgtacaagtaaagaatgaagtggtttcacgaccagaacattgttgagctatatttcgaacccgaggacatggtactgctctataattcaagattacggctattcccgggtaagcataaatcacgatggtctgggccatttcgattggttgaagtattcccttcaggagctgtagagatcgcctaagagaaagactctcacacatttagagtcaatgggcagagattaaagttatacataggcatgaaggaaccaaaggaagtgtcagaggtccacctaatggaacctcagaggtcgagcgagccttaaatgcgtttgtctgcgtcgtgccacgatattaactaaggcgctggttgggaggcaacccaacgatagtagtagttgttaattgtgagttttaggaagtgctaaccaatgcaggtgacaatgggcgggtgataaagccatcgaaagtggtaacaacaagtggaaaatgtaaaaaaaattcctcccaagagcgcgcccgcgctataggctgtgctatttgggcaaacattctacccggcccgcgctaataggcaaacattctgcctggcctgtgctcgtgaacgtgctcctggatgcgctactagcgctatcgcgctcctagacgcgttagttccgacgattttttttgtgttatattttctgagttgttgtaattttattttttttgttagttgtaataaacccctcctttaatcccccaatcccacgccccactcccaattcccatgccccgattccaaacacaagagaaagagaaacaaaaccctccccaaatcctcttcttcatcaaatccccttcaccttcaactcccctcttccacaaatttttattttttttcaattggccccaagtctccaaccacattctcctccacctttcttctctgttcccctccttctatcactacaggtatgcattttagggaccatttttttttcttttgttccttttatttctgattttcatttttatttttattattgttgctcttgcctctgtttagtcgaaatttgtagtatttgttgtagtaactatggatggaatggtcggtggagttagagaatgatttagttgtgcttgtggctacattgtggtggtttttgatgttgtcaaatacttgaaaagggttgtgagtgcctaatgcccacaaggtctttgtggaaaggcctcaatgaacgtaactatgtagttgtgaccacttatgcatgtgaagtctgagtaatcgcaatgcgtcacaattttgtgttgggctgtgctaatgtgttcccgtttttcaggtatactgactccatctaggaaacgccgcgccacaggtgcatcttctagcagccaagccgactcgtccaggacacgaggagcagcccctacatgcccctttgatagcaccagatttgtctcggccaaggcttaggaccactttgcggcgaaggcctctaaaaaaccgattccggagaggggtaataacatcggattagtccagcagcactgccctcacatttacactgagatgttgaggcgggggttgaaaaccttcattaatgagccatgtgagggcaattttatggttgttagagaattttacgccaatgtgttggagcatgacaatggtgtagtcatggtgcaccgaaaggtggtgaatgcttctattgaggcgatacggacgacataccagttgccccatgttgtggttgattataatgacttttatgagtatgaccgtaacccaacacacgaaaagtgggagcgattctttgaaacaatctgtgtaccaaggaaggaggtggtttggatgaaatatggtgagaagtttcactcctcggcactaacctttgaaggaaagtgctagctgtatcttatcaacaaccgtctgctttcgtcctccaacactactgaggtaaatgggccccaggcaactttgatttggtgcttcgtcaatggtcacaacttcgacgtggccaaagtgatacatgaagagatgttcatacgctacctagtaaaaaggtataggttcttttcccttcttttgttactcagctttgcagggaagctcgggtgcccaaaaatctagctgtggatgggctagtaccaagagaccacaagttctgggctgacaaggtaacaacgggtaaggagccggcggcagtttagggggaggataatagtggctctgatgactcggacgaagaggaggacgaacaggaggatgtggaggccgaaccacaggcccatgagcacagtgcagcagctgcagcaccacctaggacttcaacatcctcccagccacgccgtagtacccgtatgaccgctttagagcaggatatggctgggttgcgtacctccatcactgatttaggtgcccgcgttgacgcgatggctgagcggtaggtgaagtcagaaaagaaattcttaggctggcagagagctctgggtcgcacatgcaatgtgaacccagacaccgtctccgagcaggagtgatcctttagggaagttcctttaccttactactctttaaattttggtgccatgaggacatgtctacattttaagtgtggggtgggggatacttcaatgtatatatgtaattgtacaatttaactgtttgatgtctctttgttttgcgttgattgttttcgatgtttgagtaatagtttcattaggttagtttaaagtaggtaagtggcttgttccgacaacggatctctttcggcgggattcttgagggactaagtcgattgaaaaaaaaaaggaaatatggagactcttcctgatgatgaagcctttagacaattttcttgagggaagtaagtctagagaaaagaccaaaaagattttttttaggtagtgtagtaaccccccattgggttttctttgggccacggttctttttcaagggtttaacttgaattgggtataggtagtttttgttcattttgttttctttttagtagattaggattaataggctacgagctaaaatcgaaagttaagcctctagcgttgatacacctgaacacaatagacactagagtgtaacacttagtctcagtagttgattcttgctaaagtgccttaaaaattgtatgtttgttactgaattgaatactcagaagagagtgtcttgataagccaatctggaataagtcatgtgccatgtgcgtgtcagttttattgtattccatgattcacatttgatgcctagaacttgccttgtgtgtttgcaaagcgaaatagtagtttcattcagtcctagaagtgatataggcatttctttattgagccagacatataaagtaaacctacctaactgtattacatcttagttaaccccattgagcctataaacctatttctttggcaaccacattgcgaaccttacccaattatttgaatagcctgctgtttgaacccttctacctcccataagcacttgaatggtatggaaattatacaaaggcaaaagtgtggggtggttctttggtttttgagtggagccgttgaaatagataaaaggtgcagtgtttggaaaagtaaaagaataagcaccactgaaaaaaatgaataaatgtagtaatcgataagtggtggtttgttataattacatccaatggatggggttgttgtaaataaaagaaaaaaaaatggtgggatatttggttgacataagtatggctttgaatgttaatgtaattgtattaaaaagtgcttagggaggttagtcactatatccacatatatcctacccgtcccttagcctacattacaaccaagtgaagacctattgatcttatactgagcgggctcgattagtagagtagtacactacgggcaagcctatggtgcatctttatggcatgtgaatgttcttttttgagagtgagctagttttgtctatctaagttcctaattgttctaaacatcactatatgtggaactactctcttgtgtggtgcgggcatgtaattcatgaaggaagggcaagtcttgacttttgcgtagagtagtttgagaaagtatgaatattgcacgacacgtgagagtcgacttttgaggctaagattgttcactactaggtgtaactcatgtgatttgttcttggtgtgatgcgttaaggaagaattcttagtgaaggaacctctatagagtgtggtggactgctcgaggactagcaatgatttaagtgtggggtgttgataatagactagatttatgtaatttggcgattgtttatgccccaacttaattatgtttcaatgttataatatagttaaatgatgaaaaatgggctctaattgtgaatgtcacacattgtaggagtgaggagcttgtatgaggccttaaagatgtgattggagctacattgaagcaagaaaaaaccccctaggagctgagtacgcaagaagacgagaaaaagaatagttaaaatgaaggcctagactagcgcgaccattagcgcggccgcgctagaccagatggtcgaggcagaatgatagggcattagcgcggccattagcgcggccgcgctagcctagttccggaatattaattttcaggggtaaacttggaagtctgggggaaaaaatcacttaacctatagaaggtcaagcttgcccaaggaggggctatgcaacttttcatagcttagtgcaagaaaaggagaggcaagaggcaaggaggagaattcaacatcaagttcttcctttcttccttttgttttatgatttgtgatgaatttgattattgttgtgatgaacactagtatgaatagctaaatacttagtctaaggtttgatggaacctattgaaggatgaacttcttgcttatgttaatatagtttgccattttaatctctatttgttcaactacgtgcttattgtagttaattgacaggatcctcaattagctgtgcctatttaatgtgcataattcgggagagagtgcatatttaggtaattattgaacaccaccactcccaaaatatatgagggatcaataattgcggatttaaaggctggattagggataacgaagccttgggtgtaatctaaagtgagctgtaataaataaactagctagcgtaactcgggagagtgcatctagtagattatcgtgattactcgggagagatttacagtagtaagagtgcttaggattgatagagataatttggtaaatctatgtgaagcataaccggaagagagtctatcaatagggaaaatcatagccttagaaccttctcttaatagtttacaactcaattatagttatttttcagttgcttatttacattcattcgtagttagtaaaaataccctcaattgttatttacaacatttgagaagttgattccgtggaatttagtaagtctaacgagaagtaattaataggttaattccttgtgggttcgactctgggctaaatactcagattatatttgcaacgtatgtgtgtcctttacataaggcatagttgggtgtgatcaacctcacatgctataattgatttgttagtccatgttctatcttttattgccaaatttacccttatatactttaattgaaattgttgcttctttcattgtcacgttatctcttccataaatgatttattcttatttgaagtcgttgctacatgttatctatctcattgttgagttattattatttgaatttattattacttgttatgtctttcattgttgagcttattctcccatttcattgtgttgtcataattctcgtgttaatttacttgccgtactctcgtgttattgttgtactcagtgttgttgagtcgtgggctatgtgtggttgtgatattgagattgttgttatggaaatgttgcggcatatgggtacatgtagtgtgagttattatattgcgttgttatgttttagacacatgtcaaattgtttagaggattgtcggggtgtttgcatgtgagttgttcgtgctattgttattattgatattttcacatgcggtgtgataaggcgggctatatatgttgagtttgcgcatgtagggcatgataattattgatgcgcgtgtggcgagacaaggcgggcatttactttactattgtgcatgcaacgagacaaggcgagctatatcatggatgatttgtgatggcctgggggcattgtctttgatgatatttgtgtggtggtttgaccatattgtgtgcatcatgcatattgtgggtttttttgtattgtttccaatgtgctattcgatatctttgatcttacttattgactcgagatgtgatagtacacctgcacaagcatatatcgtaatctgtcacctatatcagtccatgagtataattctcgatgtttattgatcatgtacatgtattcttgtatatctaccttatatgtggggactgaactgttggcatgtaggttgtctgtgttgatataagacattgttactattgacacgtgagttgtccgtgcggatatgagtttattgttaatagaattagcacgtcagtaatccatgcgggtatggggttactgttaatagaattagcatgttagttatgcgtgtaacatgtagattgtccgtgcaattgtgctttataaagtgggcaagagatgtcgcgtgattatgattcgtgagttgggatttgtgaaattgtggtatttcgatatgatccttgttgtgcattttatgttgaaaagctcgatgagttgaatgattgtggttcttgttttccttacttccttccattcgtattttttcattgttagattatatcaatgtcttgtacatgttttcatgtctagtaggtgtcttgacatgacctcgtcactactctaccgatattaggcttgatacttattggataccgatgtggtgtactcatgctatggttgctgcacatttttttgtagatcaagtaccttggagtatgcaggttgttggttagttgattgtgagctgatgtggagacttcaaggtatacaggccatcccgttcgcaagcctcgaagtcactttctgttgttttctttaccactatttatttctatttcagaatagtttgtacttggagattcttctaatgaattcaatagagcttatgacttgtactactgattttgggatattgaacatctattgatggttgtaggctatgtatagaaatttatggttcatgtttaatagttgattgctttaaatctattaatatctcgatatgtgttaggcttacctagtcttagagactaggtgccatcaatattagaagggatattgggtcgtgacaaaaagtaaatctctcatgtataataaaaaagagataaggtcataaaacaaaaaacaaagtaattatctcatgtgtaaaaaaagagatggagtcataaaactaaaaacaagtttataaagacccacaacatcatttgatccttatttgatccttagagttgttaattcataaagttatattaatgtcaatgaaagttggttgggctatttgtaacatgtgggttaaagattatgacatatattactagtgcaattatgaatacatgggattggttaccttgaaatacatatacaacacagcttgcatagttgcaagaatattagcggtggtttggtaggatgcactagagaaaataatgcatgcattagcttttggtattactaatttgttgtttgatacactttttcagcctatgtattactaatgcaagtattagatatataacatatttggtattatcctatgtaaaactaatacatagcaaaccatggtattagcaataccaaagctattaatgaatgcattagcatggttaaagataaaattgtccttataatccttcaaagctgaataatacggaggacattttggtatataactaatttttaaaaaaaattatgcaatgcattcttgaagtggaggttagcgtcgggagtcttgtgtgacaagaaagtgtcaccgttactaaaaggtaagttttatacggcagtggttaggcctgccatgttatatggaactgaatgttggccggtaaagaactcacacatccagaagatgaaagtagcagagatgaggatgttgaggtggatgtgcgggcatacaaggatggataagattaggaatgaagatattcgagagaaggtgggcgtggcccccatggaggacaagatgcgggaagtaagactcagatggttcgggcacattcagaggaggagcactgatgcaccggtgaggaggtgtgagcgactggctgtggtgggcacgcggagaggtagatggcgacctaagaagtattggggagaggtgatcagacaggacatgactcgacttaggattactgaggacatgacccttgacagggaattatggaggtcgagcattaaggttgtaggttaggggaaagttgtgaatatttttacagcacaatagagtgagactagccagttaggagttagactaagaatgtcattggtcgtctattgatgcagggctttacctgctagttttactataccagccatctatttcgtatttcatattttgtatttcatatctcttatattgctgttattttattatgcatttttatggtactaatatatcggctcatgttgcttttttgagccgagggtctcctggaaacagcctctctacccttcggggtaggggtaaggtctgcgtacatattaccctccccagaccccacttgtgggattatactggatcgttgttgttgttgttattgttgttgttgttgttgttgttgttgttgttgttgttgttgttgttgttgttgtatgcaatgcattctaattttcaatacactactccaaacactagataagaagtaatctttgcataactaatatgttatttgaattggcttttaaaaagtagcttataagctaaaagccataagttggtaatacctaacatttaacttttggcttatttttgtatatttcatgtctaaaagtaagtgcttttcagcactttttatcattgccaaataacacaaaaactaaaaaagtgcttaaaagccaataaacacttaaaataagccaatccaaataccatttaatacttgcattactaatccctacattactaatataacttattcaaaattatttttatacaccctaccaaacgaccccttattgtaacacttcatattttactattttagggatcctatatgcaccacttttatagttagagaactatttagagtacctcagtatactttagggatcacttggaataaatgctaaaacttaagggaccattctagacttttttctcgacgacgacaacgccagtaaagaaatgtatataataaataaataaataaataaaaagcacaacatgtacgataagtccgggatttttccagattaggttctctaactcctctctctctctcacacactcactctccctccctcgtgtactacactcagcattggggctagggtttcaccaaatatctttttcacaaattatcttagggtttttgtctgttcttcacaactgatttatgataatggatatacggatgaattaagctttttcgagggattttagacttataaaaaactaaagggttttttgtaattgttgcttgaaatggcggatttgaacccatttgatttgctgggtgatgatgacaacgatgacccatctaagctgattgccattcagcagcaaaaagttgataccgctaagaaaccctctgctccggcggcggcggctaagaagcagccggctaagctccccactaagcctcctcccacggctcaggctggtgagcgtcacctcagtttattatgttctcatattttgtatattacctaaaagtagagaaaggtattagtatttcgatcatgtttagtgtattgagttaagcagatattccatattgcgcagatagcgtgattaactttttggatgttgatttcaacgtctaatcaattaatatgacaccaacttggtgtattgcttatgcaatactaacattgatttatcaaaacggaagtagtcatgacgtacatagacctttaaatataacagtctatacgtgtgacaccatagtgattagaagtgctaaaagggactaggtttatttaaaatcacacgaggaattgtctagaagaaactccattctcttaggattgatgtgggctcaactaagagtatgagagaatcgaagcaaagtactcgcgcagatgataccagctatttaagattcatgcttagttgttgttgttgttcacacctacattaggtcgaggtaaggataagtgtgatagaatctctaattttccttcaattacttagcagtatcagcatgaaattgggttgaatacagtggaatatatagaggattcatgtcattaacccgaactattttgggattgaggtattgacccaaaaagaaaaggaactagtttgagaatgaggcataatttattgatataagaaagaaaatataatgagttaaatactccaattttaagagggaagcataagattttgtaatttggacctttatttattgaaggattggctgttgtgtcctatttctagtgtcacttcaaaagaatgagaaataatcccattcctgctgttattgattcctcttggtcttgaaatttcagttgttcatcatacgtacatacttttttatattccacacaagatgtctgacggtgaccagttctctgttattctatttccttattctcataatttttgctagtgggtccacttgaataatgatatggatgaattactttttgtttatatcttttgttatagtcattgcacttatggttcttttcctctttttcttttgcaagtattcagaatttacttattgcttctttgtttcaactgtgtagtcagggaggcaaaaacagaggttggacgtggaggaggtagaggtggtggacgtggttacagtcgtggtcgtggtggaggcgggtttaatagggaagcatccaacaatgagaatttttctcgaaacagagaattttctggtggtatagctgcacctgaagatgtggaaggaggaagaccctatgaaagacgtggcggttacggtggaccccatgcttttggtggtggtcgacgaggcggttttagtaatgaagaatttcctgagggagaccggcctcgtaggatatttgagcgccgtagtggtactggccgcgggtagacacacctttcttgtctgtgttaccatcaccttttgttgctgtatttgtaaagctttcttacttttccttcgctatacgagcagaggtgagataaagcgtgaaggagctggccgaggaaattggggaactcaagcagatgaagttactcagtgagttttaccttcctacatagtcctaaacagactagtgtgaacatcatggcacattctatctattgattatggtgttgatttgtttgtgttgtgtattataggattactgatgaagttgctaatgaaggcgagaaaaatctgaatgtggagaaaccctccgcagatggagaagcaggagacgacaagaaggaaaatccagctgctgaagctgaggacaaggaacctgaaaataaggtgaaccttttgtatcatactcaacacattattgataggaccttgacgatccctgtgttgctgccttgtttgttgacacatgtcctgctctgctctagaaacagatgcttaagagagcttgagcagtcagaatttaacaccttcctttttgatggcttcgtgctcaattggagtatgctaaatcaattgggtgtttagtatatgctatgacatgcacttcaccaacattgctgatgcagttgctctttaattaaaagaaggtttctgaattgacatggtttttgcttcatatattgtttcacttaatttcaattattttatctatatattgttgtttgtttttataatataaaaattataatgctcacctgtgctattagttattttttctgcagtactgtatatattaaattcttttcccttcgaacatacatgccttcgctgcagagtaggtgttttagttgcactttactttatgtatttcgcttcttacaatattgaccgtaaaggtagaagcagaggtttcatcagtagtagaagctttccaggtgttgttctagctgtggtagaactagtacttaatacatagtggagttgcaggcgatagttaataggtgttacatgtgaatgtaactcatgttccttgaatgaataggagatgacccttgaagagtacgagaaggtgctagaagaaaagcggcaggctttgcaggcacttaaaactgaggaaaggaaggtcgacatcaaagaatttgaatccatgcaacagctttcaaagaaatccagtgatgacatcttcatcaaattggtgaaattcttgagacattatgccctctactcatgcttgatgctagttatctataaagcatctcttgaaatacttctatgccatgatttttagggccccaaggataagagaagagagtctgctgagaaggaagagaaggcaaagaaggtacttattcggcatatgcgttctttcctgacaattgtttaaccagcaaatgcttttcatacactgctcaatagtgatttaccaagctttatgaacaatgcgtccagtctgttgcaattgttatatgaacaatgcttccaatctgttctagttgttattcttgctatacaccacagcagttatttctacttttctggatgctgttgcatgtgtgtcgatgaaaatggtatcatgtaacaacattgttgtagagggaatatttaagttgtatttcttctaaagtcgggccttggtttctttcagattttctggtaattgtttgacttgcgaacatatagtaattattgtagtaccatgctacaatttttacaataaaattccattgctcactcttatacatgtgcatggacaggctggagttgattgagatgagaggtgtcaaatcagcagaaatgagaatcatctaatctttttttcccttcttctctggctttaggcagtcagcattaatgagtttctgaagcctgctgagggtgagaggtattatgcacctggtggtcgaggtcgaggaggtcgtggccgtggttctagaggttatggtggaggttacggtggagccaacactaccagcaacgtggaagcccctctcattgaagatccgggtcacttccctacattgggtggcaagtgatgctttattagtgcttttctcccacgtccaagaggcaaattgactgaaaaataatggagtgaaagggtcaatgtttctgatggccttcaatgtaaatttcttgccctcatgcagtacccctctgtagtttttttctttatgttgtgttacttttctgatatattggggtatatgaagcacattaatttatgcatgagctttttctccgcagttccgttcttatattttgtatcgcattctcattgacaaaagatgggagggtgctcgtgttctgatttgggacaaaacacctttacaatttacattatttgtgttgggaagtgataaaagtttaatagccgtgacactaatgagtaaccgtaggggggacggttagtgcaaatccgtggtgaggttatttgacttctcatgttttgtccatactctatattttttttcaaaaaatctgatcaccctggccttcacctcctgtggtgttgaagcgtttggcattgaccctttttgcttattagaatcaaaaaaagattccaataagaaggggaccttatatgtgttcgaaactgaccaaagctctgatagcaccaaagagtttataagttcatcctcttaatgaatcttaggaattgctaaaaaaaggaattaatcacttgtccttttcatctaatgaagtgttcacgctatttcctttacaaggtccaatgttctatacacttcatggacctgctctgccggtcttccaccattctgcgacactactttggcaaaaagaaaagattgtatactaggctcaacagaagcaacaaagtgaagagaaagagcgcgaacaccttcattatgagaagcaacgtgactaactattttggcccgttaatttcttcatatgcataactagaacaatttggatcgtgtactcctataacatagtaaaaaaaaaaaggtgttctggtaaggcggtataaggcaattgtatgttctctatccctataagcatagattgccatattctcgctagagtgcaaaacaaattagcttaggcgctaacacgctgttctcatactgttgaaatatgagaaatatatttagacatatattgagaagaggatcatgccgaccgagcagacctttgagcttagcacatttttgtggcaggcgaagtgctgtccctttggggacatccgatgacaaaaaggatcttagtcaccagacgtttgagtgcgtattcatcttcgccagtatagcttcatgttgaactatgagaaatatattaagatatttgtcaagctgaagcagggctaagttgtcaaagttcaacaatcgttatgttcacaatttgtacacttcaattaaaaaatctttttaatcaagaaaaaagaagatacatctagctgtaaggattttgcaggacaagtccacaagggtaaacattgcttgtgattagtgagattacagtagatatgtcatggatgagccatcaagcaaatagcggaggttctcttgtagtcaaaggactcaagatgagcagcagccactattctgagcaacaggctgtccacgaatatttacagttggaggcttggcagtacttgtggctggttggcttgccatactgcaataaggagagcaaaagagaattgaaataatggaattttgcttgttaagaatgaaattatggaaatttagagaagcaacgcatatgccagctcaaatcataaatgtaaatgaaaagattatttggaggacattttatacaagggatgaggccagaaccaaacaagttgctgtatctttcatttagattttttttttttggcttgtgaaaatgttatagggggttgcacgaaatgatccatgaccatgtttaaatccattttaaggcatcaaataggatcctaactgtaagatgattatgtttaccatctgaaatatctctcaattttctgtaccaaccataatgtcagaaaaggaagtgataaaaatatatacgtatccctctcccagaaaattttagtaattgaatctgatgaaagatcaggccacaacttggaaaggctatacaagacaccattgaggagcactatttaaagaggatacacttttacctattcttgatagcagaagtcatagccatgaaagcctgttctacgttactagcatctttcgcactggtctccaagaatggaatcccaatttcatcagcaaaggcctaagaataaatttaagtagatcagtttgttttacatttaaggacaaaggataattaaatatctgcacgaagatgattcaccttagccgtttcatacgacacaactctattagctgcaaggtcagacttgttcccgacaagaatcttgttaacatttggggtagcataacgatcaatttcattcagccactgcttcacattattgaagctctcctgatccgtcacatcatagacaatctaccatagaggccatgcaaagaaaatgtcaaaaggtacagaaagcagttggcattagactctacagataactacttgctatttacaatttcttataaaaagtaaggcaactactcactattatgccatgggctccacgatagtagctgctagtgatagtcctaaaacgctcttgtccagcagtatcccactaaacagtgtcaaaatagaaaacaacaatatcttgatttcatgaaaagttcacaacacaacgaatatctgtaatatgaaaggcctgaagcagaagtgcaggtgaagtcttacaatctgaagcttaatggtcttcccatcttgctccactgtccggattttctacatgaaaatatttgaacagttggtaagatcagtgataacataaaagtaagagtgctctggctgaaaaagatcacataagattccaactgtatgtaaaattgagtagctcataaacaattaaagcatcttacaaaatcaactccaattgtgcttatgtagctctcctgatatgtgtcatcctgatggtaaaaagcgataaaatagtcagccaacatttgcagaataaattttttaaccacattgaactataatctgataaacttttcagcagggtgagaatctctgagttgaactataatctaataaacttttcaggaggttgagaatctctgagttcacgatcaagaatctctaacaatgaaagcgacgcaaccagaaataagttcataactaatcatccagatgattaaagtgtgaaaaataaatttcgtgtaaaagaagagtctcaaatatcatggcagatgtagctttttatgagtaggtgattcataatttcataaaaagcaatacaacaactccaccagggtcagtagactctactagctggaaaattaaggattattcaagacaaataattcactccaagtggagaatggaactgagaaatgaagacatggagaatccatggctgatgctccataaatcctccatttgtttagtcaatcaggaatttagtaggtacgttcagacaggtaaaagcaggactagagaaaaaagtcagtatagacaattccaagatttgaaaacttacagcaaatcttaaaaggagacatgacttcccaacaccagaatcaccgataagcagaagcttgaacaggtagtcactgccggaaagcacaaccaatataattataatatacatccattagctggcaaatgtgcaaagttgtatacttaagcgctacccggaatgaaaaaactaaatcactaatagaaacaagcgctaacatcaatatgagagaagtttgttaccttgctatatatgcgtaatttagcaacatctactggtcacattgggattaaatttggtagtcctacttgatttggctataaaaatatggaagggcagaagttctacatttacgtattattccctagatgttcaaacttactatactttttagtaaatattatttcacatatttatcaacacaccaagacaaagtagtctttacattatagaaatcatcatgcactgttggatgatgcagtctaagtatggttagattgatatgtatgatagaatttgcggaagagattgtctaaggattgtacctcatttgataggctaaaatgatagacatgagataattgacctgccatatgctatcatctacaatcaaatatagcctacaagttccaacattgattatgtttggagtaaatattttgcatcttcttgatgccattattgaagtcaattacttcataaaaaacacagatcatgtttggatgctcttttctaggttgcacttgatatgatttaatgctgcatcacgaacacgtaatcctagttatctagaacatctctacaccaaaggaagaccaacaaatatcggcctatttacccaaaaaaaactgacttaggaggttactagttggaccttgtgcaagcatgtgaaagaaatattacaccaaggaatttcaaacgatctgagataaccatgaaagcaatgttgtcaatgacaaaaaataggaagtgccaagtgcctacaggaatttaacagcaaaccacaactgaagtgcgcactttatgaagaaaggcgcgtatgaaaataaggtatatgcaaggcaagaaaaaaaatagtagttgtaaatgttaatcaacaactgcaattatatagacttactgaaaaagctgcaattgagtgaattgtatgaagcaagaaccttcttcatcaagttcaaaaaccatttaaaatctctaatttaaatataaaagatacagttttgagttttgaatttaactggtgactagtatttttaatactttttaagtttccaatttaccatttcctgaaaataacttctattttttgggaccgattgaaaaaggaataagttattaagcttaatgttgattttaatcttctcaaacgacgttcgattgctgattttagtgaattagggattataggtgaaatccacaactgcgataaagataaggatgttttgacaaaatccacagttaaacgaataagtattgaaacgaaaagaactagaaaaggaaattgaatgacagaaactaatatgaagagatagttcaattcttcaccaataagtattgcaaaataagcaaaggaatatgccgacggaacttactattctggattcatggagactaaaagcagacggaagtcgccggaatattgagagatctaccggcgagaattggacggaatttgattcttcgcggcagaattcagatgcaaaaacgttgaaagaggctgtgggagagagaaagagaccctgcaatgaagacacgtaaaaggaaacaatgacaaaaatggtcctttatgtttgggaaggtctaaagtagtcccttaaatatacatttaaatagttttagttctttaaatttatcaaaatcgagcaattttggcctctattaaatatttaacaaactacggtagttaaattaatgggaaccggaaaaaacatttgaaggtgcatattttgaagtttttgctatttttgtctatttctaatgtcgggtgcagtttttgaggttatttagttcgggtctttaatattagaattaggggtgtataaaggaaaacgataaattgtactaaatcgataatccgagttaaaccgaaaaaaatccgactatggtttgatattaggaaaaaatccaaccataattggtttagtgttaggaaaacaaaccaaccataattggtttggtttggttttaactaaaaaaagtcaaaccgaaaccaaaccaatctgacattatatgtatacaagttttaaaaatacttttataataaaaataattattgtaatgtaatttataaatattttttaactctttaatagttctctcttttaatgttttatttcaagcttgggtttagaacttttgaatggtcaaatatgttttataactcataaaagctagtaactcaaataaagcccaaagcaaaatcaaatcaatactaatgctaacaaaaaaatttcaattcaatactaggaataacgataatactggatatttatttttttagttttgcattgacttagatagtgaaaatgcataacctacttttaatattatttagtcatataattaatggggtagtacttattagtcgtacttattttaacatgatttagtactttagattatttttttatttttattatggcttattaattagcaatatctatcttatacgatttgttgagtattttagtataatcatgactcatcttatattattttatattattttagcaatatctatcttatacgatttgttgagtattttagtataatcatgactcatcttatattattttattggatagtatcttatatagtttgatcctactaggacctaagaaatattacagcacaaattataaattttatgttatgaagattttgtcggaaaaaatcccgaaaaaacccgaaaaatccgagaaaaaccgcgattggaaaatccaacttttgttggtttggtttggtttatagatttaaaaattcgagacaattggtttggtttgataattaaaaaatccgaaccaacccggcctatatacacccctaattaaaatatttgatattccaatttctgatgtataattgtaatattttggtgtttcttgttaaaaaaaattcttccaatatcaattaaatctaacaactagacaaaaaccaaacgtgcttacttttgacaaacttggtaaggggccatttttgttatttctctaaaagaaagcattgattattttctcatcccgcttattattttaataaaataataagtcatatcatgagcatgaaatcgagttgttaatagataaaagacaaaatcaacttttaagccaaatattgatgacaatatgaaatttactgatacgctagctacaacaacaacaacaacaacaacccagtgtaatcacacaagtggggtctggggagggtaatatgtacgcagaccttacctctacccgagaggcagagaggctgtttccaggagaccctcggctcaaagaggcaacaagagacactatattagtactatcaatagactcataataaaacaacataaaataccatgaaatccataacataacataaatgccatataaaacaaagtaacagcaatataagagatataggaaatacgagaaagatataaggtattaatacacaacagataaagcccatcatcagtagttgatcaatagcatcctaagactaactcctaactggctagtctcactctagtgcgctgtaaaaaagacatcacaatttcccctaacctacaaccttaatgctcgatctccacaattccctatttagggccatatcctcagtaaccctaagtcgcgccatatcttgcttcatcacctctccccaatacttcttaggtctccctctacctctcttcgtacccaccacctccagtcgttcacaccttctcagcggtgcatcagtgttcctcctctgaatgtgcccgaaccatctgagtcttgcttcccgcatcttgtcctccatgggggccacacccacctctcttgaatatcttcatttctaatcttatccctccttgtatgcccgcacatccacctcaacatcctcatctctgcaactttcatcctctggatgtgtgagatcttcaccggccaacactcggtcccatacaacatagcaagcctaaccactgccctataaaatttacctttcagtaaaagtggcactttcttgtcacacaggactcccgacgctaacctccatttcatccaccccacccctatacggtgtgtgacatcctcgtcgatctccccggacccctgaataaacgaccccaggtacttgaaactacccctcttagggatgacttgagaatcaagcctcacttccactcccgcttccgtcggctttgccccaaatttgcactcaaggtattccgtcttcgtcctgctcaacctgaaacctttggactcaagggtatgtctccaaacctctaacctctcgctgacgccgcgtcgtgtctcgtcgattaggactatgtcatcagcaaatagcatgcaccatggcacctccccttgaatatgatgtgttatagcatccatcaccagggcaaataggaaagggctgaacgcagacccttggtgcaaccccgtaataaccggaaaataatcggaatcgcctcctgctgtcctaacccgagtcttagctccatcatacatgtccttaatcgccctaatgtaggcaaccagtacccctttagcctctaagcatctccataagacctccctaggaaccctgtcgtacgcttttagatcgataaacaccatgtggagatccttcttcttatccctgtattgttccaccatcctcctaataaggtggatagcttctgtggtagatcgccccggcatgaacccggactggttgtctgaaatagacaccgtccttcgcactctcatttctaccactttctcccaaactttcatggtatgacttagtaatttaatacccctatagttgttacagatctggatatcgcctttgttcttatacaacgggaccattgtactccacctccactcttcgggcatcctattagtcttggatataacattaagcaacttagtaagccattccaaacctgctctacccacacacctccaaagctcaaccagaatttcatctggtccggtagctctgccccttctcatcttatgcattgcctccataacctcatcgacctcaatgtcccgacaatcacttagttcatgggggctgtcagcgttcctcaattcacctagtataatatcctgatccccttcctcatttagaagtttatgaaagtagatctgccatctcctcttaatctggtcatcccccaacaaaactttgtcgtcctcatcttttatgcacctcacttggtccaaatcccgagccgtcctctctctcaccttagcgagtcggagtaacttcttctccccgccttttttggtaactaacttctttttattagttaccaaatagtaattacataacaaagcaaagcaaacacagcttgctaatcttttatttactccttatactaatcttcctagaaacataaactatacacataatgcttgttcctaggagtgactctagcactaactatatatgctatatcttttgaaatttgctccacatttctgctcttcttctcgaatacgcttctgtttctttcaagtcatatatgataaacaacttctgcatacattattctgaacatcatcgcataaacagacttcccttttgcttcaattatggcccattgaagaaactgctgccagttgccatttccaaacttctattttccaagccatctgcacattctgttccacacttggattgcataatcacaatgccagaataggtgatctcttgtttccttttcttttatacacatcacacaatctggttctacattgaccttccaactaactaacctgtcacaggtcattagcctttcctggatcatcaaccacataatgaattttgcttttggtcttgctgcattttgaaataccaatgttttccattccgttcttctgtaatcttccagtaggtgcaggtatatttgtctgatcatgctcttcttccgactatgtgagaactgcacctcttcaagtatactgtatgactcaatcactttccttaccatccagcatgcttgttgaggaactttcattgtcttcacttgctgattcttgacataataagcatgtatccatctgatccatagcttgtcctatttgtgagctaaatcccagcatgtctttgcaatagttgccttgttccacaacttcaaattgattcaccaatttgaagaacgcaattcttaatattaatatataattcaccaacatgtactttgttttcccagtatttgttgggaaatgtcattaatccactatcagatacataaatttaatttaaggatttaagttatatgtattgacagtataacgatttttttcaccaaatataacttaacctgtcataggcagctaatggtggggaactctgtggttttgtttccatttcaccaatttatgggatgatatttctccagataacttttccttctactctttcagctctcatcgaagtttgagaacctaacatgtctaagattgtttgatacaataagaactctgaagttcatgaagcttgagaatttagtgtaaacagtccaggataaaggaagactagttttttttttgggaaaatttgatcaccaagacacaaaataagagagggtgaaaataatttgttttatttcacaagttggcccgaatactacaattatcaggaaaaatacgcgtgtcaaagattaggtctcaggttcaaattctagcgaagacaaaaatactaggtgatttcttctcatctatctaagccttggtggatagagttatcaggtatctattactagtgggaggtaccacgtacctgtagaattaattgaagtgagagcaagcttgccagtacaccacgattataaaaaaaataccggtgtcaaggttagggtctcatgtttaaattctataggaggcaaaaatatttggtgatttttccccatatgtccacgacttattgaacatagttactcaatatatgtactggcgagaggtagaaggtgcgctgttgatgcccaatttcgccatcatatttttccaaataatatatatttttaacatgtcagctttgcgtcattatttagtttataagaattatacatgtatttttcataatttttagcaaattttacagctttaaagataattttcttgcatctaaattacttaaatatttactaattattcctttaaattattttttgatgacttgatcatctaaaattattatttgcatctatatacatgtttcaaaattttcttttaattcattttatataattatattagtatttttaggctatttgcacaatcttgcaataatagcccatattttgcattttattgcacttgtcattttattcagggtcaaaataagtctctacatttttataatcttctactattttaaagtagtaatttgcatatatatcttttttatatttatttaactatttttattaaattattttccttttaatctcttatttaaaagctgggccaaattttgagctaattttcggaccaaacgaacctaaatccctggaccaatccccaagaccctttaaaataacccgccctgtttcttttgcgatcctggccgttgttctcaaatgatcaacgacctatcataaacccatccgttccttttatattgcctcttacccaaaaccctagcccattttctaccaatcgccgcccctgaaatccctggaatccacccttttctctgaagaaccctaatcaccgccctctccaatccttctcataattccgttaacaatgggattcaccaattattttcttactatatttgcattccttcgctactaggtgttttttatggtattacatagtactttctttattttggaaagtataaatctttaaataaaagggaatccttctttaatcttcaagatctagacggtatttcgtccatatgcatcatgacaaggtcatatgggttcgaatcaatgagatttttaactatttttggctctccatcataaactagggtttacctaattttctccctaatccgtttttaattgattccgcatgttattatttccttatttgtgtttgattttacagtgtttccttgtttgtttgcttgatttctactactatataaatccttcccctatttccctttgagggcagactttaatcatcggattcactaaaaactcaaagctatcactctattattatctcactctcttgttctatactttagctcttggccggctaaaagccaaggttaccggaatttgattattcaacctttcttagtgcaagcactgtcaggagttcatttgaaacccttggaaactctgatgcactaagactctgggttctattgctctttgttgacgtttagaatactgtagagtttgttatttcttgcttgtctgtttatcaattgataactggtaagttccttcgcttttgcaattttattctcttgtattcatgtcttgtacattcatacctctgaaattccgtgacttgatgtattactaggacatctccgtgtgcaaccttgttggcactaaatttgttttatgatatgaacttctttagcatttgaatttgcctaaattttttagttctgagacctttttattgtacatgcttaacttgaataattttgactctattaagctcgtttagtctagcatattggtacctaaatgtttatatttgccgcctggcataagtttgcgtccctgctttgttttgaattcctgtaatgactgacttgtatctataatgtgttctaatctctgttaggacattcatcatagctatgaccttccccccatgctattttgtcacttattatgtctttattttgcttaatcttatatcccctagtgattatttggaacctttagagtagctatcctaacttgtgttttcttataaggtttgatactggtttgtcttactgatataagttggcatgtctgcttttctggtgttgtgatggatacttaacataacttggatccctaggctttaaatcctttaatttagtgctctactttggatttgtttggcattgtgcacccttatatgttgatcctataatctcagaaaaactgattcctttaactctcttaatgtgtttttctgcccaatatgctatctcttgctaagtgattgaatatgtaatatcaacctgccctctaagtcttgttgattctcttaactctcatgttctctatgtaatcaaccttgctacgtctgcttctaaagtgcaagtgcacctcttaaaattctatcacttaatcactgttctctcactctcatttgttatctatattattctgaatctattattcttggccggctgaaagccaaggccaccaaaactctttctatcgacctccctagttgagccctactcggggtccatttgagactcctgtgaactctaacactctaggatttggggtcctttgaccatttctttactggtggaacttaagctgtctctgacacttagcttttctccctaatcttttttgttgatctgcaaactgggttgcttaagtgatttttgtgtgattctataatttatttgggttatgtgtagttgtttggcttggcatcagttcctctgtgactttgggctgtgctgatgggcatagtctcctgtttgagaaatgcttggatctgggcatgctatttgcgacgaatgagcttgtgaaggcaggtaatactaggtatctccttttgggcctgctgttaggcctactattgttccatgtgtaatatttatacttatattcattatctgggcctgtaataatttgtgatagacaatggggacgttagtgaaattggaaaatgggtatattctaatgtttgcataaaagggtagaaaacatgcctatagaatttatatgacttgttattttatccaacctgccatatatgctatttagtgtccatgtacactagtagaaaccatgcttataggaaatcacacactcactcaacctattttactatgcctactactttacattattagacaacatgcctataggaaattagtgtcaataactattcgttaaatttgtgtaattacagcatgttcactagataccatgcttggcggatcacactaatgctcatctagatatcatgtctataggggttaattgactaattagcctattgttttcatcatattgctcacttggaaaacatgcctatagggatgaagcgttatagaactagtttcaactgccagatattagaaatcatccctatagtatgttgttattcgcctagaaactatgctaataaaatcaaacacgagtaatatttcaagctttcgaactgttttattgcctcatttagagattatgcctatatgatttgtaacacctataatctgtaaactcattgttccaacaaaatcagcactacatgtgcacttaaaatcaaaatcaaatagaaatcatgtctatagggtttaatgactctaatttgcctcaattctgaaactgtctgatgcctaatgtgaaaatttgcccgcatgcatttgttgcttatatgtggaggctaatctgggcctttaactgcctttatatgaagtcctatttgttttgaatgtcccctaactttatcgttttgagtaacctaagtaaagtctagaaccacccaaatagaggtcaaaatcctcctggaccatatgcatgagactggtagcgcaggcataggatacgacttagaattgaattaaagagcctttaggtaaacaactttaacatagtaatcggatagcaggagatgatagtctgtgcccgttgaataatatgaataactccccatcttaatggagctgcgaaatattatttatgttgcacgggatgatcctttaggctaaaaaacttagggccctcctttttctttatactctttgtcatctaatataggccgttatagttatatccttgtagtccatttgtaccaattctcattatgttataataaaactctttgaccttttattttcttcgtttatatgatcatcttgcctaattataatctatatagtcttaggttcggccgggacccacagttgtagaccttgaagagtacccaatactttatctttgaggtaatttgagtccttacccgatctttggtagcgttgactagtcaaacagagttatccgcataataggtgacctaacgcatcttaaaaactattaggtggcaactcttcttcttttaatactctatctcccactcaaaagagttgtcatatgtcgaaactcgctttcgtgagaaaacagagcgcgacacgcgtaatatctacattagtagagatctgctatagtcaagggcagatctaccttagccaagtggtgtcacgtgacaccgcttcgtcgaaaatctttacttattatttatatataaaataaaaaaataaaaaagtaaaatatgataaagtgacactgcttgtcacaaagagatgtgtagcttatcttgtaagactctaaagtgttctacgtgggttcgaacatccatagctttatttgatgttctaatacttttgtgcctcatctaaaaaatgtacataaccaaaaggggttttgagacactaagcaattagacattatcaaagcactaaaccagtggattatagtcataattgaagaaactagcacaattaattttttaaatggagggatgttgctattttcttagtaagttgtgctatttatttttttaggttattttttaaaatacgatgttattacagtaatttggttacatttaatatggtagtagtgcttacaaaaactcatgtgtacgctactggctacgctaaacgtaacccgaaacccaaataggaagagcaaaaaaagaagaccaagtaaatgagaaatcaatcaaaatatcaataaatacagagaaaaaattaccagaaggtttagagtgcctatgtggaaatttgcgtgggattctgtgatgatccggccgatcgtcttaagaatttatgccccgatctcctatttactattttccccatatttatttctgctattttgatttgccgggatgttcggttttgagtttgagagttttgggacacttagtccctaaatgagagcttaagttttgaaaaatttgaacgtagtcagaacaatgtgaagacggccttggaatggaattccgatggttccgttggccccgttgggtgatttcgggcttaggggcatatttggattgtgtattggaggtctgtagctaatttagtcttggaatgacaaaagtcgaatttcaaagttttcggtttgatagtgagattttgatatgaggatcagaatggaattccggaagttggagcaactccgcagtgttgaatgtgacgtatgtgcaaaatttcaggtcattcggacgaggtttgatagactttttgatcggaagcgtaaatttagagttttggagttcttaggcttgaatccgtggttgattcgtcgttttgatattgttttaggtgttctaaagattggtataagtttggctagtggtatatgacttgttcgtgcttttggttgaggttactggggcctcgggatgatttcagatgtttgacggaaaggtttggagttgaaagttgcagctgaagctttaagtctgctgtcataaccgtacctgcgacctggggaccgcaggtgcgaggtcgcagaagcggtcgagcaaccacataagcggtttaaggtaaaaatggagttgaccgtgttgatacccaatttttccctatataattttcatatgcaaaatactttcaaaatagcatatgtatgcatatataagcatgtccaagtgtttcattatttttcaatttttaaaacatttttaaatcaatttatcgccttattttatcagaaaaaaccaataattatttcccaaattatcatttttggtaactcctttattgtattctcatatttataccaaaatatagctaatgtaatttttgcacattttcttacaaatttattgagtattttaaaattaaattgcacataattgcaattttagcctattttaagatttaattgcgtttataattacaaaattaatcccaatatttttaatttaatatttgcgtattattaattaatttagtaccttcaatttgtttccaaattttgctattttttataaaaataaagagggaaaaagtggctatttaatactagccatacctatttaaattttagcccaaatcgaccccccaattaaccccaatttcaatttcaaatggaccggcccaattcctaaactacccgcccctgatccaattaagttcaactcgcccggccccccattaaatccaggtcgttgatgtaaatgatcaacgaccacaatccctcctttccctttttaatccaacaacaccccttaaccttaaatcatttcacctaaccagccgcctctgaaaccctctcctctctcaaaacactctcgaaccttctctaaccctagccgcctcccatcacttctaccttgaaacctaccgtgatccatggcttctcaggctatagaagtcttatacccacctcctgttgctcttacacacctgatctctgaagattcaaggcctgtccttgaaggtttgcacccagacctctgccgattcaaggtccagagtcatcgtcgaccttggtccggcgtatcatggtgttttcagcctggttctgacctctccgactcagatcagtgaccttttcaaagcctttctcatttctagggttcttttgaaaccctaaccctttgaggttttctctgatctctttagatccgttgtgtatctgtgctctctttgagttttcaaacgatctccctaacttttctttcgaaaattacttttcaaagtctttcttttacgatttaggattttctgaaaagcttaagtgtttctctgactttcttttccttttcttttgtgtgtatttgcctctactgtgttctatgttttccttctaccatgtatgttcttctactgtgctttctatgttccatttttgtatgttcttctactatgctttctatactatgctgttgtatgcttttctactatgtcctgctattttcttctactatgttttggtatgtttcgcctactgtattcttctaccgtgttcttaagtgttcttactattttcttttattgaactttgtttaagtttcttttaaaaggatcctcttaagcatgctttcttctgctgttcttatcagtcttttctcatcatgtttcgaattagtctttttactctgtttgccttgaacccctctactctatttacatgctattcatgagttctgttgctggaaaaagcatgctagaagtgtcaattcttttctgaaacctctaagcatgtttcgattcaactacttgtcttatcatctctgtacttgattcaaggcggaaaccctaaaatttgggggttctgccaggtttgatcatatatttgattgaactagggttttattttagaacccctaactcttcgagtctttgaattgagtttagacttctttgtttttatatgattctgacctttttactaaaactcttctacactggtttttcttattaatttacagtgacatgaaagttttctttcatacttaacatgctcacatgctttttatatatgatgaatttccctctaaatggttttcaaatttgcaattagttcaaacttccttatgaatgtggcttgattgatttctttccattgtttgctgattctccctgttactcgacctaagttaaaacccttcttcatcttttctgactcggttcattcatgcaaagtctcagactcttttgatttattgtttgttaattgatttgcttaccttatttgcacaaaccatgtatttcaaaaccttgtccttaaataactttttatgtatttgcccctgattgcatgttgtgcacaaattgcttactcaatttctttccttaaatggttttcacccgtttgaatctgaatcccttagttaagggaagccttatgtaattgattgacaatcagttccttaactgtttttcttaccttatttctgcttgatttttacactataaaaggcacaaccctcttcacacattacatcatcagaatccttctgagctcacactctctcataataatattctatttttgactgtactgtggcctgttttacaagacctactgctttcctttacttgttttcctgaaaactggtatgtcctaatttaattcttagcaccacaacaatgtgtagttactgcttttgtatccatgttcatattctacttttgtatatctcaacacttaaattagcatgttaatttccttatgtgtgttttgttatgaacccccattcctctatcacccctatgtgttttgagtggtgacttaaggcatggcaatgtaagttgttgtccatgaattaagtttgaaccactggggtcttgacctctaagcaaacaggccagaaggtgtgccagcatctcccattgctgggtatgctcttcagcccgcttttctgttgcctcttgcaacttcccattcccctatacccttatgtgtaatgatgtgagctgcttcccttttcctttttcccctttcagaattctacttctgcacttgcactctctcttagtccttaagttctgcccccctcttgtgagccttgccttgggaccttgagctccctctgaacttggacacctgagggctggcccttttatactgcactatggcttaatccgtgatacatttgggtgtaagcactgcccggagttcatatgatactcttagggaactctgacactccccaaataggagaaaggctttgaaatatgatcttttggagttgatttacttcatacttcagacaggaagtctgaatcaggctccccttggttgtactttttaatttctgatgtatttttcctttactttactttttctgggttgtaattattttgtaataaaactctcggggatggttagtgaaaaagtgagggtaactatgtatgcaaaaaggggtagataacctgcctataggagtttatgaatttctgcattcttatatagataccatgtctataggaatcttgcattcgcgtctacataccatgtctataagaatttctgcatagataccatgtttataggaatctcgcattctcatataggtaccatgtctataagaatttctacattctcatatagataccatgtctataggaatcttgcattgtcatgtaggtatcatgcctatagtttatttctgaacttctgcatagcgtatatatatcctgcctataggaatttttgaatttctgcacatcatgtacatatcctgcctataggttctttctgaatcttgcatatgcattcctcatcaggcaaacatgttcgtaggtcttaaataaccaactgcaattagatatcatgttcatagactttaaatgaaattcaacatctagatgtcatgcctataaggtttctgcattttttactacgtttataaaagtgtcctaaatcgacaacacatataaagcttgcctataggagccttaatcgaatttgaatcgtttcattcgcttataggtctaaaactagtaacaatgacgcatgctattttgctaaaacccgcctttctttaataacatatgattttcttaaattagtatgtattcatgtttgtttcatcgtttctggaatcagtagatatcatgcctatatgggtctttgtctaacacttaggcaagccatagggtgaaagtttataaactgaatcagatttttatcagctacaaccagcaggcaggcctgattcgggcttcttatctgaactatgtaataaatcaatctgcctccaccatttaagttttaaccagaccctaaaaagtacatgcaagtcatgctatattatgtgctttcttcgattttaaggaggtctgtttgagcccttttatttgtttatatgcttccccatacttgccatacgtgttttgattgtcgccttagaataggtacctccttcctttaggattagtagtcccaagtgcctccagagctgataagatgggggcgggtaatagcatgcaataagtaaacgagactattctgcgctttaataccttaacggggtaggaaagggtagacatgaatatgatgaccatgcgataacatcacgtgtagcccctcactgaggagtgattaccggatattgtgtggggtgatccatattattaataaacctaggacccccttccctttgttttctttgtttcttttaaatccttttaaaccatttcttttaagaaaatcaactctttttagttcctttttcttacttttgtttattgtaaccattacgtgaaaatcccctcttatttgaagcctttatttgcctatatgttatttgcacttaagtcacaatagtagtttggccgggaaccacactagtggatcctgaggggtgcctaacaccttcccattgggataatttcaagcccttacccaatctctggttactcaaaacaataccctcctaatgtcctaatgcactttaatcattatgtgacgactcttcaattcaaaacccaattcccgaacgggaacgagttgtctcgcaaatgtcacaaacccgatttttgtgagaaaaagggggcgcgacagcgtggcgactctgctgaggatatcttttaggcttctaccatttcaagctattactgtgactttacatttcttatgtgccttatttgtttaatacctttaagcatttaattccctcttctactgaaaaaaactaacttgtctcttgtttctttcccttgtttctttcacttctttcctttactgcactcctttattactattttaaattattgtaattattactttatgaatgtgcaaatatgtgacgacttgttttaattgcatatgcatgtttccaacatcatattccactcgtgccaaataaataccatagcaacgcttataatgagtggttgcgctcttccgatattatcaccctttaaatccggcaaaagcgtatttacggtaaaaccagtcgatcaacggtgtagtcaacggttccgtgcctttccctcttcagttgtccgctcaagggtaccagtctaaaaccccgtagaaaccttactctgtttaaactgtgcatacatcatggtcaaacctagctgagtcagttatgttgtcggcataatgactctttaagatagccttgtccaaagtccactgggtttcccaaaaacccaaacagacactatcatgttttgtgcatttttttggagaactaaatacttttatgtcaattattggtatttaatagtcgagtttggtgggggtaaggacctagcccttttgtcttgcagaaacatgaggcacgaagtccccagattcggcatggtcacaaacatccacccaaggttgctaagctggtgggaggatcttcattccagtgatcagactcttgtccggaaatacctaggaaatctaccttccctcctggaggtccaacccaacaataaaatcatagaagctgcaactctattctgggattgtgataagtctgtgtttcacttcggagagattgagatgacacccttgctagaggaaataggaggattggttagtgtaccatgggagacccccagttttttaatgtcggaaaatcgcaagggtagaggttttctcaaaatgatgggcctaaagaagaatccagacttgacatgtttgaaggagtcctacattctctttgattatttgtacgagaggtatggacacagcaaatcctaccgtacatatccggatgagttcgcccttacatcattggggcatattcaccgaaggttctttgtcttcatgttctgcttcttggggatgatagtgtttccaatgaagaaagcaaggatccacaccaggctagccatggtcaccaaaactttgttggagggaattggtggaaaaccatttagcatagtgcccatgatcatcgcagagatataccgagccttggaaaagtgtcaataaggagccccacacttcgagggctgcaacttgctactccatctctagctcatggagcatcttcaaaggggtaaatatcgacaagagattcagcatagagactgggacgatcatatagccttccatcaacaaaggcgaatgaactacatgcccaacatgtttgctaagccagaagatgccaaggggtgggtggagatgtttgaaaatctaactgaggatcaaatacaatggatgttcgagtggttccctactgaagagttcatcgcccgatccaaggatgcaccatttctgatactgatcagtttgataggaacctaccattatgtccctcttcgagttatgagacaggctggtaggaagtaggttataccaagggtcaataagatgagtcacatccgggctgacttccaagctgatgacagtccttataagtgccaagctcagcatatgtggcattgcaagatcatcacgggaagagatactatcgaaccagacagataccatgctggctgcaccccatactattcaggctggctggaggataatcacaatggtctgggccaacccgggtctgttcgaggtcacagaatcatcgatgaaagggctgaagcacaggtcaaatacaaccaactgcgtaagaggattctggaatgtgaaagcgagcaccgtgagattcaagaagcccaccaaaaactgattgaagagtggaaagacatggctgtcagtgccaacaagcgattaggatacctagaacaaggtttagtggagcatggaaaagaagtttctcaagaggatcgaggactgccagaatgctgaaggaaacgagggtggacacctggctagagcctacctgctgctgggacttcgtgagctggtgaagctgttcgatggatccaaagatgccgagtctggggaaggtccttctgggaccaaataaataggagttttcttttactttatgaaatgtaataaggccaatggccactagtgacattttatttcttgttatttagtgtcgttttagtattcgtctactttttatcaataaaattaggcatttagtatttaaagttcttaaaatcaatttgtcgctaggcctacctcgggcaaaacaaggcttccaaattaggacgcgatttacattcttgcactatgtgtttaaatatcgcaacactttcttataatccccactgacttgttacctttttgtttttactttttgtttatttactcccctccctaaaggttagttcgtgtactctggcatcgttatcatattccacaagatcaaagggccctccacccactcctcctcctagtcctatcagaagcaggaacaaaggaaagatggaagatttgaacaacaccagaaaggaaaacttaactgaacgggtagaggtcactcatggtgctcaggtctccaaagaaagtgcgtcccaactcgagcagaaactgttgaaatttcaggaggaacttgatcaggttcagaatctggcaaacttatcatttttcctcaccactccagaatcaattttccgaacgctcagaaccccacgcctccacaaaacatcccaaaaccacaaaatcatcccgctcctcaccaccactgtaatacttgccacactccactactcatcccagaacctctaaattccacaaatgaccatttccatgcccaccataacgctcccatctatgtggaaaccatgcaaccctccacccaacctgtctcaagcacacccgagtctgatgataaagactaactcatcaggaacctggttgcggaactcaagaaattgactagtcgaattcacggtgtcgaaggaagtaaggggattgaagggttgaactacgaagatctttgcatacaaccggatgtcgaactgcccgaggagtacaaacctcctaagttctagattccgagagtccacttgagaacatactatgacaagctggtcggagtagggaaagacgaaaggattcacatgaagcttttcatgaggagtctgaagggagatgctctatcttggtacattagccaagaccctaagaaatggtcgaactgggtgagtatggcgtccgactttatggacaggtttaggttcaacacagaaaatgcaccagatgtgttcttcatccaaaacttaaagaagaagcccacagaaacattccgcgagtatgccattcgctgtagatcagaagctgctaaggtcagacctgctttagaagaagaacaaatgaacaagtttttcgtccgggctcaagacccacagtactatgaaaggatgatgttgattaagagccagaagttttccgacatcatcaagctaggagaaaggatcgaggaaggcatcaaaagtggtatggttacaaactttgaagctttgcaagctaccaataaggctttacagtctggtggtatgtccaagaaaagggacgtaggtgccgtaatggttgcacaaaaagccaaatcccctatcaaataccaagcctatccgatacctccactcacatatcagcctacctcgaattaccaagaaccctcaccctcttaacaagctccatcacctacttaccaatcacccccacctcctacatatcaacctactttacccagatattcccaacccgcacatgtctaccaagcctacaatgctcagccatcccactatcaatcacctcccacatgtcaaaactttcctaaacctagaccaaatttcgaccgcagatcccccaaacagtataccgccattgctgaaccgattgactagctgtacgaaaggctcaaagatgctggttatgtcacccctatccctgctataacccctgaaaacccttctcagtgggtcaatccaaataaatcctgtgcataccattccgacatgaaagaacataccattgatgaatgccgttctctgaaagataagatccagactttgatcgataacaagatcattgtagcaaaggagcctactccgaatgtccgcaacaaccctttgccggaccataagggtggaggtgttcacatgatttaaatagaagatgattgggatcccaaaggatcgattggtttaatcacagaaggtgacgaactaaagaagccgatagtcaccctcaatccaatcgtagtcccgacgcagccttctggggatgacgaggtaaacatatctgtaccacttgaatttgaagcaccaccccctacaaagaagccaacaccaattgcagtcgagtttgggtctccaacaaacgcacccgcaccgtttgaagttgaggttttaccctccaaaatacatgctccgttcggagtaagggtgcccatcccagtagcaatgtcggccgtaacaccatttcatacaaatgccataccttgggattacacagccgaggcgagaaggaaaaggaaagctaaattcagggaaatagttgcggcccagggcatgacaagaaccgacagggtttatactctggagcatttagctgagtcgagtaagcaggcctctggtcagatgtccatcactgaaactgggcccgatgatctccggaaaaagatacaagccaaggaatactcagtcattgattagctaaacaaaacactgacacagatttctatcctagctttgctgcaaagttccgatgcacataagaatgccttgttgaaggtgctgactgaggcatatgtaccaagaaacatcactggagaagaaatggaaaatatggtagggcaggtattggaaagtcataagatcacttttcatgaagatgagctgccactagaagggttgagtcacaacaaggcattgcacatcaccgtacaatgcgaagattattttatcactagggtcttgattgatggagggtccaacctcaatatttgtcctttggtaacactcagaacattggggaaggggctgcatgagatcaaggacggggccatcaacgtcaaagcttttgacagttcccaaagatccaccattggggaaatcagcctatgtttgcaaatggggcatacttggttcgatgttgatttttaggttatagacatgccgacatcttacaacttgctattgggatggccgtggattcatgccgttggggccgtagaattgacactgcatcaggcgatgaaatttgagtggaaccaccaagaggtaatcattcacgacgatggtagaaatcccatatatagtcgccaaaccatcccagcgattggaggaaggaaaaggataggcgggtaaacctatcaccatttcgagcgagtcaatgccgctgacaaagacaagtggtggggaaacaaaattgagagcatactaaattggtgcggatatgaacctggcaagggacttggcaagaacctccaaggaatcgccaagcctatcaaattgaagaaacatggcaccaagtttggtctgggatatgagtatacttgggaggaattcaacaactggtcgccaccatggcacggtccatactacccgctggagcagccaataccacatttggagcagactttccagccggccgatgttatctatgggtcggaagaagagaaagcacttgtagcagtaaggaatttgttcttaaaaggtaatgacatggattgttgtgtcattttcgaggaggagggggaggaaggcccttccatacaggccgtaagtcgaggagcatacctcaacaattggaccatcagaaccaccagagcccggaaagcctcggggtagcaaggctgaacaaagcatcatgcactatcttttatttttactaattgattttcctttcgtatttttgaatttttgcaataagatcttccaatgttcaaaacagttatgaaatttatcaaagcattttggtttccttacaaatcttactcttattattttctctcattactttacttgtacaacattactattacctatcttgatgaaccaatggttgtgatatgcaacaagacaacacaacaaacgtatacagatttagaggaagatcacatactgaaagagattgttaaagaagtcaaaaattttgagaacagacctaagtccaacctagacaagacagagattgttaacctgggagatgcagaaattatcaaagaaactcggatcaacgttcatttgtcaccgtcagaaaaggaagaatacactgaatttttgaaggaatatgaggacatattcgcctagtcatatgatgacatgactggtttgagaacatctattgtgggccataaactgccaactgatccgacatgtccaccggtaaaatagaagctcagaaagcttaaacccgacatgagtctgaaaatcaaggaagaagtcattaagcaggtcaaagctaaggtcctcagggtagtagaatatccgacatggttagccaatattgtgccggtgccaaagaagaatggtaaggttagagtctgtgtcgactaccgggatatcaatcgggccagtccaaaggacgacttccctttaccgaacatacacatcctgatcgacaattgcgccaagcatgagttgcaatcatttgtagattgcttcactagatatcatcagatctggatggacgaagaagatgctgagaaaacggctttcattacaccgtatgggatgtactgctacaagatgatgccattcgggttaaagaatgcagggccacctacatgagggccatgactactatcttccatgatatgatacacaaggagattgaggtgtatgtagatgatgtcatcataaagtcctagaaagccactgaccacatggaagatttgaggaagttcttcaacatactaagaagatacaacctggaactgaatcccgtgaaatgtgcatttggggttcctgccagaaaattacttcagttcattgtgagtcgccaagggatagaactggatccatctaaggtcaaagctattcaagaactgccaccgctgccagatacatgcagacatgataaaggtgcctccaaatgagcttaatgcaacaagcttgccgtggcaattcgccgcttggggaatggatattattggaccaaccggaccctccgcatcaaacgtgacaggtttatcctagcagcaattgattatttcaccaaatgggttgaagcagcatcttacagggcagtgactaagaaagtcatggcggatttcgtccgcgaccatatcatgtgtcagttcggaattccagagtcaatcattactgataatggctccaacctcaacagtgatttgatgaaatccatgtgtgaaaccttcaagatcaaacataagaattctacagcttacagacctcaaatgaacagagccgtagaggctgccaacaagaatatcaagaagatactaaggaaaatgatagagaagcataagcagtggtacaaaaagctctcatttgctttattgggataccgcaccacaatcctcacatcgacaagagcaaccccctatatgctggtttacggtacagaggcattcattcccgccgaggtggaaattccctcattaagaatcatacaggaagcaaagctagacgatgcagaatgggtgaagaatcgttacgaggagctagctcttatagatggaaagagaatgaatgcagtttgccatggtcaactttatcagaacaggatgtccagagccttcaacaaaagagtcaagccgacacagttcacaccggggcagctgatgttaaagaaaatctttccacatcaagatgaagccaaggtgaaattctcttccaactggcagggtccgtacatggtttaccaggttctaacaagaggagccctcatactcgcagaaatggatagagaagtctagccaaagccgatcaattcagacgcagtcaagcgatactatgtgtaacctttatactttcttttatgatgtaatttgaactacgcatgactcgattaccgtttaataggggatacgtaggtagccctatgggtttggtcacaattcaataaaatttccattttccccgctattggaaactggggcagaattttgaggaggaccctcaaaattccgaagtcgattccagccatttatcattaacagccgtcaggagcagcaacccagtaaactggggcagaattttgaggaggaccctcaaaattccggagcaagcgaagttgcaatgtctttaaccatgtcgcagtcgtcggttcatctaaagaaaattattcttaattatgcacttatgttatgcttttactaaatcatgcatgtttattactaaaattgccttgtttagaaatgctaccccaatgatacgtacaatatcaccagatcaaagccgagcaggtcaagcaaagccagcggggatacgaactaactttcccccctttacaaactcacgattttcctttgaatgcaggcacttgagttgcaaaatcatcaaatatgctatacgctcactcacaaagtttaggaatacaactctccgaactgttgcacttgctcgcaactgctatccgcacaacagtgtccccaacatgcataatatccccagcaatcacgataccagaatccgctatcagctaagaaaactctattgccatttgccatttttacttcctgcataaggctaccattttgccttccacggttaagctctacctccatctacattctctgcattatataaggctaccattctgccttccgagactaagctctgtctccatctatattctgtgtattgcataaagctaacattttgccttctgaggttaagctctacctccatctgcattctctacattacataaggctaccattccgccttccaaggttaagctctacctccatctgcattctctacattgcataaggctaccattctgccttccgaggttaagctctacctccatctgcattctctgcattgcataaggctaccattctgccttccaagactaagctctgtctccatctgcattctctgcattgcataaggctaccattctgccttccgagactaagctctatctctatctacattctctgcattgcataaggctaccattctgccttctgaggttaagctctacctccatctgcattctctgcattacataaagctaccattctgccttccaaggttaagctctacctccatctgcattctctgcattgcataaggctaccattctaccttccgagactaagctctgtctccatctgcattctctgcattgcataaggctaccattctaccttccgaggttaagctctacctccatattgcatggctgaaagatcgccacttcatttacatcttgcatggctgaaagatcgccacttcatttacatcttgcatcggctgaaagatcgccacttcatttacatcttgcatggatgaaagttcgccacttcatttacaccttgcatcggctaaaaagatcgccactttatttacatcttgcatcggctgaaagatcgccacttcatttacatcttgcatcggctgaaagatcgccagttcatttacatcttgcatcggctgaaagatcgccactgcatttataccttgcatcggctaaaagatcgccactttatttacatcttgcatggctgaaagatcgccaccttatttacatttgcattggttgaaagatcgccaccttatttacattcgcactggctgaaagatcgccaccttatttacatttgcactagccgaaagatcgccacctactgcatcatgggctgaaaatttgctaatttgtccaaaggcgtcattgttcggaggcaccattttcatagcacgagaacgctatgccatggcctgaggaccccttttatcttttgcatgtcattagtcaaaggcatcatagttcggaggcatcattctcaaagcccgagagcaccatttcatggcctgcgaatccttattatacgcttcatggcccaggacgtcatggtctgaggacgtcatcctaactgtccaaagacaacatttcatggtccgacgggaacttgcatcatgtttaaatttccgcacaacatatggttcatttgcaggtaaaccggcgagcaacgaccatctcagtagaagaaatccttctccagttcccgtagctctattaaactttaaccatccagcccaacctaaacattgcgtccgttcttggaaaacctctatcggcatactctgccgacggatcctgaactatatatggcctgattcctataagaccagggatatgtaggaaactcaggaaccatggcacgatcaacattttcaaaccatttcgttcgatcaaaattggccatcatatctttacccgacaactctttcatccttcccgggtaaagaaggacagctgttgatacccaatttttccctatatatttttcatatgcaaaatactttcaaaatagtatatgtatgcatatataagcatgtccaagtgtttcattatttttccaatttttaaaagatttttaaatcaatttatcgccttattttatcagaaaaaaccaataattatttcccaaattatcatttttggtaactcctttattgtattctcatatttataccaaaatatagctaaggtaaattttgcacatttttacaaatttattgagtattttaaaattaaattgcacataattgcaattttagcatattttaagatttaattgcttttataattataaaattgatcccagtatttttagtttaatatttgtgtattattaattaatttagtaccttcaatttgtttccaaaaatcattttgctattttttataaaaataaagagggaaaaaatggctatttaatactagcccaacctatttaaattttagcccaaatcaacccctcaattaaccccaatttcaatttcaaatggaccggcccaattcctaacctactcgcccctgatccaattaagttcaacccgcccggccccccattaaatccaggtcgttgatgtaaatgatcaacgaccacaatccctccttttcttttttaatccaccaacaccccttaaccttaaatcatttcacctaaccagccgcctctgaaaccctcccctctcttaaaacactctcgaaccttctctaaccctagccgcctcccatcacttctaccttgaaacctaccgggatccatggcttctcaggctatggaagtcttatacccacctcctgttgctcttacacacatgatctctgaagattcatcgccggccttgctccggcgtatcatggtgttttaagcctggttctgacctctccgactcagatcagtgaccttttcaaagcctttctcatttctagggttcttctaaaaccctaacccttcgaggttttctccgatctctttagatccgttgtgtatctgtcctctctttgagttttcaaacgatctccctaacttttctttcggaaattacttttcaaagtctttcttttacgatttaggattttctgaaaatgcttaagtgtttctctgactttcttttccttttcttttgtgtgtatttgcctctagtgtgttctatgttttccttctaccatgtatgttcttctactgtgctttctatgttccgtttttgtatgttcttctactgtgctttctatactatgctcttgtatgcttttctactatgtcctgctattttcttctactatgttctggtatgtttcacctactgtattcttctactgtgttcttactcttttcttctattgaactttgtttaagtttcttttaaaaggattttcttaagcatgctttcttctgctgttcttatcagtcttttctcatcatgtttcgaattagtttctttactctatttgccttgaatccctctactgtatttacatgctattcatgagttctgttgctggaagaagcatgttagaagtttcagttcttttctgaaacctttaaacatgtttcgattagactacttgtcttctcatctctgtacttgattcaaggcggaaaccctaaaatttgggggttctgccaggtttgatcatatatttgattgaactagggttttattttagaacccctactcttcgagtctttgaattgagtttggacttctttgttttcatatgattctgacctttttactaaaattcttctacaccggtttttcctattgattttatagtgacatgaaagttttctttcatacttaacatgctcacatgctctttatatatgatgaatttccctttaaatgattttcaaattagcaattagttcaaacttccttctgaatatggcttgattgatttctttctattgtttgctgattctccctgttactcggcttcatcttttctggctcggttcattcatgcaaaattttagactcttttgatttactgtttgttaattgatttacttaccttatttgcacaaaccatgtatttcaaaaccttgtccttaaataactttttatgtatttgcccctgattgcatgctatgcacaaagtgcttactcaatttctttccttaaatggttttcacccgttttaatctgaatcccttaattaagggaagacttatgtaattgattgacaatcagttccttaactatttttcttaccttatttctgcctgatttttacactataaaaggcacaaccctcttcacacactacaacatcagaatccttctgaactcacactctctcataataatattctcttcttgactgcaccgtggcatgttttacaagacctactgctttcctttacttgtttccctgaaaattggtatgtcctgatttaattcttagcaccacaacaatgtgtagttactgcttttgtatccatgttcatctgctatttttgtatatctcagcacttaaattagcatgctgatttccttatgtatgttttgttatgaacccccattcctctatcacccctatgtgttttgagttgtgacttaaggcatggcaatgtaagtagttgtccatgaattaagtttgaaccactggggtcttgacctctaagaaaacatgccagagggtgtgccagcatttcccattgccgggtatgcccttcagcccacttttctgttgcctcttgcaacttcccattcccctatacccttatgtgtaatgatgtgagctacttcccttttcccttttcccctttcagaatcctacttttgcacttgcactctctcttagtccctaagttctgcccctctcttgtgagccttgccttgggacctcgagctccctctgaacttggacacctgagggctggcccttccacattgcactatggcttaatacatgatacatttgggtgtaagcactgcccgaagttcatatgagactcttagggaactctgacacatcccaaatagaagaaaggctttgaaatatgatctcttggagttgatttacttcatacttcagacaagaagtctgaatcaggctctccttggttgtactttttaatttctgatgtatatttcctttactttactttttctgggttgtaataattttgtaataaaactcttggggatggttagtgaaaaagtgagggtaactatgtatgcaaaaaggggtagatgacctgcctataggagtttatgaatttctgcattctcatatagataccatgtctatatgaatcttgcattcgcgtctagataccatgtctataagaatttctgcatagataccatgtttataggaatctcgcattctcatataggtaccatgtctataagaatttctacattctcatatagataccatgtctataggaatcttgaattctcatgtaggtaccatgcctatagtttatttctgaacttctgtatagtgtatagatatcctgcctatatgaatttttgaatttctgcacatcatgtacatatcctgcctataggttctttctgaatcttgcatatgcattcctcatcaggcaaacatgttcgtaggtcttaaataaccaactgcaataaaatatcatgttcataggctttaaacgaaatttagcatctagatgtcatgcctataaggtttctgcatttttactacatttataagagtgtccaaaatcgacaacacatagaaagcatgcctataggagccttaatcgaatctgaatcgtttcactcgcttataggtctaaagccagtaacaatgacgcatgctcttttgctaaaacctgcctttctttaataacaaaggattttcttaaattagtatgtattcatgtttgtttcatcatttttggaatcagtagatatcatgcctataggggtctttgtctaacacttaggcaagccatagggtgaagtttataaactgaatcagattttttatcagctacaaccggcaggcagacctgattcaggattcttatctgaactatgtaacaaatcaatttgcctccatcatttaagttttaatcagaccctaaacagtacatgcaagtcatgctaccttatgtgccttcttcggtttaaatgaggtctgtttgagctgttttatttgtttatatgcttccccatacttgccatacgtgttttgattgtcgccttagtattttacatttttaaccataaataagcccaatacctcctccctttaggattagtagtcccaagtgcctccggggatgaaaagatgggggctagtaatagcatgcaataagtaaacgagaccattccgcgctttaataccttaacagtgtgggaaagggtagacatggatatgatgaccacgcgataacatcacgtgtagcccctcattgaggagtgattatcggatgttgtgtggggtgattcatattattaataaacctaggacccccttccctttattttctttgtttcttttaaatctttttaagccatttcttttaagaaaatgaactctttttagttcctttttcttacttttgtttatttgtaaccattacgtgaaaatccactcttatttgaagcctttatttgcctatgtgttatttgcacttaagtcagaacaatagtttggcctggaaccacactagtagatcctgagggatgcctaacaccttccccttgggataatttcaagcccttacccaatctctggttactcaaaacaaacccctcctagtgtcctaatgcactttaatcattaggtgacgactcttcaattcaaaacccaattcctgaatgggaacgagttttcttccaaatgacacaaacccaattttcgcgagaaaaagggggcacgacaaaccacagatgcggtcagggcaccgcataagtggctccacatttgcggtaagttagtcgcaggtgcagaaagtcctcctttaatgaaaagtcgtagatgcgaccttggatccgcagaagagggaccagagatgcggtttcactggtcagaaaatagggatttcgagggtttagtttcaaaacttggaaaaatcaaactggagctcgggagagggcgattttgagaggaagttgaagcggaaatcattgggtaacaattctttaaccctttctagttatatttcatcaatctattgttagttttatcctttaatttcggattggagatgaaaattggggaaaagttggaagaaagttcttagacctagaatttgacttttgattgggaatttgaccttggattttggtacttttggtatgactgaactcgtgagagtgtgaggattctgaaaatgtaaattttaaccgatttcgagacatgggcccgaggggcattttggtcattttacctaatttcgcatgttagcttagaatatttttgtagaatcagttacttaaagtgttatttacattataaaattgaagtgaattgatttgggctatttggagtcgagtactcgtggcaagagcatggtttcagattgatttaagttggttcgaggtaagtggcttgcctaaccttgtgtggaggacattcccccttaggatttggtattgtggtaattgaattgccttgtacgtgaggtgacgaatgtgtacttgtgttaattgttgaaaaacctattttcactaaagtagctttaattgtgttttccttttcttgcttactctacttgaaattttagcctgctgttagcttagagaagcatgtttaattgacttaattgttttattacttaaaccgccttaattgtatcatgtgaagcatgttaggttggaattacctattttacttggtacgaaattgagcttaattgagtattccttgtgttgttgttgtgtgttttattttgggactatgggatggcatcccgagagatcccttgtacgtatttatggtttgagttgaggtgcaggatactgagagatctctagcacgtatattgaggatgctaagagattctcgagataccaggagatccctagcacatattgaggataataagagatcatcgggataccaagagatccctagcatatattgaggatatcaagagatccctggtacatattaagggtactaagagatcctcgggataccaagagatcccatgcatatattgaggataccaagagatccacgggataccaagagatcctagggataccaagagatcactgacacatattgagggtactaagagatcctcggaatactgaggatccccgattattatccttgggaagagtagtattccgtgtgattgtttttgcctctgtttcagttgtagttatctttattatcttatattaattcttattgttatctttcaactgtactgttttatcttattctatcacaccatatattttatttaatattagtagggccctgcccttccttgtcactacccaaccgtggttagacatggcatttactgagtaccactgtggtgtactcatgccctttctgtgcatgtttttcatgtgcagatccaggtacctccacccaaacttatcacgcttgagacgaagcgttcgtagaggctccaaggtatatctgccgcatccgcagactgaagagtccctttctactctcccttttaggtattagcccttctgtattttcttcccttgttagatattctggggttagatacttgtatacactcaaagacttgtgttcatgagattccgagttttgggaaatgtattagtttttgagagttgatattgtgcatgccaagcgacatttttaaacgatggtttatttcactattttggtttttaattgtttcttccgcaaattggtttatttttcacattgttaggcttacctagtcgtagagactaggtgacatcacaagttggttcatggagggcgaatcagggtcgtgacaagttggtatcagagctttaggttcataggagtcatgaatcacaagccaatttattagagtctcatggatcggtacggagatgtctgtacttatctgcgataggctatgtatctgttaggaaaattccacttcatttgatttctttgtcatgtgaggtttgatgtcacaattttaaacttttatattctattctctcacagatggtgatgacatgcgctatccgagatgatcaggcacccacgccccctactgtagccgtcagaggccggggccggggtagaggccgaggacacgcatgtggtgtagctagagcacctacgcgagctgccaccgaggtaccaccagcagttccagccggagtccaatcatttgatacacctactgctactactactccaacacttcaggagactctagcacaattcatgagcatgtacaccactttggcttaggcagggttgcttccccttactgtagctacatctcaggccgggggaggagcacatactcccaccgccacactcctgagcaacaagtgtatgttgagtaggttcccaaaattattcctgtaccgcctgcagtccgagattagcccgtggacagggcagcaatttccgaggatgagcagctgaggcttgagaggttcaagaagtacaagcctcttatatttaatggtctagcatcggatgatgctctgggatttctagatgagtgttaccgcattctccgtaccatgggtatattagggggtttccttcactaccttccagcttcaaggagccgcctatgagtggtggcacacctatgagttagacagtccggatgaggctgcttcactatcttggactcagttttcagatctattcttgagagagtatgttccttagagcctcagggacgcatgacgcacagagtttgagcatttgcaccagggtgctattattgtctcagagtatgctatccgttacactagtttggctagacatgcaccaaccttggtttctactgttcgcgagagggttcaccagtttattaaggggcttatcccagcattaggtctagcatgactcgtgagttggagatggatatttcttatcagcaggtggtgagcattgctaggaggattgagggtatgcatggtagggagagagaggagagggagaccaagaggtctcgagagtcgggctattattttggtgcccgtgccccagctacaggttgtcatggtaggagttatatgagtcaccctattcattcagctcttccagtagccagtggtattccagctcctcttaggcctcaggagccttattatgcacctccggtatctagcgcgcctcttgcacgggatgctttcagaggtcagtccagcagacctggcccgagctagtcacaacctccacgtcctcccagatcttgttttaagtgtggggacacatgccatgttgtgagggattgccctagacttgggaggagtgcgcctccacaaacttctcggccacaacgcgccccgctgagttctcaggctatggttacagctccagttgctaccccacctactcagccagctagaggtggaggtctgggaggtagaggtcaccctaaagggggaggccaagcccgatactatgccctttctgcccgtaccgaggctgttgccttctattctgtcatcataggtactatactagtttgtcacagagatgcatcggttctattcgatccaggctccacttactcttatatgtcttcttattttgctctgcatttgggtgtacctcgggattctttgttcccctgtttatgtttctactcttgtgggagattctcttgttgtgaaccgcatttatcggtcgtgtttggttgctcttagtagttttgagactagagccaatttattgttgctcagcatggtagattttgatattatcttgggcatggactggttgtcactccattatgctattcttgattgtcacgccaaaaccgtgctggctatgccaggtgtaccgcgtgttgagtggaaaggtactttagatcacactcccagtagagttatttctttccttaagtctcagtgaatggttgagaagaggtgtgatgcgtatttagcttatgtgagagatgttagtattgatacccctttagctgattcagtcccagtagtacgagattttcccgatgtgtttccaactgatcttccaagcatgccgcctgatagagataatgattttggcactgatgtgttgccgggcactcaccctatttctattcctccgtattgtatggctcctcctgagttgaaggagttgaaggagttgaaagatcagttagaagaattgcttgataagggttttattcggctgagtgtatcaccttggggtgctcctgtcttgtttgtgaagaaaaaggatggttctatgcatatgtgtattgattatcgctagttgaacaaaattaccgtaaagaaccgttatcctttgcctcatattgatgatctgtttgaccagcttcaaggcgcacatgtatttctaagattgacttgcgctcaggttgccatcagttgaagattcgggagccagatatcccgaatactgctttcaggactcggtatggtcattacgagttccttgttatgtcatttgggctgaccaatgccccagcatcctttatgcatttgatgcacagtgtgttccggccgtatcttcactcattcatcattgtctttattgatgatattatggtatattcccggagtcgggaagatcatgagcaacacttgaggactatgcttcagactctgagagagaagaaattatatgctaagtcctcgaaatgtgagttttggttggattctgtggcattcttgggtcacgtggtttctagtgagaggataaaagtggatccgaaaaaggtagaagtagtgcagagttgtccaagaccatcctcagctatagagatccgcagttttcttggcttggcgggttattaccattgttttgttgaggggtattcatcgattgcagcccctatggggtgctccgttcccatggacggaacagtgtgaagcgagctttcagaagctcaagatagctttgactacaaccccaatattgatattgcctacatgttcggggtcttacactgtctattttgatgcctcgaggattggccttggagcgattttgatgcaggatggtagggtgattgcctacgtgtccagacagttgaaggttcacgagaagaattatcccatccacgaccttgagttagctgccattgttcacgccttgaagatctgacgtcattacttgtacgatgtcccctgtgagatttatactgatcatcggagctggcaacacatgttcaagcaaaaggatctaaatttgcaccagaggagatggttagagttgctgaaggactatgatatcactattttttatcattcgggcaaggccaatatggtggccaatacttgaatcgctgagcaaagagtttgggaagtttggcttatttaccgacatcagataggcctatggcgatggatgttcaggccttagccaaccagtttgtgagattggatctttcggagcccaatcaggttctagcttgcgtggtttctcggtcttccttatttgatcgtatcagggagcgtcagtatgatgaccctcatttgcttgtcctcaaggacaaggttcagcatggtgatgccagagatgtgactattggtgatgacggggtattgaggatgcagggccgaatttgtgtacctaatgttgatgggctttgggagttgaatctagaggaggcccatagtttgcggtattccattcatcccggtgacgcgaagatgtatcaggatttgaggcagcactattggtggtggccgatgaagaaagatatagttggatttgtagctcggtgcctcaactgtcagcaggtgaagtatgagcactagagactgggtgggttgcttcagcagatagagattccggagtggaagtgggagcggatcaccatggactttgtagttgggctcccacgaactttgagaaagtttgatgctatttgggtgattgtgcatcggctgaccaagtccgcgcacttcattcctgtgtgtactacctattcttcggaatgtctagcagagattcatatccgggagattgttcatctgcatggtattccagtttccatcatttcagatagaggtactcagttcacatcacgattctggaaggccgttcagcatgagttaggtagtcgggtggagttgagtacaacatttcaccctaagatggacggaaaatccaagcgcactatttagattcttgaggatatgctccgtgtgtgtgtgattgagtttggagggtcttgggatcagttcttgccattggcggagttcgcctacaacaacaactatcaatccaacattcagatggcaccttatgaggctttgtatggtaggcggtgtagatccccaatgagttgtttgagcaaggtgaggccagattattgggcacagacttggttcaggatgctttggagaaggttaaggtgattcaggatagactccgtacatcccagtccagatagaagagttacgcagactaaaaggttcgtgatgtttcctatatgcttggagagcgggttctgcttcgggtatcacctatgaagggcgttatgagattcgggaagaaaggaaagttgagtccgaggtttattggcccttttgagatattgaggcgtgttggggaggtttcttaagagctttccctacctcccagcttggcaggagttcatccggtatttcatgtttcgatgctctgaaggtatcacggtgattcatcgcacgtgttggatttcggttcagtctagttggacaaggatctatcctatgttgaggagccagtggcaatattggacagacatgttagaaagctgaggtcaaagaatattgcatcagtaaaggttcagtggcggggtcagccggtcgaggaggcgacctgggagatcgagcaggatatgcgcagccgttaccctcatcatttcactacttcaagtatgtctctatgctcattcgaggacgaatgaatgtttaagtgtaggaggatgtaacgacccggccggccgtcttaagaatttatgccccgatcccctattaactacttttcccgtatttatttatgatattttgatttgccaggatgttcggttttgagacacttagtccctaaatgagagcttaagttttgaaaaatttgactgtagtcggaaaagtttgaagatggcctcggaatggaattctgatggttccattggctccgttaggtgatttcgggcttaggggcgtgttcggattgtgtattggaggtccgtagctaatttaggcttgaaatgctgaaagtcaaatttcgaagtttccggttcgttagtgagattttgatccgagggttggaatggaattccggaagttggagcagctccatagtgttgaatgtgatgtgtgtgcaaaatttctggtcattcggacgaggtttgatagactttttgatctaaagcataaatttagagttttagagttcttagacttgaatccgtggttgattcgttgtttcgatgttgttttaggtgttctaaggattggtataaatttagatagtggtaaatgacttgttcgtgcttttggttgatgtcccgggggcttcgggatgatttcagatgtttgccagataggtttggagttgaaagtagcagctgaagctttaagtctgctgtcataaccgcacctgtggcttggggaccgcaggtgcgaggccgcaaaagcggtcgagcaactgcagaagcggtttaaggtaaaaagggagttgaccgcagatgcggtcagggcaccacagaagcggctccgcatttgcggtaaggtagtcgcaggtgcggaaagtcctcctttaatgaaaagtcacagatgcaaccttggctccgcagaagcgggaccgctgatgcggtttcactggtcagaaaataggaatttcgagggtttagtttcaaaacttggaaaaatcaaattggagctcgggagagggcgattttgagaggaagttgaagaggaaatcattgggtaacaattctttaaccctttctagttatattccatcaatctattgttagttttatcctttaatttcagattggagttgaaaattggggaaaagttggaagaaagttcttagacctagaattcaacttttgattgggaatctgaccttggattttggtatttttagcatgactgaactcatgggagtgtgaggattctgaaaatgtaaattttacctgattccgaaacgtgggcccgaggggcgttttggtcattttacctaatttcgcgtgttagcttagaatttctttgtagaatcagttatttgaagtgttatttatattatgaaattgaattgaatagatttgggccatttggagtcgaatactcgtggcaagagcgtggtttcagattgcctaaccttatgtgggggacattccctattaggatttggtattgtggtaattgaattgccttgtacgtgagatgacgagtacatacttgtgctaattattgaaaaacccgttttcactaaagtaactttaattttattttccttttcctgcttactttacttgaaattttagtctgttgttagcttagagaagcatgtttaattgacttaattgttttattgcttaaactgccttaattgtattatgtgaagcatgttaggttagaattacctgttttacttggtacgacattgagcttaattgagtattccttgtgttgttgctgtgtgtttttactttgggacaacgggacggcatcccgggagatccctgtacgtatttatggtttgagctgaggtgcgggatacagagaaatccctagcacgtatattgaggataccaagagatcctcgggataccagaagatccctagcatatattgaggataacaagagatcctcgggataacaagagatccctagtatatattgaggataccaagagatccctggcacatattgagggtactaagagatcctcgggataccaagagatccctaacatatattgaggataccaagaaatccctggcacatattgagggtactaagagatccttgggatactgagagatccctggttattattcttgtgaagagtagtattccttgtgattgtttttgcctctgtttcagttgtagttatctttattatcctgtattaattcttatcgttatctttcaactgtattgttttatcttatactgtcacaccgtatattttatttaatttcactagggcccagaccttcctcgtcactacccgaccgaggctaggcttgacaattactgagtaccgttgtggtgtactcatgccctttctgtgtatgtttttcatgtgcagatccaggtacctccacccagacttatcacgcttgagacgaggcgttcgtagagattccgaggtatatctgccgcgtccacagaccgaagagtccctttctactctcccttttaagtattagcccttctgtattttcttcccttgttagatattctggagttagatacttgtatacactcaagggcttgtgttcatgagattccgggttttggaaaatgtattagtttttgagagttgatattgtgtatgccgagcgacatttttaaacactggtttatttcactatttcgatttttaatttcttccgcaaattgatttattttctgcattgttaagcttacctagtcgtagagactaggtgccgtcacgatggttcacggagggcgaaccagggtcgtaacagattctcttcattgcttgcactccgctcattttgctctattcttcgattcgtatcttgtataccttcgatggtataagagaaaagtataaagacaatatttgtgttaattaactttttaagaagatatattcaaaaaagcattaggcgcgaattataaagtctcatttgtcgaatgcgattataagtcgcaggcaacatgattcactctgttgctcgatgatttaaatctcctcgtatgctaactccttatgtatataatcaacgatttttaatttctttactaaatatattaagttattttttttctcttttttagctacatataaattccccgaacaaaaatgatttcagaagtatttctcctctgattataaccccttatataatcaacaactgtctatctttttgatgaatataaaaatttattgttgctcttggataaatatagtttcaaatgtgttaaatattattttatcaattgaattttcttaggccattaataaatgtatgtatgatatattgaggaataattcattactatgtatattggactttttgattttggtcgctttacgtgggctgatccaacccatgtaaaagagataagagaattatctataaagaaatttactgcacaataaaagggagaaaaatatgaaagagtgaaaagttgtttttttcagaagaaaacggtatcttttcttctttaaaaggaaaagtctgcataagctttcaaatacaacttcaagagacagaaaaacttcctcttgaattctcccataaacacacacaaaatctaggatatttagttcgtggataaaactttgttttcaagagattcagagtacgatttggggctattattttggtagtgagtttaacaaatcttctactgtgttattgataggtacgctattgttgttctcgccccgcgaattattctaacaatggcattagtgcctacgtgtttactcctagttgctgccaccatgatatatgcttcgttacagataatctttgtttggtgtaggcactgattttctttttggccgctcaaactggataacctaacaaattgatgttaaattctttgctgaggttaccgactaagaaggaaaacaaaagacgttgtcggggtttataatgatcttcatagatcttgtatatattttcttttgacaagtacaattgttctatagaaaatagatttatcagaatgatatccttttataaacaaagtatgtcatgtcagtagaaatttcctacatatcaatctaatgatgacaatgtcatgagcatattaaaagacatatgtagattccatgaatttgctaaattgtctttttgttataatacaagacacaatactactttcacatttttttggaggcatttggatagccccgtagaattttgaccataattaatttggttagagaagtatcgttggatataaataattttttttccaaatgaccatactttatttgaagtgctatagaattcaattacgtaaggaactatggttaacttgaataagtttccttaatgacattttctttgtgtgaaccgtgaactaatataaactgtccttaatataacttaatatctccttaatatagaaaattaatttagccctaatcccttgcattggcatacttctacgagttattgtgacatatattgtcatattgaatggttatagccattcttattgtttcctcggtcctatttcagatatgactgaacaaggacaagttcgaattactccaaatgagagttctcaaagtcaaggaaggagacaacgtagaaggatgcatcgtcactggacttatttctataatgattcaaacttagaacctgacgtcatcaagaatgtctcgagagcgatgcaaaatgagttatgggatcagagggctaagcgaaggaaatgaaaaaagaaacttagggagtctatggactttaaaatgggccctgatgcttccatttctaaacatgtgcacatttttcagttaaaaaaagctgaattgtctagttacatagagattacttattgaaaaacattaactattttagcaaactctcttcgagagccttggggtgaaattttaactgagatttatcatgatatttggcccaatgcaccttttagcgtatatgtgcaagagttagtattcaattaatacatggatgtcctagcaaacatgtaaattgttattatatattttattttaatgaaattaaattatattatttgtctcacctattacatatattatttattattttattttgcaatggactgactttaatattaattaaaatatttggatatagatgataagtgaaaacgtaatgaccttttgattctatattaaatgtagagttagtattataattaatttacttgagtgtgtaatcacatgcataaattaattgcaatatatattgatgagttaaacttataatattgtttctaataacagacatgccatcgaaaagtatcattgctaacttaaataagggtgacaaactgaatggtgaaaatacgacatctggagttgtaaaatatggtatgtactcgaagagcaatatgctcttgaaattattaaccatgttatgagtcacccagaggagggtaatattgcccaacacaggagggatctgaaaacttacaatatttggaaaaataaagattccactgcatgtgaaattattgtaagttcagttactgatgatatcattcatgaatgtgagcaatatcctactactcaagccatgtgggcacatttaagagaggcatattagggtacaactgtgaatcgtcttcgacagttgataatcaagtttgacacatacaaaaagtgtcatgatcacagtgtcaagtaataactaaaggtgatgtcaaatatgattgctcaaatcaaagtgctggccatgttctcagagatgagaaacaggttcatgcagtgattcagtctctcctaataattgaaaatatctgaaggttagcttgacccacaatgatagcattaaaacttttgttgattgttgcccgtcatgtggagcttgaagacaagcggtttggtgctgctaaagctgtacctaatgcctttgtgacataatcaagtggtacaaagagatcatgtcacaaccccagtttgccctccatgacttgtcgtaacggcacctagtctctacgactaagtaagtctaacaaatgtggaaaataataatttgtgaaagaaataattgaaaaccaaaataaccgaatgaattagtatttaagatgccgctcagcatatataatacaactctctaaactaacaacattttccaaaattcggaatctcatgaaaccacaagcctttgaatgtttacaagtttctaactccagaatgtctaacaaaagtaagcacagaagggctaatacttaaagagagcatagaaagggactcatcgttctgcaaacgcgacagatatacctcgaattctctgggaaagtcgcctcgcctcaaaggtgataagactgagtcgaagtacctgtatctgcacatgaaaaacaagcgcagaaagggcatgagtacaccacagcggtacttagtaagtgccaaacctaacctcgatcgagtagtgacaaggaaaggcagggccctactgagattaaataaaatataaggtaaaatagtataaaatgagatagtataactaaatgtaacagtaagaaataacacataatagaaggaacaacaataactataatagagacaaacaatcacagaaaaagagtacaactcaacttagagataacaaccggggatcttccaggataccgtccttattggcccaagaacaggtgaagtacaatcatgatcaacctgtacctatgagatgcacgtgaaggagataaatctaaattatcaagaagtaaatctcccgatctgattgaaaaggttgcatattggataaggagaggaagactccttatatgaagagaacacagtttaggaagatgatagtgttagagtttgagatcaacttgaactcttctacgatagaagagtagcatctgtatcccagtcaatctctaattactaacctattaaatgtcagtgttgtttctttttacaggtaatgcacataagcagaagttaaacttaaattgagagcaaaagagcaagcgattttgcaagcaatttatgtgtgattaagagtgcaatcctgaagctacttgaacaagatagaaaaaaccagttccaagtgtctatcttttatagttcaattgtagtaggtaattttacattgtacctttcagctttcatagaagcaattgtattaggtacctagagtgttcaagttagggttaacttgaagttgtcgcaacagttgaggctatgtgccacaacatgattagagttaatccttaggtttacaaagatttttgtaaatgctgttttagctcagtgattttagtggaagtttgggaaaatcctactgagtaataggtcgtggttttttcaccttttgagccaggtgttttccacataaaaatctctgtgttctttattttctttacttattattccgcaaacagtagtagttggcacagatagaaaaaccaggtccttctttagtttagttaagcgaaaattgagtaccacacaaatcacccccctcttatgtggtattgaagtctaaaacattaattggtatcagagcattttgtccttgaagaggttaacaccttaggaaaagatcaagatgagtgcaccacctggaaactgggaagggcaatccactgctaggccttcactctttaatggtcagtactattattggtggaagaacaggatgagagatcacatcatagaagaagactatgaactccgggacatagtcactgatggtcccctgactactacaaagaagaacgctgaaggagtggatgtgccaaagacaagagttgactgcgctgctgaagacttgaagaaatgggaaaagaatgccacatccaaaaaatggcttgtgtatgaactgggtccagacgagtacatcaagattcaaagctgtaccactgctaaggagatatgagacactttacaggtgattcatgaaggaactcctcaagtaaagagatctagaggaacactactatattctcaatatgagaatttcactatgaaggaaggagaaagtatccaggagatatacataaggttcacaacactaacaaatgaacttaaatctcttgggagaattatccttgaagaagacaaggttgaaaaaatcttaacaagggtcttaccagtaacttggaaaagcaaaatcactgccattcaggaatcaaagaacattgctactctcaagttggatgaactgattggaaatctcaatgcctatgaactaagaaggcaaaccatgaaaatggatgcacccaagaaggaaaggagtctgcctcttagaatagctaaaggtgcagatttggaggacgatgaaatggccattatcacaagggatttcaagaagtacctgatgagaggaaagggtccttcaagaggtactaccttcaacaaaccaaaggctcttgagaagtagacaaacgagggctgctacaaatgtggcaagactgaccacatgatcaagaattgtcctcagtggaaaatagaatggaataaggaaagggctgaatgaaggaacaagaagaaggaacaggttcaacccaaaaggaacaaaggatcaacaaaagctatggttgctgcttggggagaagcattagataaggattcagaagatgaagctggagatgaacaagcacatatggccatcggagaattagataatgaacaagaggtaagtgtgattcatctcaaagacaagattaaatttctgtctaaaaaaagttatctgaactatttctagactttattgatgagtctaaggtaattaacaatgagaaggaacaactgtctagggagtgtgtgatcttaaaagccaagtgcaaaaatctagaatctagggcaaatgagaatgacaataaaaatgctaagttgaagaaccaggttcttgaacttgacacaagtatcttagaacttaggtctgaaaatttaaaaataaaattaggaacaggtaagaagaaatctgatcacacacatctcaccttagaagaaaatctaggaaaaatgaatgatgagttgtacaaggaaagatgagcagataagagtcttaaaagaagacctagggaaggtaaagcatgaactagacagaatttgcaaatggaataaggcttctgatgcactctcatggttacaagaacaccacaatagcaacaagagaggacttggctatgggacccaagcacctaagtgggaccccaaaaataagtacatcactcttcttgagaacaaaatctgcacacactatggcaagactggtcattacaaaaatgaatgtaatgcaaaagaaaaggccagtcaaaataaaataggctgcctgggtgggcctaaaggaatttaatttacccatttgcctatagaaagagacctaaactagtttgggttcctaagactaacccctgatttctttttgcaggtccaagtgaagggaagtagccaaatatggtacatggatagtggctgctcaaaacatatgactagaagcaagaactagttcctttcacttgagaacttaaaaggaggtaatgtctcctttggaaattggaagaaatgtgagattattggggttggaaaggtaggtaagacagactcacactccattgagaatgtctacttgatagatggcttgaaatatagcctaatcagtgtatcacaactgtgtgacagaggtaaccttgtagcatttacctctaccaaatgctttgtgattaatcttaccactgacaagattgttttgcagggaaaaagagttaacaatatttacattgtagattcgtccactctttcagaaaatgaactcacttgattgagtgtgttggacaatgatcccctcctgtggcacaagagacttggtcatgcaagtctgaattaactcaacaaattagtttccaaggacttggtgatagggttacctaacatcaagtttaaggaagacaaaatttgtgagacctgtgcaagggggaagcaggtaagatcatcctttaaaagaaagaaaatggtaagcacaaccaggatgatagaactggttcatatggatctctgtagtccaatgagaacattgagcagaggtggtaagaaatatgtgatggtacttgttgatgattattctaggtttacctgggttctattcttaacatttaaggatgaagcatttgacatgtttactgcctttgttagtaaaactcagaaacaactaggtaatcaacttgcatcaatcaggtttgatcatggaactgaatttgaaaatgctaaatttgctgaattttgtgatgagcatggtatagatcataatttctctgtccccaggactcctcaacaaaatggagtagttgaaagaaagaacaggactctagaatatatggctaagactatgcttctttctagtaaactgccccataacttctgagcagaggctgtaaacattgtatgttatatcattaatagatgcatgactagacctcttgtatagaagactctctatgagttacttaaagggggaaaaccaaatatatcccatcttagggcatttgaatgcaagtgctttgtgcacaataatggaaaggactccctagataagtttgattccagaagtgatgagagagtattcttgggatattcttcatatagcaaagcttataaagtgtttaataaaagaactttgtgtgtagaagaaagtgtacatgtagtttttgatgaaactaacattctttttgagagacaggaacatgaagatgaagctattggtctggtaaaagatttgagtgaagtctcagctcaagctaaagtggcaccaaaagaaggagtaggtgatggaacatgttcttccatccagggcaacttggtagggggaactgatcaaagaggaactgaaatcaatcccctaaaggaacctgttcatgaccctgttcctcagcaacagaacatgggaaaaacatcaagtagaaatctgttggttgtgaaactgcacaaatatcaaatttctcatcccattgagaatataattactgatccaacctctggagttaaaactagatcacaattaaagaatctgtgtgcttttgttgcttttctatctattattgaacctaaaaatattgttgaggctttgcaggatgcagattgggtaagtgcaatgcaatatgaactcaatcagtttgagagaagtcaagtttgaaatctagttccaagacccaaggacatatcagtaattggcacaaaatgggtcttcagaaacaagtttgacgaagatggaacagttacaagaaataaggcaagactggtggtccaaggttatagccaagaggagtgtatagattatgatgaaacctttgctccagttgcatgactggaggcaataagactcctcatagcctttgcagcacatatggaattcactcttcatcagaatgatgtcaaaagtgccttcctgaggggctacctaaaagaagaagtgtttgttaaacaacctccagagtttgagagcgaggaatgtcctaaacatgtgtacaaattagacaagactctctatggactcaagcaagctcctagagcatggtatgaacgattgtccaaattcctgcttgaacatggctacaaaagaggtaaaattgacagtactctattcttgaggggaaaaaggtaaggatcttcttgtggtacaaatatatgttgatgacataatttttggggaaaccactgacaaactaagtaaggattttgccaaattaatggggagtgagtttgaaatgagtatgatgggtgagcttaactttttctttggcttacagatcagacaaaacccaaatggaaccatgatccatcagcagaaatatgcaaaagagttgatcaaaaattttaaaatagatgaatcaaaggaaatagacacccctattgcaattgccactaaattagacatagatgaacctgattcatctgttgatcagaagttgtatagggatattattggtttacttttgtatcttactgccaacagacctgacatagttttcagtgtggggctttgtgctcattttcaggctaatttagaggaatctcacttgactgctatcaagaggatactgagatatttgaaaggcactactgatctgtgcctttggtaccctaaaggtagtaatttcaatctagtagggtatgctgatgttgattatgcaactttccttgtggataggaagagcacctcaggtatgactcattttcttggttcatgtcttgtattatgggccactaaaaagcagaattcagtggccttatccactagtgaggctgaatatgttgctgctgcctcttgttgtgctcaattactgtggatcaaacatcaactgatagattttggcattgaagttggttgcattcctatcttctgtgataacactagcgctataagtatgacaaagaaccctattcatcataaaaggactaagcacatttatgttagacaccacttcttaagagataactacgaaaaaggattgatctccatagaattatgtgctactgataaacaaattgctgacatctctactaaagaactgagtagagaaaattttgagaggaacaagttggaattagggatgattaagatcacctaatagtaccagctcagaatgcacaatgaaaaaaaaatgatgaaaaaaaaatatgaaaaatgaatatttttttgctaggaaatctgaactagtgtaaatatctagattaagttttactcagcttcatactgtaattagtatactcctgtgacatgtgttaatatgactgactgatctcttacaaaattttctctattatggtaaattgaggcatgctcaagagaattctaaatgaagaacctggttcatcagtatgagttcatctgaatgctgaggtatgttttctatactctgcacaattagaaataattttttttaaatcatgagcagaagtcctacaattgttcaactccttagaaaattctatcagtttgtttttgaaccagttccgtcagctttagaactctaaaccacaaaaactgatctagagaagcctaaccattcattcaaacctaaaatttcaggttgattagacctctaattgaccactgctaaagttgctgttaaacattcaatgtgtatttctctttaaatacacatcattacctccttccatcttcataattctaagccgtcaaaaacccttcttcactttcaattactttcttctccaaagttctaactcaccaattctctcacgaaatcagcgataatgacaaacccacaagattaccctagaattcctcgactacccactccctcaaattcatctacccttcctccacctagcacatctcccaaacccaggttgagaagggtaaaaaatgcttgctcgaaaaacagtagcttctagggctctttcaaagaattgaatgagaaattaaaggcaagtaagtccaagactctaactccaactttgattctgagtcgtacaagtctgctagtgagggggaaggacctgggtcttctgactcggagaaggctcaagaatccccttctaaggtaagttcttttttgactgagaatttagaaactaggtttgttttggttaggcctatcagggatgtggaattacctgagttacgaaggagtggaggtaagaagaaatctaaaaaagaaaaagagagagagagggtgcatgtggtgacgagaggggaaaaagggaaagggtggttgatcattcaaccactaatgattagtctgtacctgctatctatggggttgaacaagaaaatgttgaagaaagtggcaagaagtcagggggaagtggttttagtgaagctgctgaagggttagttaatctaagcgcctaaggagatgaacctggttcatcaactgaagagaccctagcagacccgttgaaaaaggttggggcaagttatgatccaaagaaaagaaaaactcctacaccaaaagcccccagtgctcctaaaccctccaagaaaagaaaggctttatccccaacaactactgaaatttccttgccaaagggaagagccacaagaagtagggtgaaatagagtgagagtgatctacaaaaggctctggttgagagtaagaagaaaaggatggataaaggaaaagggaaggttgcaaagtcctcagaagttgtggaagttgcagagatggaacaggtccatcaggagacagttacaacagtggaggttcagacccccaaggccaaaattcctaagacttcttctaagaagtcttcctttgtgtctgaggctgctgaaccttcattagccaagaggacaaggtttgcagtaaaaggtaaacaagttagaatttctgaagatgaggaatagagtggtgaaaaagaagaagatgagtctgatggtgaacaagacaagcttgccatgtttggcaaaagaaaaattttgaagggtagattgctgaaagacctggtggagctaggaatgatgagactggtagatgccttagctgctcagggctggaaggacatggtcctttagatggatggaatgctagctaggaatgagatcattgagttcatggcaaatgcataggttgacctttgatgcaaagaagctaggggagatacttgacataccctctgaagggtttgatgactatacaaggcaaaggtggccatgtctggactctcttcctactgcccttgaaattaccaggaggttctgtgatgctgcagatgtgaatgaggctagggctgttcagaagagtgaaatgagaccacaacacaaagtcatttttgtgtttgtcaacaagtgcctactgcctaggcaggagagaaggcatattgcaaattatatggacttaattctgatggagtgcctggaaaatgaaaggcaaattaattggcctgcattcatcatcaagctgctggacagggtcatcaatggctccaaggctcatgctaccccctatggctttattctggctacagttctggataggtgcaatgtgcctctgaagaaatgggaaatgacctcaagaaaggaccactttggcattaatattgtgcttgcttgtgactatttagtcaatgccatcccaaatgaacctggttcatccaataagactcctatcaatagtaaagtcagggctcttgttcaggaaagtgaagccaaggatgctgagatagctaggctcaaggatcgtgtgacagaggtagaatctgagagggatgctctcagaactgagcttaccaaggaaaaggagaagaatgatggaattcttcacaatatgctgaatcttctccaagcccaaagccaaccctctagctcccccaagccttaggaattctagcctttgtctcctaaacctgtctagtaccttcagtgacccggattaaggatttttctttctttttgctcatggtttaaatgttttttttgctttctggttgtggattgtggtagcaacatatcttctatcaatgatatctactgtttttgctcttgttcaatgttaatctttccttgatagtttaaatatttttgcttgattactgatgattaaaccatgattgcacttgcagttgccccagtggccatgagtacttattaaaatgtgggactcacactttgtatgcaacttttcgatgatgataaaagggggaagagatattgtgctttacatattctgaataagtgatatttataacctaattaacctggtccttgatgataagtgaattgtctaaactttgtattgatggttaagctgagctcttacaggatccaagtaagtaaaaagcacagagtttgtcatcatcaaaaagggggaatttgttggcccaagaacaagtgaagttttgaagtctgacaaaagaactcagacatggaccaggtctatcttgtgaagcacagtcatgatcaacctatacatatgagatgcacgtgaaggagataaatctaacttatcaagaaataatatctcccgatctgatcgaaaaggtttcatattggataaggagaggaagactccttatatgaagagaacacaattttggaaaaggatagtgttagagtttgagatcaacttgaactcttctacaatagaagagtaacatctgtatcccagtcaatctctaattactaacctattaaatatcagtgttgttctcttttacaggtaatgcacataagcaaaagttaaacttaaattgagagcaacagagcaaggcgattttacaagcaatttatgtgtgattcaagcgtgcaatcctgaagctacttgaacaagatagaagaaccagttccaagtgtctatcttttattctagttcaattgtagtaggtgattttacattgtacctttcagctttcatagaagcaattgtattaggtacatagagcgttcaagttagagttaacttgaatttgtcgcaacagttgaggctatgtgccacaacatgattagagttaatccttaggtttacaaagatttttgtaaatgctgttttggctcagtgattttagtgaaagtttgggaaaatcctactgagtaataggtcgtggttttttcaccttttgagccaaattttttccacgtaaaaatctctgtgttttttattttctttacttattattccgcaaatagtagtagttggaacacatagaagaaccaggtccttctatagttcagttaagcgaaaattgggtaccatacaaatcaccccattttatgtggtattgaagtctaaaacatccgtcctatagtcccaaatatacatttccaatagatatgccgggataccatcccgtagtccaactcatagtgtgcggggatatattggaatcccaatccgtagtcccaaatgtaaatacctagtactgggggaatctaccgggtgcagtcccgtagttccatataactgtgcagggagatctaccggaatcccacatccgtagtccaaaataaatagacaaggaggatctaccggaatcccacatccgtagtcccaatgtaaatgcacagcaacaacatgaaaaatattcagcaaatgtcaattttatattaaggcaaacaagtaattctagcttagcatgctgcacagatttcaggtaaagcagtttgagcaaataaagcaattaaatcacttagacatgcttccctaagtcaacaacatgctaaaattgcaagtagtaataacaggaggagaaacacaattttaattacttagtgaaaaccggattttcaacaattaacacaagtacgcactcgtcacctcacatacaaggaatttcaaatatcaacaatatcaaatcctaaggggaagtcccccacacaaggttaggcaagccacttacctcgaaccggctcaaagtcaacccgaaaccacgttcttgccacgagtactcgactccaattggacaaaatctattcaattcaattacataatgtaaataacacttcaagtaactgattctacaacgaaattctaagctaatacgcgaaagtaggtaaaatgaccaaaacgcccctcaggcccacgtctcggaattgggtaaaacttacattttcagaattctcatactctcacgagttcatgcataccaaaattatccaaatctaatgccaacttcccaatcaaaactcgaaatctaggtctaagaactttcttccaacttttccccaattttcatctccaatccgaaattaaatgacaaaactaagattagattataagcatgcaactagaaagggattaggaatcgttacccactaattttcccttcaaaatcctcccaaaatcgccctctcccgagctccaaatcgattttccaacttctaaaactaaaccctcgaatttctgattttttgcccagcaaacccgctccggtccaccaatcgcatcttcgataccacttctgcggttctcacttaaaattccatctcctcacctgcgacccatatgccacatctgtggtctcccatgtgcgctaacccatcgcttctgccgtccctgctctatttcctcttggcctctcaaccgcaccgcagatacggttatgacagcaacccaaagaacttcagctgcaaattccaaatttccaacttcccgttaaccacccgaaatcatcccgaggcccccaggaccttaaccaaatgcacaaacacgtcacataccactatccaaacttacacaaatctccaaaacacctcaaataacatcgaatcaaccaattagcctcggattcaagtctaagaacttcaaaaactcttaagatatgctttcgatcataaagtctatcaaacctcgtccgaatgacctaatattttgcacacatgtcacattcaacacctcagagctattcaaactcccgaaattccattccgaccctcggatcaaaatctcactatcgaactggaaacttaaaaaattcaactttcgacatttcaatcctaaattagctacggacctccaaaacacaatccgaacacgctcctaaactcaaaatcacccaaagagataatggaaccaactgagttccatttcgaggtcgactttacaccgttctgactacagtccaaattctaaaacttaggctcttatttagggactaagtatcccaaaactcttcgaaattccaaataactcctctcagcaactcacaatatcagaaacaaacacgaagaatgcaataaatagaggatcagggcgtaaattcttaaaacgaccggccgagtcgttacattatcccacacttaaatattcattcatcctcgaacgagcatagaggcatcctaaagtagtgaaaagatgatggtaacggctacgcatatcctgctcggtctcccaggtcgcctcctcgaccggctcgccctgccattgaacatctactgatacaatgttcttcgacctcaactttcgaacctgcctgtccaatatcgccacaggctcctcaacataagatagatccttgtccaactgaactgaactgcaatccaacacgtgcgatggatccccgtgatacctccggagcatcgaaatatgaaataccggatgaaatcctgccaagttgggaggtaaggtaagctcataagcaacctccccaacacgtctcaatatctcgaaaagaccaataaacctcggactcaacttccctttcttcccaaatctcataacgctcttcataggcgaaactcaaagcagaacccactctccaaccttataggaaacatcacgaaccttccggtctgcgtaactcttctttctggactgggcttacggagtctatcttgaatcgccttaagcttctccaaagcatcctgaaccaagtctgtgcccaataatctggcctcacccggctcaaaccaacccaccggggatctacaccgcctaccatataaagcctcatatggtgctatctgaatgctggactgataactgttataagcaaactctgccagtggcaagaactaatcccaagatcctccaaactcaatcacacatgtacaaagcatatcctcaagaatctgaatagtgcgctcagactgtccatccatctgagggtgaaatgctgtactcaacttcacccaagtacccaactcatgctgaacgtctctccaaaactgtgatgtgaactgagtacccctatctgaaatgatggaaacttgaataccatgcagatgaacaatctcccggatataaatctccgccagatgctccaaagaataggtagtacacacaggaatgaaatgtgtggacttggtcagccgatccacaatcacccaaatggcttcctcaaagtctgtgggagcccaactacaaagttcatagtgatccgctcccacttccacttcagaatctctatctgctgaagcaacccacccggtctctaatgctcatacttcacctgctgacagttgaggtaccaagctacaaacccaactatatctttcttcatccacctccaccaatagtactgcctcaaatcctggtacatcttcgcgacacccagatgaatggaatatcgcaaactgcgggcctcctctaaaatcaactcccaaagcccatcaacattgggtacacaaatctgaccctacatcgtcaataccccgtcatcaccaatagttacatctcttgtatcaccgtgctgaaccttatatttggggaaaatcaaatgggggtcatcaaactgatgctccctaatacaatcaaataaggaatacaaaccatgcaagctagaacccgactgggctccgaaagatccaatctcacaaactggctagctaaagcctgaacatccatcgccatgggtctctctactgctggtaaataagccaaactccccaaactctctgcccgacaattcaaagtgtcagccaccacattggccttgcccgggtaatacaaaatagtgatatcattgtccttcaacaactctaaccacctcatatggcgcaaatttagatccttttgcttgaataggttctgcaagctccggtgatcagtataaatctcacaaggaacaccgtacaaataatgacgccagatcttcagggcataaacaatggcaggtaactcgagatcatgaacatgataattcttctcatgcacctttaactatctggatgcgtaggcaatcaccctaccatcttgcatcaaaacctctccaaggtcaatcctcgaggcatcacaatagacagtataagaccccgaacttgtaggcaatattaaaactggggcagtagtcaaagctgtcttgaacttctgaaagctcgcctcacactcttctgtccactataagggagaacccttctgggtcagcctagtcataggggctgcaattgatgaaaacccctccacgaaatgacggtagtaactgtcatgccccaaaaaccgaggagcgcgaccggcgctcaaccgagtatacccgactgagcaagtctgctaggtttcattctacccaaactaattcacgaacaagtaggagatggactccattaatcatacttagtaagtatttcattatcaacttccatttcatttccattagcaacttaaatcataattatcaaaatattacaagttttataaatctttaccaaacatcaatatttctactttaattccaatacccgacactacccacaacctgtctacagagcctctaaacacaactgaagagtaatataatatggaaatgccggtaacaaggccccgactatacctccattgcaaagtacatgatgaacagatgaaataggaccccgagagagaaatacttagtaacttaattatatcaaatacaaagtacatgatgaaatacttagtaaatatttcattatcaacttccatttcatttccattagcagcttaaatcataattatcaaaatattacaagttttataaatcttttccaaacatcaatatttctactataattccaatacccgacactacccacaacctgtctacggagcctctaaacacaactgaagagtaatgtaatatggaaatgccggtaacaaggctccggctatacctcaaatacaaagtacatgatgaacagatgaaacaggaccccgaaacgaagtggggctcaccaagtcagctgaaaggatgatgcggcactagctgcgaccaacactgcctgctataaaaacacctacattcatttaaagatgtagcacccccgacaaaagggacgttagtgccatcgaatagcactagtatgtataactaaacaccatctagtaagaaagaactttcatacgagaataaagaggaaatcataaagacaacaaagtttcaaataagcaccatgccaacaatataaagaggttcacatgattttcacatagttcttgaaattttagattggagcatcccacactgttgcatcattatccatattaccaccacttccgtgagggagttagatcacgacccgatcggctaagccgtctccccgatatgttaccattattttattcacactttccagtttcattcatccatacattaccaccacatgtatatatatcatggagtccgatcatggcctgatgggctaagccgtctccccgagacgttaccattttccatcaatcatctcaattcgatccttgtttcacatatatcatttcataggtacatggggccacaactatcacgtcatatatttggcactaggccacatttcacatcattcccaatttcaatgttagatttgtgatttaggatgatatgtgtacacaagggcaaataaaattgtaagcatagatgagacttcacatagaggacacaacatatacaacttcaatcttaatttaaagtttaagcatttcaatacatgattcatattccataattaacgtttcacattgttcccattttcaacctttacttttgccacttaagatcataggcgcatacaaaggcaaattaaatcataagcatagagagaaattcgtcaagtttggcatattagtcccaaagtaaccttggcatgacatttaggcatttagcacatatcatgttctccacacatcctcaatttacaaagaataacacattaaacacatgaagaagtacctaccacatataatttcacaataataatctacttaacacaacaagtactgtatcaatcacgtttcgaacttacaacatttacacgggcaccatggaagttcaatttctaagatacggggttttagacatacatacctcaatggagctttccttaaatctctacaatacaccaacacctctagtattaacaatctataaggagatagcagaaatcgattaataattggaagattgtccatggtgtaactctcttaggaatttcatcaaccacctaacatgtgaagtagactacaaggtttagaaatggcaattccttcctccctcaaccaattttaacatgaactacccatattagttctttaacatcacatactacaacttagtcccacatacatggcctatttctgacccccacaacatatttgaacctttaacctattgcatgatgttttggaagtaggacttatccggatggaggacaatttatggttatcttccttgattcttaaagacttgagcaagatttggatgattatgaagttaggcccctcctttatctctctatgtgctctcatatctctctaaatcagtagaaaatgaccccaaaatgaaccccaaagcctatatattaaaatgaggtcgggttataaaaataggaaaaataaccctccgaaactgggtctgcaatcacagaatggaccgcaaaacaagaatgtgggccatagaatgcaccacaaaataggtgcccaaaactgggcaacactggcccaatttacgacagatctgcgatcgcaaagtcaaaaatgcgacagatttacgatcgcagattcgacacaggatcacattttttcagcctttggtaattggatcataactttgtgtaggaatgtccaaatgatgaacggtttgaagcgttggaaactagactcaaagtcctttcatgtgataggttgttcatcaaataaaatctaatacatatttagatatgcttgttcaaaatgtggtcttatgtaaacttagttggaatcttagcctattatgaaattttccaatgtgacttaggtttaggcctttctttgggccccaaattacttaccataagacttgtacacttatttaccaaattcaatttatgcccaccatgttaatagcacataaaatattataattagcctacgtggcatcacgaaatcctagattacttagcgaaattttccggggccttacattctcccccctttaggatcattcgtcctcgaatgaggagtagagcctggcccaaatacctaacataacgtatctcttttctacaatttttcagaaatttcggcagcatctcctttgtaactaggcctatccacctgtcagagaatcacccaaaaccatcctaaaactcatccataactcgacaaagcaccacaatatatatattaataacataaaccagcattacaagcactacattatcatgatgatacctggacatggattgcacatttttaaatcataacacatagaaggtacttttcaaatcaaaaccaattgttatacaatcaagagaaaataccttatttccacaatactcttggccttcaatgtgtcctcttatacttataggctcttctgtaaaacattcacgaaaacaaccccaacctccaaacttatctaacaatgatgacaactagatacctcgcataagctaactatctattaacattcaccttcaataattttcaccaggatgatacacaaatgatatccacctaccttcttagacatagacatatgaaaacaccaatttatgaggaccaactatggggaaacatcatactcctagtgcgacctaatgggaaatgcgcttacgtacccttcatcatcaactcacataacctctacaagggagaattttgagaataaccgattcaccctcctgaattctaaatctctatgcgaacacctaaactaaactcgtggtgaccttcacgattactctaagatatgctataataaatttaccataaaattacctattgaatatatgtgatcacaagatgactttgacacgtttgaaacttcaataccaaatagatctaatatagtaaggagcaatagagttcaagattgggatggaattatttaggaatccatttatgcgctgagcagagtatttcatgaggttacatactgagagacacgaggatttatattaatgaggctgacatggtttaatccaggtgactacatcaattatcaaatagatgaagcatagtggtgactaatattcttagataaggtggataccatgtatgtgaacttgagattttaaaaaggtgatcaagtaagatgcaccagttgtatccctgagcgtaaggtaagtagttgagttcaaatggtaagactcttgaaacatgggtgtgattgaggcagcaaatgaaatacgtggaattttattttactcctatcaataaacgactcaaagactttatgccacaagcgcatgaggatggaaaagaagtcatctacttatgagatcatcataattcgaacaatctaagccttcctaaggtggtggaatgccagaggtagcaaaattcccatacatgacaatgacattgtcaatactcctagaagccgagtgagcatagagccacataacctcatcaaatccgacccattcatgacttttctgaaaaggggacacactttggtttgaaatcatggcaatttaagcttgcactttaaggaaaatcattacttttaaaacccatgagacaagccctcgtagtcctagagaatcgtcaacaatggcaagaaagtacttaaaattattacgagctggtatagaataaggcctcgaagcgaccatatgaataattatgaaagggtgagaagtcttgatgcacttatcgaagaagagtaacctaagttatctagtcacatggacaagtagagcaggtaaatgattgtttaggagaaaatctcataaggagtgcgagtaatatctttttatcctaacaaaaggagcataccccgacccttgatgccataaggcataaaattagattcacgaggagagttactagatgaaaatagatagtaaggcagcacaactaagagcaccgcttggaatcgacaagcttaaacagagttgaagacattagaagtctgtaaaaaaagggaaatttgcccactctctgggcacttgtagagtacataaaagtgaggttaattaaatcagatcatatagttggataactaatcgagacattgagataatatcgcattgaatattccgggaaaacaacacataatgcaagacaaataaaaagaaagtgagagagccttatggaagtaacctttacattgtaaccactaggaatggtggtaatataaagcgattacgagaagctacatttttgaaagaagatctctgtatgtagtcacgcgatgtatagttccagaattcaaaaatcaaattatgtttagcaactctatttcacaatgaagcactatagcacacttttacacaaccaactattaccaaccaaattgggaaacactatacgaggtaccacatgaccataatagtaaggtgtataaagtatgtgaaaagtgagtagtattttaagtaaatgggaataattctcaattatgcgggtaatagattaattaccgggtaacgaaacattacccggttataactaataagtggataaatttaatcaattatcctaaagagtaatttggcagcatgccacacattaaaagaatgactcttcaagtcatttcaatatgtgacagtgtaacataaagtcatttaatgactcataaggaacatgaaagaacaaaaaccaaaatcggattcttaaagtttcaaaaagaccttttgtctttagaaaccaaacaaaaataaacgtgagtgagattcttaaggaactaaaaacttaagaattagatttttcaaaatttcaaagccaaaacgtgaaaccaaacaattgcatactgtcttgaaccaaaaaatcaattctgtcaacacttcaaaaatttcgattgaaatttcagtccaaatttcaatccaagcttcaagcataggttttgttcaagaatttcgcagaaacgagtatgttaagtctaagctcttctttcatttggcatgatctcgtcattacattcacatctcggaatttacgtatattttgctagtcttgcaaattgcgtataattttctagtgttgtaagttataatattctccttatcgggatttcatattcagttgagtatttccttcttctattcaagagtgtagagaacttacatatatatagtattaaaagtattttcattaccatcgagctataatcgatgggtaggcccctactaggaaacctctgatcagatgataagttatatgacgatcatactgtggccgagcgcatatgagcgagcccagttggtcgagatacatatcctagtatggccgagcacttatgagcgagcctactatagcagagcagatatatatgtataccgagccttatagggccagacaactattttacttactatattgagagaattgagtcagtatcaacaggtaaacatatcttcagattatctttgacttccagctacttgcagttattatattatcagttcaattttagctttcagtatattgccttacatactcagtacattatttcatactaacgtcttttttctgggggcgctgcatttcatgcgtacaggtcagacagacagatgagtaggcctcttcaataagtgttgcccgagttcagcttgattggtaatctccatacctttcggagtttacgggtctagagccttatgtatatcttgtatatatacatatatatgtcatgagtaggtcagatagccattctgataacattatatccattagtgaaggcttgtagacatatcttgtcagttagtgcagtatgttaggatttcaggccttgtatgtatatttggttggtttgtcagctgtaataaatatgacggccttgtcggccaacttttatattgatgtttagtcagcattcgctgtcgtcttgcaatgtggcccatggccaaaagtatggcatcatatgttcagagtcccttagttgtaagttggtacacaaggataggtgaggcattgggtaccggtctctccccccccagttcggggcatgacaaaagtggtatcagagcagttctgtcctagggagtctacaagccgtgtctagtagagttttgtttatgggtgtgtcgtgcaccacacttataagcaggaggctacagggcatttaggattgtcacgctttcttcttactctagaccatgtggtagagctcacttataagaattcaaattctgaaaatctattttattcgtaataaaacgatgcctccattaggaaagaaggttggaaagaaagatagttgtggaagagctgagtcagaggaactggagttttgtatgatgcgtacgataagtaaatatgaggtctttagcagatcatgagtgtactgaaaggtgtaagcttcctgataagaagccttaaggcaggaatgcctttccatctttatggtaaaggacaatgagagattaaagaagataagtacaagtagaagcaagtaaaaggagcaaggtgaaaaagggtacaatatacccagttaatgaaggttaacaacatttataattgaggcaaaggaacataagctttttgagttatattcaatagtaacagaggtatatataattggtcgcaccccttccagatatgccctatgggggttaacaaaagtagtataagaaaatatgatggatgaattgattgcgtcagttgacatttctgaaggatattgcaaatgtgctaatagatctctttatgagacacctagatggtgcactctaaaatagtgcagtcagatatgtgtactacaaagacatgcactataagacttgaagggataagtattaccttagtgtgtctcatgtccctagtaaagcgagaatgttaagcaacttgaacagccactggatggagcaaaggaaagctaaaagcgaaagaatgtcgtattgaagttttcacaagaaaaaagttatgcagaaatattagtagagtaatgagaagagagataaagaagcattatgaataaggtgtgatacatggagtaaaacggtagagtgttacaaaacctatagtcaaatgaaagaagagatgaaaggtgaagggtcttatgacaataaaagagtataggccataagattatatcttcatttcgagaaataatttcgtgactctagtgcgattgccaagaggaaaagttagaccccagagtagtagaaatcagtatgggctggtgaataagataaactatatatgaattagggaatgagtgatttggtaatatttagcatcataagaatttcagatcgcattccggcaataataggacggacaacagaagaaggttcatgagaaattcagagaatggtcattcaagaagacgctttcctaaagaaagcaatgttagcaaagttaagcctaagggactgtatgtaccagttacattaagtgtcaccctcacgagtaaggggatttgtcatccttggtacagaagggttgccgcaagacgagtaagtatcattgatgttgagaaacgacgccaaagatgaagaggtaaaacatctataggtagatcatcgtagcttcagctcttagtacacccctaaaagggggaatatggaatgatgtggtattaagtcagaattaagtggttctagtgactatggaatggtaaaggaagaatgcgataaatgaaagaggaatgagatggcacttatccaaatcttacagatacgctacaatttaaaaatattatgcaagcacgacatcaaggaaaggaagtaaaggttcctacccgaactgttattaataaatatagagccagtgcgagacgtaagttaagacaaatgaaataactcaagaaagattacaaggaatattgatatgagaatggaccaacgagtagttagtaattggtcaggaagatcccagttatggctaaacaggaggttacagacgagtcatcagaccgtgtgagataaacaaagtagaacccaacatggagagttaagcctcgaagaatattattattatacttgagatatattcaaacaagagtcggggtagctaaagataccgtatgagtgttaggggataaaagaaagtgccactgggaagacagtaaaaatatcagttcagaagcaaccatacgagcacaagggcatggaggtaagcaactacggatgattacaggcaagtaaggacatcaaaaagttctgcaataagcacacagctttaccagagtcaagggttatccctaagtactacaacgaaagactagctaaggaaataagaaagaaggcttcaacctaagcacaatgacctaaagaagaaatgatcgtgtaacaacaatctcacaacaacattgaaagcattccaaaggaaagtggcacctaccgtggctaatgaacgggaagtaagaattaaaagtaattgcatacgttttaagagagctgagatggaacgaaaggaattattcgatcaatgatccagagttagtacgttatggacatactcgagattttggagcattatacttgttggcaatcatacaaccatagaagactctgatataagttaaaaagaagaattgagcctagggcttagacaaatgattgaattgctaaaagattgtatcatggatattccataatgcccatgaaaggctaaggtaattaactgacaccatgagccaagggtcgaaggatagcttaagcctacgtaaaggctgatccgaaggaagaggaaactagaaaaatcacatcacccaagtaaatcaggagtctgattattggacctagaaaaattatagaagttgttcttgagaacatggtagaatcactcttaatatcagatgttcaagagaaataacataacaaccataatctataatggctccataagaaagccagttagaagaagtaccagcctcataagacgtcagtacgaagctcccatcggatagtgtatgtagcagaggtgcgagtattataatagagcttcatattatggacttgaattatacctatgtggaagggaggtcatgaaagagatagaagatatgatgctagattttaaggtaagaaaggtagaggtgaacaacatacgagatattcaaaggcaggatatgtgaatagtccatacttcggatagaaggctataagtgctgagattcaatatcaaggaatgatagcagcatagtcagtgacatatctcatagcctatggttcctaggtatcgatgaggctaataagacagtaaagaagagttagagacgatgtgatgtccggcttgatgtaccagaatgacataaagaaatatatgatacaagcaagttgaaaggttgcaagtaatataaatagagttgtgtaggtcacaagccattgtatggtgaagcgacaaggttctagaagacaagagtaaggataagaaagggcaagtgagaaggtaacgaaaatggataagtcctcaggattacacccatgaaaacaagaagaatagatggtttctctaaattatacaaagctcactatagcctgaataaactcaaaggagtctaagactaataacatttagaatgctaccctggtagtagaatgagagtgtaattgtgatagataaaagatgatgtttgggccttcgattaagtaatgattcaacaaagaaaagaaacggatcttatgaattggacaggattaaggtacccacacaaggtgaatcggattgggatgttgtgaggtacgattatgaaagcaggatatcgccccaggtggatcaatttaatcatttcagacgttccccgataaaaggtgaatcctagcagcaatattacataaaaggttaagttatcagtggtatattatggatcaaaattgatggataaaagttataaagtatgagaagagattaagccgtcattcttaagatgaacagtattgtggaagcattagaggacatagatttatacgtatgggataagcaatgaaagtaacctaggatttggtagcagacctcagtaatgagaagtcgaggtaagaattatggtatagtatgacctatgtagatgcagtacagtcataagaatggataaccacgtctatagaataagatatagcaatattcgtaagtttgacaaaaaaaagagcgaagaacttcaggattggctgaggaaaaaggaaaggagagtctcataagcacacttacatggtcagtatcgtagaagctgcatgatgggaggtagcaatagttatgagattgggaggaatttgatcacaagtcatgacatgggaaagaggcctaaacggggagaataccctagactttggacttattcacagaacagttgcctagatggcaagaggactactaaagtattcggaagacacaggctataaaaatgataagagcaccagtcaacattcgaggacgaatgttctaaagggggaatgatgttacatcccacatttttgtatgttaaagtttagtcgtaagttaatcaacgtaagttcgaggatgatattattttgagattttaagtattatgctatttcaaacaagtgataagtaaattcatgaaggtgagaggggaagcaagtcaaagaaaataaattttcgtccaagtttggcatgttggaataaaatacgacccgagctaaaatactcggtatttatggactagtaccatacgaagtaccacatgaccataatagtaaggtgtataaggtatgtaaaaagtgagtagtattttaagtaagtgagaataattctcaattatgtgggtaatagattaattaccgggtaacgaaacattacccggttaactaataagtggataaatttaatcaattatcctaaagagtaacatggtagcatgccacacattaaaagaatgactcttcaagtcatttcattatgtggcaatgtaacataaagtcatttaatgactcataaggaacatgaaagaacaaaaactaaaatttgattcttaaagtatcaaaaagaccttttatctttagaaaccaaacaaaaataaacgtgagtgagattcttaaggaacaaaaaacttaagaatcagatttttcaaaatttcaaagccaaaacgcgaaaccaatttcaaagccaaaatgtgaaaccaaacaattgcatgctgtcttgaaccagagaatcaattctgtcaacatttcaaaaatttcaattaaaatttcagtccaaatttcaatccaagcttcaagcataggttatgttcaagaatttcgcagaaacgggtatgttaagtctaatctcttctttcatttggcatgatctcgtcattacatttatatcccagaatttatgtatattttgctagtcttgcaaattgcgtatatttttctagttttgtaagttataatattctccttatcgggatttcatattcatttgagtatttccttcttccagtcaagggagcaaagaagttaaatatatacagtattaaaagtattttcattaccatcaaattataatcgatgggtaggcccctattgggcaacctctgatcagatggtaagttatatgacgatcatactgtggccgagcgcatatgagcgaccagttggtcgagatacagagtctagtatggccgagctcttatgagcgagcctattacggtagagaagatatatatgtataccgagccttatagggccggacaactattatacttactatattgagaaaattgagtcggtatcagcaggtaagcatatctttaaattatctttgacttccagctacttgtagttattatattatcagttcagtttcagctttcagtatattgccttacatactcagtacattatttcgtactgacgtcccttttctgggggtgctgcatttcatgcgtgcaggtcagatagacagacgagtagacctcttcaataagtgttgcccgagttcagcttgatcgataagctccatgcctttcggagtttccgggtctagagccttatgtatatcttgtatatatacgtatatatgtcatgaataggttggagagtcattccgattacagtatatctattagtaaaggcttgtggacatatcttgtcagttagtgcagtatgttgggcttttaggccttgtatgtatatttgattggtttgtcagctgtaataaatatgacggccttgtcggccaacttttatattgatgtttagttagcattcactgtcgtcttgtaatgtgtcccatggccaaaagtatgtcatcatatgttcaaagttccttagttacaagttggtacgcaaggataggtgaggcactgggtaccggtctcgcccccccaagttcggggcatgacaattggaacccgacgagatagtgtaaaacgatcatggaagattttcagatgttcataatgagttctccatgggtttggacttgaggaatacctatatactaatgaaaaacagaaagacaatagaaacagacgttgtgctacgataaaatcacctccaaaggtgcgcttggtcttgatggagagccttgtaagggtccttatgagaaaggaagtattacaatgacacatagaaggatatgttctctcatggttattgaacaagtgttcggaaactagcacaatgaattcactaactaaagaacacaattaacacatgttgtggagatgtaaagagaaaataaacatttgctatacgctgggcatgcttatgctatattaacccccaactgcaatatacaaccatgccacgagcaaccacaatactaggacaaagtgagctacttactacgggatgtcccaagtggacaaagtgagctactatgacggggatgtgaggatctcaatttttagagagactttatgtacacggtggccatttcgattgacatgaactcatgtgataggtgttaagttttgctcttatgttactagacattgaaaaaagttttatgatgatactcgcaagagagtagattaactgttcaaaccatataagccatatacacaattgagtcaaagagtgactcgagaaggatcgtaatactgagatgctttcatggaacttgacaccacataggtaaactttacgacggtgcatgcataggcacaaatgagcagacgttgtccatataaaagattttgtaataaattcatcggatatagtcccttgttgagaatttaggaaagcaagtcggaaatgctaatcctagagtcataactccattcaaggacacaattatagaacttaattctacgagaatataaataagaggatttgtaatagagtggattcacgagtaatgcatctcgttcaaagagttgatacatgcaatattttgttattcaacaccttgttaagaccatgtttatgagaattcttcaataaggatgtacacatgcaatgagtaaaatttttgtgttgttcataatgatgcactagggagtgacttacttggtgactttaggttgatagggcaataacttaatcgatgcccctcaactccacatccctaacacacgtcggtaacataccaatatactacattatctggtggtacagtgagattaataggaataagggcactcccatcttagcgataggttctaccaatccctccacagatcaatacattctcctaacaagtccttgggcaatccactcaaactcaatggtgggatcactaccctttcatgatttcaaattcgcggattatgctatcatgattactcattttgagagtaaggcttggagagaaaactaactccctaacttgagctctactgcacgatctggagtatcaaagaagggtgaaattcctaaatatccgaatagcctccaacttatagatgtggtcgactacacactgataagagggactctactagacacaactccgagacatcctaggacactttaaaaccttaggctctgataccaagtttgtcatgccccaaaatcgaggagcgcgaccggcgctcaaccgagtaaacccgactgagcaagcctgctaggtttcattctacccaatctaattcacgaacaagtaggagatggactccattaatcatacttagtaagtatttcattaccaacttccatttcattgccattagcagcttaaatcataattatcaaaatattaaaagatttataaatctttgccaaacatcaatatttctactttaattctaatacccgacactacccacaacctgtctacggagcctctaaacacaactgaagagtaatgtaatatggaaatgccggtaacaaggcttcagctatacctcaaatacaaagtacatgatgaacagatgaaacaagaccctaaaacgaagtgggtctcaccaagtcagctgaaaggatgatgcgacactagctgcgaccaacactgcctgctatagaaacacatacatccatttaaagacgtagcgcccccgcaaaagggacgttagtgccatcaaatagcacttgtatggataactaaacaccatctagttagaaagaactttcatacgagaataaagaagaaatcataaagacaacaaagtttcaaataagcaccatgtcaacaatataaggaggttcacatgattttcacatagttcttgaaattttagattggagcatacaatactgttgcatcattatccatattaccactgcttccgtgagcgaagtccgatcacatcccgatcggctaagccgtctccccgagatgttaccattatttcattcacactttctagtttcaatcatcaatacattaccaccacgtgtatatatatcatggcatccgatcacggcccgatcggctaagctgtctccccgagacgttaccattttccatcaatcacctcaattcgatccttgtttcacatatatcatttcataggcacttggggccacatctatcacgtcatatatttggcactaggccacatttcacatcattcccaatttcaatgttagatttgtgatttaggatgatatgtgtacacaagggcaaataaaattgtaagcatagatgagacttcacatagaggatacaacatatgcaacttcaatcttaatttagggtctaagcatttcaatacatgattcatatttcataattcacatttcacattgttcccattttcaacatttactttgccacttaagatcataggcgcatacaaaggcaatttaaatcataagcatagagaggttcgtcaagtttggcatattagtcccaaagtaaccttgacatgacatttaggcatttagcacatagatcatgttctccacacatcctcaatttacaaataataacacattaaatacatgaagaagtacctacgacatacactttcacaataataatccacttaacataacaagtactgtatcaatcacgtttcgaacttacaacatttacacgagcaccatgaaagctcaatttttaagagacggggttttagccatacataactcaatggagctttccttaaatctctacaatataccaacacctctagcaataacaatctataaggagatagcggaaatcgattaataattaggaagattatccatggtgtaactctcttaggaatttcatcaaccacctaacatgtgaagtagactacaaggtttagaaatgacaattccttcctccttcaaccaattttaacatgaactacccatattagttatttaacatcacatactacaacttagtcccacatgcatggcctatttttgaccccaacaacatatttgaacctttaacctattgcatgaagttttggatgtaggacttacccggatggaggacaatttatggttatcttccatgattcttgaagacttgagaaaaatttggatgattatgaagttaggaccctcctttatcactctatattctctcatagaaaatgaccccaaaatgaaccccaaagcctagatattaaaatggggtcgggttataaaaaaggaaacgtaaccctccgaaaccgggtctgcgatcgcagaatggaccgcaaaacaagaatgtgggccacagaatgtaccgcaaaataggtgcccaaaactaggcaacactagcccaatttgcgacagatcagcgatcacaaagtcaaaaatgcgacagatttgcaatcgcaaattcgacacaggatcacatttttctagcctatggtaatttgatcataactttgtgtaggaatgtccaaataatgaattgtttaaagcgttagaaactagactcaatgacctttcatttgataggttgttcatcaaataaaaccttatacatatttagatatgcttgttcaaagtgtggtctagtgcaaacttagttggaatcttagcctattatgaaattttccaatgtgacttaggcttaggtctttccttgggacccaaattacttaccataagacttgtacacttatttaccaaatacaattgatgcccaccatgttaatagcacataaaatattataattaacctacatggcaccacgaaatcctagattatttagcgaaatttttcggggccttacagtaacccgccatgccaagaaaactacggatctttgtagctgaggatggtctaggccaactctacactacctctactttctttggatcaatctgtataccctcactcgacaccacatggcctaagaatgccacaaagtccaaccaaaactcacatttcaaaaacttagcatataacttcttttctctcaaggtctaaagcactgtcctcaggtgctgatcatgatcttcccgactccaggaatacactagaatatcatcaataaagacaatgacgaacgagtcaaggtacgaccggaacatactgtgcatcaaatgcataaaggctgctggggcattggtcagcccaaatgacataacaaggaactcgtaatgaccataccgagtcctgaaagcaatcttcagaatatctagatctcgcatcttcaactgatggtaacctgagcataagtcaatcttagaaaatactcgtgcaccctgtaactggtcaaacagatcatcaatacgaggcaaaggataacaactcttcactgtaactttgttcaactagcgataatcaatgcacatgcgcatagaaccatccttcttcttcacaaacaagacaggagcaccccaaggtgatacactaggcctaataaaacctttatcaagtaattcctgtaactgacccttcaactccttcaactcaggaggggccatacgatacgcaggaatagaaatgggctgagtgcccggcaacagatcaatgccaaaatcaatatttctatcgggcggcatgtccagaaggtcagctagaaacacataaggaaaatcccctactactgggactgaataaactgtaggggtatcaatactaacatctctcacataagccagatacgcgtcacacccattctcaaccatacactgagccttaaggaatgaaataactctactgggagtgtgataaagtacccctccactcaactctcggaatacctagcatagccagtgtcatggttttggcgtgacaatcaagaatagcataatgtggcgataactagtccatgcccaagataacatcaaaatctaccatgctgagtaataacaaattggttctggtctcaaatccactaagagcaatcaaacacgaccgataaatgcggtccacaacaaaagaatctctcacatgagtagaaagataaacaggggtactcaaagaatcccgagatacacccaaatacagagcaaaataagaagagacataataataggtggagcctggatcgaataaaaccgatgcatctctatgacaaactaggacaatacctgtgatgacagaatcaaaggcgacagcctcagtacgggcagaaaggacataatatctggcatggcctccccttctagggagacctctaactccgtgacctccacctctagctggctgagcaggtggggtagcaactagagatataaccataacttgagaactctacggggcacgctgtggctgagaagtctgtggaggtacacccctcctaagtctggggcaatccctcaccatatggaatatatcaccacctctagctggctgagcggttgtgactggcttgggccaggtctgctggactgaccactgaaagcaccctgcgcaggaggtgcactagatactagaggtgcataataaggctcctaaggcctaggaggagctggaataccactggctgctggaagggcgactcatacaacccctaccatgacgacctgcagttggggcacgggcaccagaataatgacccgactctcgagacctcttggcctccctcttatccctatccctagcatgcataccctcaatcttcctagcaatgctcaccacctgctaataatgaatatccatctccaaatcacgagccatgttagacctgatgctgggaataagccctacaataaaccaacgaaccctctcacgaacagtggaaaccaagactggtgcatgtctagccaagctggtgtaacagacagcatactccgagacagtcatagtaccctagcgcaaatgctcaaactctgcgtgccatgcatccctgtggctctgaggaacatactcccttaggaacatatccgagaactgagtccaagtcagtgaagttgcctcatctagactgtctaactcataggtgcgccaccactcctcgaagctggaaagcagtgaaggaaaccctgctcgatcctgatatacccatggtacagagaatacagtagcactcatctagaaatcccagagcatcatctgatgctaacccactgaatacaggaggatcatacttcttgaacctctcaagcctttgctacttatcctctgaagccactgccctatcctcgggctgacctaggctgtaggcggtacatgaataatcgctgggacctgatcaacatgcactcactgctcagacgtgcagccggcgggagtctgtgctcctcccccgacctgagatgtggttgcagcaaggggaaacaaccctgcctaagccaaagtggtgtacatactcatgaaatgtgcaagagtttcctgaagagctggagtattagtagcaataggcgtatcaggtgcttagactctggctggaactgttggcggtacctcgtgtgggtgctctggcttcaccacgtgcgcgtcctcggtctctacgccagccccagcctctaacagttgtagtagggggcgcgggtgcctgaccatctcgggtagcacctgtcctcaccatctgtgagagaatataagatagaagtttagaattgtgatatcaaaaatcttgcacgacaaggaaatcaaatgaagtggaattttcctaacagttacatagcccctgatagataagtacaaacgtcttcgtaccgatcagcgagactctaataaaccggcttgtgattcatgactcctatgaacctagagctctaataccaacttgtcacgaccccagttcgccctttgtgaactgtcatgacgacacctagtctctacgactaggtaagcctaacaaatgcagaaaataacaatttgcggaagaaataattaaaaaccaaaataatcaaatgaaatagtatttaagatgccgctcggcatatacaataaaactctcgaaactaacaacatttcccaaaacctggaatctcatgaaaccacaagcctttgaatgtctacaagtttctaactccagaatgtctaacaaaagtaagcacaaaagggctaatacttaaagagagaatagaaaaggactcttcggtctacggacacgacagatatacctcgaagtctctagaaaagtcaccttgcctcaaaggtgataagactgagtcgaagtacctggatctatacatgaaaacatgcgcagaaagggcatgagcacaccatatcggtacttagtaagtgccaagcctaacctcggtcgggtagtgacgaggaaagttggggtcctactaagattaaatgaaatataaggtaaaacagtataaaatgagacaatataactaaatgcaacagtaagaaataacacagaatagaaggaacaacattaactataatagagataaacagtcacagaaaaagagtacaagtcaactcaaagataacaactggggatcttccaggataccatcctgtagtcctaaatatacatatccaatagatctcccgagataccatctcatagtccaactcatagtgcgcggggatctaccggaattccgatccgtagtccaaaatataaatacctagtactaggggaaactaccgtgtgcagtcccatagttccatataactgtgtagggggatctaccagaatcccacatccgtagtcccaaataaacagacaagggggttctaccagaatcccacatccgtagtcccaaatgtaaatacacagcatcaacatgaaaaatattcatcaaatgtcaatttcatataaaggcaaataggtaattctagcttagcatgctacacagaattcaagtgaagcagtttgagcaaataaagcaattaaatcacttagatatgcttccctaagctaacgacatgctgaaattgcaagtagtaataacaaggtgagaaacacaattttagttacttattgaaaaccgaattttcaacaattagcataagtatgcactcgtcacctcacgttcaaggcatttcaaatatcaacaatatcaaatcctaagggaagtccccccacaaggttaggcaagccacttacctcgaaccgactcaaagtcaacccgaaaccacgttcttgccacgagtactcgactccaaatggaccaaatctattcaatttaattgtataatgtaaataacacttcaaataactgattctacaaagaaattctaagctaatatgcaaaattaggtaaaatgaccaaaatgcccctcaggcccacatctcagaattgggtaaaatttacattttcataatccttatactctcaagaattcatgcataccaaagttatccaaatccaatgccaaattttcaatcaaaactcgaaatctaggtctaagaactttcttccaattttccccaattttcatctccaattcgaaattaaatgacaaaactaagattagattataagaatacaactagaaaggtattaggaatcgttacccactgatttcctcttcaaaatcctcccaaaatctccctctcctgagctccaaatcgattttccaacttttgaaactaaaccctcgaatttctgatttttctgcctagcaaacccgctcttgcggtccaccaatcgcatctgcgataccacttctgcggttctcacttaaaattccatctatttactcgtggacacttttgcggcttgactccacatctgcgggagtcgcatctgtggcctctcaaccgtagatgcggttatgacagcaacccaaagaacttcagctgcaaattccaaatttccaacttcccgttaaccacccaaaatcattctaaggccctcggaacctcaaccaaaagtataaacacgtcatataccactatccaaacttatacaaatctccaaaacacctcaaacaacatcgaatcaaccaattagcctcagattcaagtctaagaacttcaaaaactctcaaaatacgcttttgatcaaaacatctatcaaacctcgtccgagtgacctgaaactttgcacacacatcacattcaacaccacagagctactccaacttccgaaattccattctgaccctcggatcaaaatcttaatatataaccggaaacatcaaaaattcaactttcggcatttcaaacataaattagctacggacctccaaaatacaatccgaacatgctcctaaactcaaaatcacccaacaatgctaatagaaccaacaaaattccattccgatgtcgtcttcacaccattccgactacggtctaaattctaaaacttaccctctcatttagggactaagtgtcccaaaactctccgaaactccaaaaattcctcccgaaaactcacaatagtagaaacaaacacggggaatgtagtaaataggggatcagggcgtaaattcttaaaacgtctggccaggtcgttacagatcaagcttcaagcacaagagaaattgaaaaaatgatggaaagggtaaggagaccggagaaggatcttccaagtaaagaacaagccaaattccagaaaggaaaatggctctacaaaaagaaagacaagagtaagatgaaatgctacaattgccaagttccagggcattttgcttgtgagtgcactttgccgaaaaatgtagcatttcaaaacgcatctcttagtgttattatatatatctctagcactgttttattaactgaatcttatcttatattcaggggacactgaccatgtgagccatgatagagaagcatttataaagtttcgtcaagttccacctggatcaaagcatgtatatgtggaaaataatgcaaagcttgaagttaaaggaataagcacttgcagaatggacatacatggtgcccgatctttgatgttgtaagacgtcctatatgttccagatatttgactaaacttagtatctgtgtctattcttctagatttagatttcaattttaacttcagtcgcaatggtcttagaattactctagaaaatgttctttatggttttggacatcgttatgatggttttattgtattagattgtaactattatgttcactgttgtgttatggcatgttattctagtaataatggtgtttatgttattatatggcatgcaagattaggtctgtagtgacccaaccggtcgtttttctttctagaaccccattcctctaaataagacttcccgtacttaattttactgatttatgacttgcagggatggttggttcgggatttggaaaagtttgggttgaaatcaaaacacttggttcttttaggttggcttaaaaggcaaagtttgacttcggtcaatattttgagtaaaaaccttgaaatcaggatttgacggttccaataggttcatatgatgattttggacttgggcgtatgttcggatcggattttggatgacccgagagcgttttggcgcataatagtgaaagttggttcttgaaggatttttaagttctttaaatttggtttggagcgaggttttgtgatattaaggtccaaatagaattctgagactgggaatagttccgtaatgtcatttaagatttgaacgcaaaatttgatgtcattccgagtagtataagtatgtttcggcgcattggaagtaaattgaagaacttgatgttcttaagtttgatttaattggttttagggtgtgattcttagttttaatgttgttttgggcgttccgagagttcgatcgattccattttatgattccaaacttgttggtatgttcgggcagggcctcgggggccccgagtgccaatcagacgaggctcgaaccaagttgagaatttggaaccacagctgagtgaaccaaatctgtcataatctcacttgcggttggtcagccgcatatgcgagctcgtaggtaaaggccaagcatcgtagaagcggccaaggaagggcacccaggtttcgcagatgcggtccctcctccgcagaagtgggactgcagaagtggttacccgacagcagatgtgacacagccgacccagggcaattccgtagaagcggacccttgtccgtagaagtgggaccgcagatgcagaaatcgctagggcatttattacggaacttagacatttttaactcatttcattccattgttgggcgattcttggagctcttagagaggggatttcacccaacaccttgaggtaagtgattcctacataatatagttaatacatagtttatgggtagattataacaagtgaattggtagaaatcatgggtttaggtgaaaacctagggttttgataaaaaggagattttaccacgaaaatgattatggaacttagtgaaaacatatatttatgttcctaaggttatgagtcacaactttcttcaaaaatttccgaaatccaggcacgtcggccggtgatgaattttaggaatcttgcatttagagttgggaaattacttcaatagtttgcagatgaacttttaagcttatattgattaatttttatactatttgtatagttttggatcattcagcaccaaattgagggtttgggcataagcttggaccgaaaagtaggccttgagacgaggtacgtcacttttctaaccttgtaagagggaaatttccctataggtgaacttaattaatatgtgattaattatgggggctacgtacgcacgaagtgacgagaatccgtatgtagctactattcctgattatgtctgcgaagttttaggatcacgccatgcttggggattcgttatttgattatatttgttattatgatagatgaaaccaagttgaggattttcaaggattttaaaagcttcacgttgaaatgtctatatttataaaagaatcaagaaaagtgttacaatttatttataaattgatatttgaccgtgtcgtatgtatgatccgcaagcgaggtaattccttgaatttatatttgactagtcgcatgtatgatctgtgagttgggtaatagatgcatctatggttcgcacggttcaaccctcagcagtgcacaatttacatttatgttggatcggacggaacgtcctcgatggtattcgtgtgtgataatagaactggatttttttataacttttatgaattgtcgtcgagagatcacttgttttaaatgaaggtagtactttggtttcctaaatatgatggaaggattgttcagttatttatatttcttgttatgagattattgttatctctatatattatgcttaaattagaaatttcatattattatattgttggccctagtaagtgttggagtcgacccctcgtcactacttcttcgaggttagactagatacttactaggtacatatttttatgtactaacgctacacttctgtacttaattttacaagatttaagggaggtgcatctggtcacctgtcaagcgcgtagattttatccccctttcgagacttcacggcgagctatcttttgagccgcactgcagcagctggagtcttctttatgctttgtttttttgtctattttcttccagacagtaggctagtattcttttttacattctactagattgcccacatacttgtgacaccaggtcttggcacatgcactagtagacttatgattttggtattgtatacatgattaaggtttatatttgtttcttccttttaacttggcttcattggaaaatttctaaatcttttaacaaatgaagaattttatccgcttagaaatttgtttaaatgggaaattaatagtttgatcaatgttggcttgcctggcaatggtgttgggcgccatcatggcctttgatagaattgggtcgtgataacatggtatcagagcactaggttcacataggtctcataagttatgggcatgcctagtggagtcttacggatcggtgcggacacatccgtacttattttgagaggctatagagtgttaggaaactactatttattcatctcttatcgtgcagttgatggtaaactaagtttccttgttctattctctcatagatggtgaggatgcgtacaacggatgttccagacctgggagaagctattccctccgttgttagaggccgagacagaggttgggggagggaaccaacccgaggtaggggacgaggatgtcctagagctaccccaatagaaccaccaatgaatccagtagaggatcccatcatgaaggagcagggtaaagtgcctgacgcagagccagccttggtagatttcatgacaacactgggcttttaggaggtcatgggccatatgctacggttcatggacattatgactcaagtggtttatttccaatagatccatccatatctcaggcatgagggagagcacagacccctactgctaaggctcttgggcacacaactacagtatatcagactacgggtacactacccgtgggcagggcccagccaattaccgcagctgcacctgagcctagaccagctgcagacaacaatttgcagaagctattggatagatggactaggctacaccttcctatcttcgaggtcgagcgagattaggatccccaggacttcattgaattagtacagggacatactacacaacatgaggatattggagtcccatggagtaggttttactactttccagctggagggcatggaccgtagatggtggttgtcttaccttcttggcagaccagtgggttctcctcccatggcttgggaccagtttacatggcttctatttgacatgtatattccaccatctcagagggaagagttgcggtgttattttgagcagctagagtagggtcagatatctgtgaccgattatgcggcgagattttctgagttatcttgccatgcacttatgatacttcctacagacacagagagagtgcaaagatttgttgcagggttgcacctcggtattcaggctagcatggcatgagaggttgagatgggtatatcagctaatggtggagattgcttggaggattgagggctatcactagaggggtagagagcagatgcagcaggacaagaggcctgattctctgtagagtttagaggtgctccagctagggcaaacgtcagtttgggaggggtcagcctagtaggtccacatatccagtaccaccacctccttggggtgatcgagcgcgaccctattttagtgttatgtcagagagttcttatcacccaccagcttatcacggtccttctagtgcctattacagtgtcatgccagagagttcataccgcccaccagccattcaggccatcagggtcatactatgaggtagcagtctatggtaacgaggttgttacgagtgtgaagatctgggtcacatgaagaggaccttccctagacttcggggcaaaggaagtacaacagggtcatcagcccatgattgcaacaccagctgcctgaccgcctagaggtgggggataggctggtaggggccgtcttagaggtggaggccagacagggggaggtcagccatctaatgttcaataaggtggacaccggccagccgttgctccaactagattctatgcttttttggccagaccagatgcaatggccttagatgccatgatcataggtattatttctatatgcggtagagatgcttcggtattatttgatctaaggtctacctattcatatgtgtcatctccgtttgctcattttctggatattcttcgtgagtccttgggtactcctatttatgtgtccactcctatgggcaattctatggttgtggattagatctatcggtcctgtttggtcacattctgtagttacaagactagagcagaccttctgttacttgaattttaaggtcatcctgggcatggactggttatccccatatcacgccatccttgattgtcatgccaagattgttactttagcgatgctagagttgccgagagtagagtggaagggttcctttgttagtacaactagtcaggttatcttttttttgaaggctcgacatatggtcgagaagggttgtttggcttatctagcctatgttcaagataccatcgtagagtctccaacgattgattcggtgatagtagtccgggagttcgccgatgtgtttccttctgaccatccaggcatactgttagatcacgatattgatttttgtattgatttggctccaggtagccatcctatatctatcccaccgtaccatatggctccgaaagaactgaaggagttgaaggaacaaatggaagagttgttagcaaaaggggttgtgagaccaagtgtatcaccttggggtgcaccaatattatttgtgaagaagaaagatggaactatgcggatgtgcattgattaccgttagttgaacaaagttaccatcaagaataagtacctgttactacatatcgataatttgtttgaccaaatgtagcgtgctagcatgttctctaagatcgacttgaggtcatggtaccatcagctgaatatttgggactcaaatgttctgaagactgccttctgtactagaaatggccattatgagtttctagtgatgttcttcggcttgactaatgctccagcgacatttacggatttgatgaaccaggtgttcttgccttatattgattcctttgttattgtcttctttgccgacatcttgatttactcacgtaacctggaggagcacgagcaacatttgagagtgctgcttcagacattgcgagaacagaagctatatgctaagttctccaagtgtgagttttggctagagtctatggcattcttgggcatgttgtgtcattaagatggatcccaagaagaaggcagttcagagttggcctcgtcccactttggtgacaaagattaggagtttcctggggttagcaagttattattgccggttcgtacatgctttttcatccattgcagcacctttgactagattgacccagaaaggtgctccattccgttggtacgatgattgtaaggtgagctttcagaaactcaagacagctttgactacaacatcgggtttagtgttgccttccggttcggggatgtatacgatgtattatgatacttcatgtgttggcttgggttgtgtattgatgcaggagggacgagttattacatatgcttcgcgtcagctgaagactcatgagaagaattagcctgtgcatgatttagagtttgccacgattgttcatgctcttaatatatggatgcattatccgtacgggatgtcatgtgaggtttatactgatcatcgcagcttacaacattttttcaagcaaagggatctcaatttgaggcagcgtagatggcttgagttactaaaggattatgacatcatcattctttatcatctgggcagggtaaatgtggtcgtggatgccttaagaaggaaggcagagagtatgtgtagcttggcattcattatagcagaggagaggccactagctttggacattcggtccttggctaatagacttgtgaagttagacatttcagatcccacccgagttcttgcatgtgtcattttccagtcttcactattggggtggatcaaggctaggcagttagataatctgcacttggtagttctcagagagacgatactacaggttagttccaaggagggctctattggcgaggatggtgttttgcgactccagggtcatctatgtgttcctaatgtcgatggcttgagaggaaagattctagaggaggcccacaattcttggtattccattcatttaggtgctatgaagatgtatcgtgacctgagacaacaatattagtggcgatagatgaagaaagacatagttgagtatgtagctaggtgcctaaattgccagcaggttaagtacgagcactagaggccagatgtcttgctccaacagatgactatacctcagtggaaataggagcgcatcactatggactttgtagttgggttgcggcggatcttatggaaatttgatgcagtttggctcattgtcaataggttgaccaagtcggcagtcttcattccggttgtgactacatatacttcggagaagctagcccagatttatattcgagagataattcggtcgcacagtgtgcctatttccatcatattatatagaggccctcagttcactttgcatttttggagagccatacagagtgagttggggacccgtatagagctcaacactgtgtgttgataacaagggattctagtctattttatactctttttgcttgagttttggattaaaaaggtatacaagtaaccctgaaagcttacatgttgtgtttgtttgcagtgtttggtcaaaaagtgacaaggaagtcaaaaccagctcaaaaaggagtgaaacctgcacaagtgccaaaaacaagtcaaagcaccatgacaacagtaaatccaccacggctgcaataaacccactacgaccacagtacatttgttatggtcagcgatggcaaagatcagagaggatgcaattttggaagttaaagcaatgcagtccacggttgattcttcgcggccgcggtagccttatcgctgccacattctattttttgtggtccgcggagaagggattcggagaatgtgaagtttggaagattcaagacaccgcggttcgcggtccatttgttgcggtccgcagtgaagccaccgcaaccacaatccatttactgcggtctgtggtggccatattcagagatttagacgtgaagcaaaaaagcctcaccgcggccttggtacctccttcaagggcttttttgtccagaaaatttggccttgtataaatacttctttttcagatttttaggctatctttatcttagcagagcatgtgaacggcgatttttagctattttgagcaattgtgtagctagtttaacattgaatcttcaaatcttagcttgtaattatattttatgggttatttttcatctaaatatttgatttcttccattattatgagtagctagacccattagctagggttgtagctcaaccctagtgtgggtatttgatgggtcttttcttttaaggcttaaatgtttatgggtgattgatatttggcctgatttgtgttctccatgttgaattagtggttacaaacactaatctgtgcctttttgacttgggctcttcttgagaaagagagtttgagtctaggaaaatcaggtcaacaaggaattggggcgtattcaagagaatgatagccctaattaaagggttaaacctagagatagtaatacccgacttgagcctatattgcttgcacaattttgagacccaattggtcttgagaaagtcaattagggcaaagtcactcaagctaccgagaggtatagagcgagtagtgtcgtgcattggctatatcacgatcccaaacataacaactttgccttagactttagaacccgtcaagtattcacctaggggaaagtcacttccctaatgtctctttaaccatttagaaaaccttacaagtattcatacttagcttaattttgcatatcattagcataaaattagaagtaacaaacaaacaaatatgattggaagtgtaatcaagagcactacacactgctagattagatagaaatccaactccaaacattattgtagctcccagtggattcgatcccgaccttctcaggtaaaagctgcttcgaccgctatcgccactctgtagtggtgtagggttggacccggtcactttctggtgccgttgctggggagttaagcggttttggctatctatctgaattgttttgtgtattatttttctttccttccgtgatactaatttgtgtgtgtcgccaattcaggtacaaaaatggcggcaaacaccaataatgaccctcttggaaacgtgatcccgggggaggaggttgatgataatgttgaagatgaggtacctcttatacctcaaggaaaaaggagaggccgccatgctaataataatgttccagaccctccccctgccacctccaagagtggctctgcaggtgcttccaaaccaaggatatgctagtgcaattgtcccaccccagatccgggtgggcaatttccaaattacacatgtgatgctgactttgttggagcagtgagggtatttcataggtgctccccatcagaatgcctacaaacatatttagggattcgtggatacctattgggggagcaagcaaacaaatgtgtcagaggatgaactttggttgagattattccctttttcatttagagggaaggctttggactaacttgaaatgcttaccaaccattacatcactacttgggatgagttggcggataaattcattgcaaagtgtttctcgtcgggccatatggcgaccttgagggatgaaatcttagctttcaaacaggagcccaatgaaccactgcatgagatatgggagagataccagaccatggtaaaggagtgtccaaataatgatatgattgaggcaatgatataacagacattctaccgaggcattaacacaacaaatcagtgcatagtgaacgaactcatcggaggcaatttcatgaacacaccatatgatgaggctaatgcaatattggatgagatggttgacacgtcctccgcttggcaaagtagagccaatgtgccacagggtgaccccacaatcattcacttgcacaaagagctctatgatcatgtacaggcaatagcagaattgacaacaataatgaaccaactagaaaaggcacaattacaataggttcaaactccacgacaagtaaatgctatgaagggtgtcaacatgttaatgaacaaaagaagacaaacatgtcaacagaaccaagggagtttggatcaatatgaccaagatagtggtgggttccaagatgatgggtatgatgagcagaatgaagaagtgcaatacgtgaacaactatcagggccaaaggggcaattcttcagaccaacaacaatggagaccccaaggcaattggggaaatcaacaacaataagggaatagtaattgggggaataacaaccaaacttcaaattgggtcaaccagaacaacaatcagaacaatcatggtaatcggagtggcaacaacaacaactgacgtggaaacaacaatcatggtggttggaacaataacaatcaagggaactgggggcaaggctttcaaaggcccccgatgtatcaacaaccaaacaattcacccccatttccatcccaaggtcctagttcttccaacaatgaaatggggagaatcgaaataatgtttgaacaaatgatgaaaaagaatgctgactctgatgcccagttggcatccctcaatacttcaatcagaaacttggaggttcaattaggccaaatctcagaatccttgaatactctccctaagggggctttacctagtgatacggtagtcaacccaaagggtgggaacaatgccgaacatgtaatggtggtaactacaagaagtggatgaggcggtgatgtgaatacctccaaacaaaaagaaattttgagtgatgaatttgagttgcaagaggatgatatccctttggtggttgagaatgtgactgatgtgaacgtggatgaggaagtgaggattgatatccaagatactgagatggaaactcagcatgacatggacccatctgtggaacacgtaacagatatgccagaaatgattgtgcctaaagccaaggttcctttgccaaggccacctccaccttatcctcaaaggcttacgaagtagaaaaatgagaactagtttaagaagtttattgacatgatgaagagcttatcaattaatgtgcctttggtggatgctctataacaaatattggggtacgccaagttcatgaaagacttggtgacaaagaaaatatcaatggattgtgagactatcaagatgacccaccaagttagtacaatagtgtactcgatggatccgaagctagaagatcccgttgctttcaccatttcttgtaccattgagagtgaaaactttgcaaaagctctatgtgatttgggagaaagtatcaacttgatgccttactctattttcaagactttgagtattgggcaacggagggctacttcaatgaggttgcaaatggcagatagaactatgaagaaaccgctaggtattgtcgatgatgttcttgttcgggtggacaagttcattttgcccgctgattttgtgattttggattgtgaggtagattatgaagttctgatcatattgggaagacctttcctcgcaactatgaaggccttagttgatgtggaagcaggggaactcaccttccgggtgggtgatgaaaaagtggtctttcatgtgtgcaagtcaataaagcagtctaatagttttgacgtgtgctctttcgtagatcttgtcatggcagtgatagttgatgatactagtgcaacgatcaatgtggaggaccctcaagaggcggtattgttgaatcttgtgtaaatgaggatgaaggccaggtggagtgtgtcaatgctttacatggaatgggctcttactcttatgagccttagaaactctctttggattttgagaataggaaaactccaccaacaaagccctcaattgaggaacacaaggagttgaaaccgcctccacacctcaggtatgaattcttaggccctagttcaactttaccaattattctttccttttgtcttactaacatgcaggtagatgccactttggcggtgctccaaaaatggaagaaggcaattggatggactttagctgatatccggggaataagccctgccttttgtatgcacaagattattcttgaagatgatgcaaagccctccgtggaacatcaaaggaggttgaacgaagcaatgcaagaagttgtgaaaaaggaggtgatctagtggttggatgcaggggttgcgtaccccatctctgatagttcttggacttcatcggtgcaatgtgtgctgaagaagggtggtatgaccatggttaccaatgtgcaaaatgagttgattcctatcaggactattaccgaatgaagggtgtgcatgggctaccgcaagttgaataaagtgacctgcaaggatcactttccattgccttttcttgaccagatgttagatagacttgctgggcgtgccttctactatttgttggatgggtattctgggtacaaccaaatttttattgctccggaagatcaggataaaaccaccttcacttgtccgtatggtacctttaccttttctaggatgccatttgggttgtgtattgcaccggcttcattccagcggtgtatgatagacatatttaccgacatggtggaggaaattttggaggtgttcatggacgacttcagtattgtgggtgactcgtttgatgaatgtttgaaatatcttgatagggtgttggcccattgtgaagaaaccaatctcgtgcttaattgggagaaatgccactttatggtcgaggagggcattttcctcggccataagatctcaaagcaagggatagaggtggacaaagccaaaattgaagtgatttcaaagcttcttcctcctacctcagtcaagggggtgagaacttttcttgggcatgcggggttctaccggagatttatcaaggacttttcaaaggtagtgaatctcttgtgcaatttattggaaaaagatgccaagttcgtgttcaatgaggaatgcatgatagcttttgaactcctcaagtacaagttgacctccactcctattattaccgcacccaattggagcttgccttttgagctcatgtgtgacgcgagtgatgttgaggttgtggcggtcttgggtcaaagagtgaataaaatttttcacccaatgtattatgtaagcaaaacaatgaattatgctcaagtgaattacacgatgaaagaaaaagagttgttggctattgtgtttgcaatggagaaatttagaccttattttatgggggctaaagtgatagttcataccaaccatgccgcactctgatacttgatgacgaagaaggatgccaaaactcatttgattagatgggtcttgttgcttcaagagtttgatttggagattgtggaccgaaaagggtgtgaaaaccaagtggcggaccacttgtcccgcttggaagaagaggggaggccccgtgatggccttgaaattaatgattcttttcctgatgagcagctcctctccgtatcagtgaatagcatgccatggtttgcggatgttgccagcttcctcgtgactagtattgtcctgtatgagctctcttctaaccaaaggaagaagcttaaacatgatagtttggactactattggcatgagacttacttgttcaagatatgcactgacggtgtgatccgaagatgtgtcccggaggaggagcaattgagtattctagaggcttgtcattcctctccctatggtggtcatcatggtggggtgaggacaacttcaaaggttcttagttgtggtttttactggccaacattgtataaggatgcaagtgaacttgtgaaaagctgcgacgaatgtcaaagagtgggttgaattttaaagaaggatgagatgcctctcactacgattctcgaagttgatatctttgatgtgtggggcattgttttcatgggcccggttattagttcatatggcaacacatacattctagtggcagctgactatgtttcaaagtgggctgagaccgtggctttacccaataatgaggcccgaagtgttgttgcatttatcaagaaaagtatttttactaggtttggtactcctcgagcaatcataagtgtttgcttgcaaagtacggtgtcaatcacaaagtttctaccccttataatcctcaggcgagtggccaagttgaagttttaaacagggaaatcaagagtattttgtcaaagatggtcaatgcaaataggaccgattggtcaaagaaattggatgatgctctatgggcttataggaatgcttacaagactccgattggtatgtctctgcaccagttggtgtttgggaaagcttgacatctaccgatcgagttagagtacaagtccatgtgggctttgaggaagctggatcttgaatgagatatagcagcaaatctttgtgtggagcagcttaatgaacttgatgaattctgatttcatgcctactccagttcgtccttgtataagtacaacatgaagtaccttcatgacaagtattctcgtggcaaagagttcaaagtgggtgatttggttctcttgttcaattctcggttacgtctgttttcgggaaagcttaagtcgaaatggagtggacctttcgaagtggtgcttgtgactccatttggtgcacttgacttgaaaaacaagaatggagagatcttcagagttaatgggcacatagtcaagcactatcttggcaagattgatgacagccacgtggtggcaatgatccatctaaagtgatttgatggtaacctgcatcgtgccgcgacgttaaatcaagcgcttcttgggaggcaacccatgtgtctttctttttctttttctttgattttattcttagtgtaggatttgtttttggactaactagttgtgagatatgtgtagggctattttgatgcactacaggaccaaattagaaaaacaatgttgcactctctgaagtttggatcgctgccgcattgcatttttcacggacgcaatggccttatcgcgggggaaaaatttgattgcggtccgcagtgctatatggtaaaaagtggaggttctctgaagttttcaccgcggttgcaatgcatttttcgtggtccgcggtgccctaccgtggatgccgagcattttctatgtctgcggtgaagttcttgtcagtgtcttctatttttaattagcatggtccgcggtggatttttcgcggtctgcggtgggtaagtaatgtgggtcctaggactttttctataaataggacctcgggcccccttttacacttttcgctcatttgcactctaaataggataaaacactgttcatcacaaccctaagttgcacaaattcaaacactgaatctcaatcatctgtattgcatctcatctctcgtaattcaaatctttccctagtttttaattttgtttttttattattctcttttagtttgttagttcgtacttcttcttctttctttttctttcaatctttaacctagggttatataatgttgtttagattaggttttaattagtcaaaatggtcattaactacctagtgggttgataatgtgttgtttaaggctaaaatgcacaagtatttgaaaccctaggtcttgttgcttcgttttgcctaccgcgaccgcggttgatatttcgtggtctgcggtgcctcactgtggccatgatgcaattttttgcggtctgtagtgaccttattcagagagtgggtagactaattcccacccccactgtggtctgcggtgctattttatgcgatccgcggtggtgcctttgcggccgcaatgctttttatgaggcgcggtgaattgtttccattcatattcttcactatttcttttggtactgtgatagtaacaaatattaactgaattctccttggagacaatggttaagtcatgaggcggtggtgaaaaacataaaggaaaaggaaagtcctcccggggtaggggacgaggaatgattagattgacccacaggttcgaaaagcaattggggaaacaagaaaacaaatcaaagctgcagatagagctgcttcccattcatagggaagtgagtatttgccctcctgggaggcatctaagtctgattcagtgctggagtatgtacctgatatcccggggaggtttaggttgagagatatgcccacacctctggcctttcctactgctcaagcttcagttcaagtttcttctaagtcgtttgagggctcagcagagagcagtgatagtgaaacatctacttcacccacagctttaacaccctaggaggatcccattgatgaagaagaagggggataaccccaaatagggggtgtggaaaggactagaaactggaggattggcaaaggagatttgctagtgagattgcttgccacaagttgggaaaattgactcttgagcggaaattcattgagagagaccttttgcctcacaaccctaatgtgaagaggcaattcagagagagaccaagctgggaatattttacaagcaaagtctgggatgcaaactagcacttagttaaggagttctacgctaatgttgcccatatcaaaaagggcactaaagtgactaaggtgcggaatttgatagtgaagtttgatgggaagacaattaatgactatctaggctttccggaggaagatgaatcattatacttggaaaaggtagcattagatgaggcagcccctccgtggttagcagaatacctagaactcccgggtaccaccccagcatggttgacatcaggagttcaaatttttgaggaaggccttaaatttcgaggcaaaagggtgggagacctttgtatgtagcaggctggaccccactacccatgagaactcttttccagtctctcgggcgatattggtggcttctattatggcggggttcccgatcaatattaggaatgttatgtctagggtgatcacaagggtggtcaatgaaggtgatagatcataccccttcccaaatttccttacaatgtattttgaggaccaagatgtggagaaaaggaagtttgatgtgaaggtgaaaccaaagatgcccttttcatggtacaacctcaaggctgatgaaaaccccaagccaaagatcctaaaggtaagccactacttctactggccagtctgaagagccagtagtagtagtcatttcttcttagccgcccataggcacaccagatattacccctggaccatctacttccactgctccacttatcctccccatcctcagcctacccattgacttcccactatttgagacaaacactttctaatatcaacaactggatgcagacaactacttctaagctgtctgtgctttctagcttggtggcaggccagtccgtacccccacagccacatgttccagcttcagtggaagagattctcaagaagcttctggacaaccagaagaagctcctggagaaccatcagttaattctggattctataggtgctcatggaaagtcactaaaggagatgaccaataagacaaagaagctgagaaagactcgagcctcaaaggagtcggtgaaggagttgagggtagaagtggagaagatgaaggctaatgaccatctatcattggagctactgttgcatgaccatcctccagcaactcaaactgagccagagcaggagttggagagggcaccaaagaggaggagagtgatcccccagccagatgatgtagtgattgagttggaggacctgcagggaggttcctctagccagcttcaggtttcaaagcaaccttaggacccagatcaggtacaggttacatggatccagtcgcaggttcccgagcagtcacaggacccagggacccaggctcatgaccccatgaatacggaggaccaatagggaattttctttactctctatccttttcttgagtttttttgctagttagcattgaggacaatgctagctttcatttgagggggtaaccctattttgatgattttggactgtaattatgatactattttcctttttgttatgctttttcactttttgtatgtacataattttaccagtttatttcacttttcgtattttgcaaccttagtttgtatataaagttactttctgatgtatatattcattccctcttatgtatattagtttaaattccctattgtacatatttagtttaccttctgcattttatttcatagcttcttacttcatcttagtagcttccttttcagttcatagcttcttattttgagttttgcgttcaataagcctttgtttttttaatgccactgttctttccaaaggtggaatttgtgtgaaccaggtggctcttcccgatgatggatggaataacaaccttcttaagggtttgagtctgttttctttttatttttgtgtaaataatagctcgtgagtaatagtgtctcaagcaaagcttcacttaggcctaacaaaattgcctttcatcttatggtcaaaaacaaattggtatgtctaggatggtgacatttgggaccttgagatttttgtgttagctaataatcatcaagtggttttcgggaccatttgcgttgctcaaatcttagctaaggtttttgtgggctcccgactctgtctctttagcaatcctatagcttgtgtggtgagaatttgatttgcaagtccatgtcccgtaccattaagtctagaacttgccctgaatgtttgtctaggcgaaatcctaaatgtagtttgacttgagaagtgattataggctctccttgatccgaatggtatcttgaaaacatccatagcctaccaatgataatatccctagtcaacctctttgagccatgccgtttttctttccaagaccataatacaagcctttacccgttctaaaaagaccttttcttggcatcgatctttcctttgcacaaggaaaaatcataagttcagggggagagataaggaatgcaaaaagtggtaaaaggtacaaaatgaagaaaaggaaaggcaaaaagaaaaagaaagaaaatcaaaaagtcaaaaagaatgaacaatgtagaagaaatgaagggattcaataaaagtaaaaagataaaaggtgtggaaagattagaaaggagaaaaaagtttgaaatgaagaagaaatagtgatggtgtgtatctctaacccctaagaaagaagcaaatgactcaaagagtcaagagaatgtgtgccaaaatgaaacaaatgaagtgcttaagggaagatgaaacctacttagaccaaatatttcctaccctgaactaaaaaccttcattgtatccccacaaaagccctatatgattttgagttgagcgaatcttacattagttgtgactcatatatggggcaagcttatggtacttagagccggacttgtgacctttctttgagagagatgagtgtgtcatccacaatcctcattttgagtgctataatctaaaagtgaggttttgcttaaggaagagtgaggagtatgagtttgggttccataatgaccaaagtagtagaaagagtttccttgatgagttgagtcaactcttgatgcttttgtgtcgcactaaaaccatggtgcttaaaaggttgaatgctgttaatgattcatttgaattgagggcaattgttagtcctaattgatgctagatgaggttactttaggtcagctgaattttcttggttttattcttagggaggtgggacttactttgtttgcttgaagacaagcaagagcttgagtttgggggagttgataactagggattctagtctattttatactcatttttgcttgagtttcagattaaaaatgtatacaagtaatcccgaaagcttacatgttgtgcttgtttggtcaaaaagtgaaaaggaatttaaaaccagctcaaaaaggagtgaaacccgcacaagtgccaagaacaagtcaaagcaccgcgacaatagtaaatccaccggagctgcaataaacccaccgcgaccgcattgcatttggtgcggtccgcagtggcaaagattagagagggtgcaattttagaagttcaagcaatgcggtctgcagttgattcttcgcagctgcagtagcctcatcgcggccgcattccatttgttgcggtccgtggagaagggattcagagaatgtgaagtttagaagattcaagacaccgcggtcagcaatccatttgttgcggtccgcggtgaagccaccgcggccgcgatccatttactgcggtccgcggtggccagattcagagacttagacgtgaagccaaaaagcctcaccgtggccgcgttccctctttcaggggcatttttgtccaaaaaattcggccttgtttaaatacttctttttcatatttttagggtatctttatcttagcagagcacgtgaacgacgacttttagctattttgagcaattgtgtagctagtttaacatttaatattcaaatcatagcttgtaattatatttgatgggttattcttcctctaaatatctgatttcttccattattatgagtagctagacccattagctagggttgtggctcaaccctagtgtgggtatttgatgggtattttcttttaaggcttaaatgtttatgagtgattgatatttggcctgatttgtgttctccatgttgaattagtggttgcaaacactaatttgtgcctttttgacttgggctcttcttgagaaagagagtttgagtctaggaaaatcaggtcaacaaggaattggggcgtattcaagagattgatagccctaattaaagggttaaacctagagatagtaatactcgacttgagcctatattgcttgcacatttttgacacccaattggtcttgagaaagtcaattagggcaaagtcactaaagctaccgagaggtatagagtgagtagtgtcgtgcattgtctatatcgcgatcccaaacataacaactttgccttaggctttagaacccgtcaagtattcacctaggggaaatcactttcctaatgcctctttaaccatttagaaaaccttacaagcattcatacttagcttaattttgcatatcattagcataaaattagaagtagcaaacaaacaaatatgattggaagtgtaatcaagagcactacacactgctagattagatagaaatccaactccaaacattgttgtagctccctgtgaattcgatcccgaccttctcggataaaagctgcttcgaccgctctctccactctgtagtggtgtaggttggacccgatcatatttcacccatagaccaatgggtagtcagagcgaactgttaagatattagaggacatgctttgagcatgtatgattgactttgggggttagtgggaacaattcttgcctttggccgacttacaacaatagttatcagtccaacattgagatatctccatttgaggctttatatggttggtgttgtcattctcccaatgggtggtttgagcccggtgaggcaaagtgttacgtcctgcagtattacactacgatgatgttacgctttgcagtattaagttactatgatattgcaccatgtagtattgtatgttggatttttcgtaaggtaattgacatcagtccaagtaaaagattatttgaagattataagattatgctatttcacaagtgatgaataaattcgtaaaggtgaaaggggaagcaagccaaagaaaatgaattttttcatctaagttttgcatattggggtaaagtacggcccgagctaaaatatccggtatttatggactagtgacatgcaaggtactacatgcccatgctagaaaggtgtataaggtatgtgaaaagtgagtaatattttaagtaagtgggaatattctcaattatttgggtaattggttaattaccgggtaacatgacattacccaattaactaataagtggataagattaaatcccttcccccacaccctaaacaaaatgttgcaaaaggcccctatttgagaaaatgactcatgttgatttaagagtaggtggctgccaaggatttaatggaaatattaaaacaagcaagacttagtacatgtcttgtttccatgattcatttggacaagagcagaatgtctttgagtcaacatagaaatcatatctccatttccattttgaagaagagtaacacagccattctgcaaaatcaagaaaattttatttcttcgatcaaatactgtaacgtcaaagaacacaggaaatcgttcaaacacttcaacgagcagaagcctaattctgtcaaaattttgtggttctaacggagtacggtgcaatattttccaagaatatcatacagattttccctactccaggtatgttaaggctaagctttccttcattttagcatggtatcataattacacaagttcgataatgaggcatagagaaaaattcatatcccggaatttacgtatattttgctagtctcgcaaattacatatattctcctagttttgtaagttataatattctccttattgggacttcatattcagttgaatatttccttcatccagtcaagagagtagagaatttatatatatgcagcattaaaagtattttcattaccatcgagctataatcgatggacaggcccttattgggcaacctctgatcagatggtaagttatatgctgatcctactgtggccgagcacctatgagtgaacccagttggtcaagatacagagcctagtatggccgagcgcttatgagcgggactactatggcagagcagttatatatataccgagccttatagggccaggcaactattttactcactatattgagagtgttgagttagtatcagcagataagcatatcttcagattttcttgactcctagttgtttttagttattatattatcaattcattttcagctttagtatattgccttacatactcggtacattaattcgtactgacgtccatttctagggccgctacatttcatgcatgcaggttcagacaaatagacgggtagacctcctcagtaggtgttgcccgagtttagctttatcagtaagctccccgtctttcggagttaccttgtctagcagtgtggtatatatcttgtgtatatatgtagataggttatgggtaggtcagggccctattccgatcatagtacatctatcagtaaaggcttgtagatatatcctgtcagttagtacagtatgctgggctcgtaggccctgcacatatcttttgttggcttgtcagttgtagtaattatgacagccttgctggcccagctatatgttgacgtttagtccacgttagtccctttttagctttatattttgcatcacacattatcttgcaatgtggctcatggccaaagtatgatattacatgttcagagtctcttagtcgaaagtggtatgcaaggataagtgaggcactgggtgtcggtctcgcccccaggctcggagcatgacaaaagtggtatcagagcagttatgtcctagggggtctacaagcagtgtctagtagagtcttatttatgggtgtgtcgtgcaccacactcataagcaggaggctacaggttatttaggactgccactctttcttcttactttagatcgtgtggtagagctcagttgtaagaactctatttcctaaactctatcttattcataatacgacgatatttacttttacaaggccggttggtaaaagacatgactatggaagagttgagtcagaggaactcgaatttgcatcatgcttatgatgagtaactataaggtcttcagcagatcatgtgcgtactgaaaggtgtaagccttttaataaggaaccttaagggaagaatatttatccacctttatggtgaaagacaatgctttcaagaagtaaaagaagcaaggtaaagaagggtatgagttgcccaattaatgaagattatcagtattacagttccagtagaaaaatataagcattaagagttaccctcaacagtaacagaggtatgtacaattggctgtacccatctcagttatgccctatgggggctaacaggtgtagtttaataaaaggacggaacatcaggacctggttggggttagagtaaaccaaaatggtgaatgaattgtttgtgttagttaacatttccgaaggatattgaagatctgctaaaagatctctttatgagacacctagatggtacactttaaaatagtgcagccagatatgtgtactacaaagacatgcactataagccttgaagggatacatatatccctagtgtggctcacgtccctagtaaagcgagaatattaagacacttaaagagctactggatggagcaaagggaagctaaaagcaaaagaatgtcttgttcgagttttcagaataaaatgacaggcataaatgttagcgggaacaagaaaaagaaaagagttaatgaagcattatgagtaagatgtggtatatggatgacaacggtagatcaaaagatgacaatattacaaaatctatagtcaagtgaaggaagatacgagtggtgatagaccttaggacaacaaaagagtataggtcatatagtcatgtcctcatttcgagaaataatttcgcaactctagcacgattaccaagggaaaaagttataccctagagtaatagaaatcagtatgggctggtgaataagataaactaaatatgaattagggactgagtgaatttgtaatagtcagcatcatgagaatttcagatcgcattccgacaataataggatggacaacagaaggaggttcatgagaaattcagagaatggtcattcaggaggacgtttccctaaagcaagcaatgttagcaaatttaagcttaagggactgtatgtaccagttacattaagtgtcaccctcatgagtaagggaatttttcatccttggtatagaaggattgccgcaaggcaagtaaggattattgatgttttgaaacgacgccaaacatgaagaggtaaaacatctatagatagatcctcgtggcttcagctcttagtacacccctaaaggggggatatggagtgatgtggcattaatcaaaattaagtggttctagtgactatggaatggtaaaggaagaatgcgataaatgaaaaaggaatgagatgggacttatcccaatcttacatatatgctacgatttaagaatattgtgcaagtacgatgttaaggagagaaagtaaaggttccttcccgagctgttattaataaataaggagccagtacgagacgtaagttaagataaaggaaaaaaaacaagaaagattatgaggaatattgatatgagaatgggccaatgagtagttagtaattggtcaggaagatcccagttatggctaaataggaggttatagacgagtcatcagatcgtgtgagataaacatagtagaaaccaacatagagagttcatcctcgaagaatatcattataatacttgagatatattcaaacaagagtcggggtagttaaagataccttatgagtgttatggggataaaaaaaagtgccactgggaaggcagtcaaaatatcagttcagaagcaactatacaagcacaagggcatggaagtaagcaactatggatgattataggcaagtaaggacatcaaaaaggtctgtaataagctcacaactttacgagagtcaagggttctccctaagtactacagtgaaagactagctgaggagataagaaagaaggcttcaacctaagcacaccgacctaaagaggaaatggtcatgtaacaacaatcttgcaacaacattgtaagcattccaaaggaaagtggtacctaccgtggctaatgaacgggaagtaagaattaaaagtaatattcgagatcatgtgagttgtatgaaaattatggcatatatgggaactaggatgagttaagtatgcaaacaacaaggggcagaaagaccaggaaaagtaattgcacacgtttaaagaaagctgagatggaacaaaaagaattattcgatcaatgaatctgagttagtacgttatggatacactcaagattttggagcattatccaagcaacatattttgttgacaatcatacggctatagaaaactccagtataagttaaaagaaagaattgagcccagggcataggcaaaggattgaattgttcaaagattgtatcatggatattctataacgcccatgaagagctaaggtaataactgataccatgagccacagatcggaagatagcttaagcctacgtaaaggctgatcataaggaaaggaaaataaagaattacatcacccatgtaaatcaggagtctgattattggacctagaaaaattatagaagttgagcttgagaacatgatagaatcactcttaatatcagatgttcaagagaaataacacaacaaccataatctataatggctctacaaggaagccagttagaagaagtaccagcctcataagaagtcagtacggagctcccaccggattgtgtatataccggaggtgcgagcattataatagagcttcaagttatgggcgtgaattacacctaggtggaaaggaggtcaggaaagaaatagaagatacgatgtgagattttaaggtaagtaaggtaaaggtgaacaacatacgagacactcaaaggcaaaagatcatgaatagtccatactttggatagaagtctataagcgcggatatccaataatcgggaatgatagtggtatcgtcggcaacatgtcttccaaaatatcatttctaagtactaagagatctagttaagagaatagagaaaagttggagacgatgtgattcctcgcttaatgttctaaacattaagcgatcgcgatcccaaacataacaactttgccttaggctttagaacccgtcatgtattcacctaggggaaagtcactttcctagtgcctctttaaccatttagaaaaccttacaagcattcatacttagcttaatttcgcatatcattagcataaaattagaagtaacaaacaacaaatatgattggaagtgtaatcaagagcactacacactactagattagatagaagaccaactccaaacattgttgtagctccctgtggattcgatcccgaccttcttggataaaagtagcttcgaccgctctcgccactctgtagtggtgtagggttggacccaatcatattttacccacagaccgatgggtagtcagagcgaacagttcatatattggaggacgtgctcagagcatgtgtgattgactttgggtgttagtgggatcaattcttgcctttggccgacttacaacaatagttatcagtccaacattgagatagctctatttgaggctttatatggttggcgatgtcattctcctaatgggtggtttgagctcggcgaggctaagtgttacatcttgcagtattacactacgatggtgttatgcttcgcagcattaagttacgacgatgttgcaccatgtagtattgtacgttggattttttgtaaggtaattgacatcagtccaagtaaaagattgtttgaagattataaagattatgctatttcacaagtgatgaataaattcgtaaaggtgaaaggggaagcaagccaaagaaaatgaaatttttcgtctaagtttggcatattggggtaaaatacggcccgagctaaaatatccgatatttatggacttgcgacatgcaagtcactacatgtccatgctagaaagatgtataaggtatgtgaaaaatgagtaatattttaagtaagtgggaattattctcaattttttgggtaattagttaattaccgggtaacatgacattacccaattaactaataagtggataagattaaatcccttccccccctcccccaacaaaatgtggcaaaaggccactatttgagaaaatgactcatgttgatttaagagtaggtggctgccaaggatttaatggaaatattaaaacaagcaagacttagtacatgtcttgtttctatgattcatttggataagagcagaatgtctttgagtcaaaatagaaatcctatctccatttccattttggaaaggagtaacgcagccattctgcaaaagcaagaaaattttatttcttcgatcaaatactgtaacgtcaaagaacataggaaatcgttcaaacacttcaataagcagaagcctaattttgtcaaaattttgtgattctaacggagtacggtgcaatcttttccaagaatatcatacgaattttttcctactccaggtatgttaaggctaagcttttccttcatgttatcatggtgtcataattactcaagttcgataacgaggcatagagaaaaattcataacccgaaatttgcatatttttttgctagtctcgcatattgcgtatattttcctagttttataagttataatattctccttatcgggacttcatatttagttgagtattttcttcaaccagtcaagagagtagagaatttacatatatgcagtattaaaagtattttcattaccatcgagctataatcgatgggtaggcccctattgggcaacctctgatcagatggtaagttatatgccgatcctattatggctgaacgcctatgagcgagcccagttggttgagataaagagcctagtatggccgagcgcttatgagcgaacccactacgacatagtagctatatatatatatatatatatatatatatatatatatatatatatatatatcgagccttatagggccgaacaactattttactcactatattgagagagttgagtcaatatcagcagataagcatatcttcagattttcttgactcccagttgtttgcagttattatattatttgttcagtttcagcttcagcttcagtatattgccttaactcggtacattatttcgtactgatgtccttttctggggtcgctgcatttcatgcatccaggttcagacaaacagacgggtagacctcctcagtaggtgttgcccgagttcagctttattggtaagctccccttctttcggagtttccgggtctagctatgtggtgtgtatcttatgtatatatgtagatatgttatgggtaggtcggggccctgttcctatcatagtacatctatcagtagaggtttgtagatatatcatgtcagttagtaaagcatgttgggctcgtaggccctgtacatatatttcgttggcttgtcagttgtagtaattatgatggccttgccggtccagctttatgttgacatttagtcatcgtttatctcttttcagctttatattttgcatcgcacattatcttgcaatgtgacccatgaccaaagtttgatattacatgttcagagtctcttagtcgaaagaggtatgcaaggataattgaggcgctgggtgtcggtctcacccccaggctcggggcatgacactaagttctatggtattgatttagtgaaggattccttggaaaaggtaaagttgattcaggagcgacttcgcacagcacaatccagatagaagagttatacggatcaaaaggcacatggtgtatcatttatggtcagcgagaaggttctcttgaaagtctcaccgatgaagagtatcatgagattcagaaagaaggacaagttgagcccgaggtttataggcccatttgaggtgttgaggcgagttggggaggttgcttatgagcttgctttacctcccagcctattaggggttcatccagtttttcacgtgtctatgctccggagatatcatgccgacttgtcacatgtgttagatgttacaccccatgtttccgtacgtgaaagtacgccatatgtaaattgatgtaagctcaaaaagggatgaattctttctacaaggctaaggaaggtttatcaaagtattgggtaagttaggatgaatgaaacattttaatcatgatttaagtgagtttaaagtcgtgaaatggctatatatgatgtttggatatgaaatataaagtttgagaaaaatcggatttaagtcgtggaaaaactgactaaggatttgccttgtaatgaagcgttttgagcaatacattttatgtgctatatgaggttttttcgggacatattatataccaaaatgaagatcttggaaactagtttccaacagtccaacccatttattcatacgacatcggggcatagaaatatggatttttgagtagggtcgccaagtcacgttgccgcacttgggagaaactggcaggtttataggacatgttgcgacacagttttctctaaatatatttagagttacatggatatctttattattgaattaaatatctatgtgtcgagtttccatcactgcaaatgatttgtcaatatgatatcagagtagagagatacaagtgtccgaagtggcactgctcaagcttccaagcaggtagcttacccacctgcttggagaattgaagtggtgggcttataagttgtctttactcattacatatagtcaatataaaaatatttcttacacaaaaactctctcaagctctccaagaactagtccaggatcttaagaaccaaacttaagagaaatcaacacaaatcatcatcaaagatgttaaagattacaagagaatgcttctatgatgttgtggtgtgattgagggctattgtgagctaagttgatatagggttttgagttttaaatgttgtacaaggtatgtataacatcttcttgattgtgcctaaggttaatcttgtgttggctatgttgtttgagtaaaaaaccataagatagcacttgaaagaacatgggatatggttgtctttttggctggacagttttgtggctaaatatatggtttgtggtggctgaaaattgtgagaaataatttgataatgttgtgactgctgttgttaagctttttcaggtgttaattaagtttattgaagaagaaacgataaaaaataagtgattgacgataaaaattaaggtgctagacgtatagggctattttggaaggcattttgttgatgttttaaactagaaataatatggtacatataagtatgatattctgaaggttgtaaactaatttatggaataagatttggatttaagttatatcttattatgagtaaaaacgagctcgtcactcaatatgattgttaagataattggagaaactcatattggattatattgttgttgttgctattgttagttgtagttgttgtattgggatgttgatgaccctttgtggtctttgagatgaattaaaaaataggggaattgctgcccgattttccttatgtcatacaactagccaaatacgatggtacgacattatatgttaacgataatataatttcacctgttgtagatgcaagaagttgtgctgagcttggttgagcaataaggaagagctcatacaggtatgttaaggctaacctttcttcttttggcatgatccaagaaatgatacgtaaatgtaatgctattccataagtgattctacccttatcagttaaggatatctacgttactcattcctataaagtgatattcaagcatgtctaagtatgtccccaagtccctattgaggtatatgatagagatgttaatgtttttaatatagtgatacatgcattttcatgcatttaccaccgtgctacggtcggtcgggcagttactaccggttgggcagtcatgcatattcatttaccatcgtgctagggctagtcgggcagtcatgcatttaccaccgtgcaaaggccggtcgagcagttaccactgatcagttgggtagtcatgcatcgatatggataatggttccaaataggttatatatatatatatatatatatatatatatatatatatatatatatatatatatatatatgcatataagtataataagtatgaatatacggtagcactgcagaggttcaggtgattcttatatctctttcattaatgctgacttatcattatgttttagttctgtcttacatactcggtacattatttgtactgacttcccttttgctgaggcactgtgtttcatgccatgcatgtgtagataggcgaggtgaggaccctccactgtaggctgcctccagatatcggcttttggttggtgagctccagttcttcctggagtattgccgagtcacgttctatgtatgttatttcgttttatgaggatgtcaggaactctatgccgacttatatattatggtcatgtttttctagaggctttgcagacagacatgtcaacgtccttgtcggcccctatgtatctatataaatattttagaattagttatgtgagttaagttctaatattgttacttatatatatatatatatataaagttaagttctaatattgttatatatatatatatatatatatatagagagagagagagatgtggcttgtcatggctcatgacaagtcttatagtaaataaggataaggtacgtggcgctcgattgagtaggcaccaggtgccagtcgtagcccctccgatttgggtcgtgacattagacttcagcactattcagttagatgagagcttggattatgaggaggatccagttgctattgttgctagacaggatcgctagttgagatccaagaggatttccgcggtaaaggttcagtggaggggccaaccagttgaggaggcaacctaggagtctgaggaggacatgaagagcagatatccacacttattcaccacttctgatatgaatctaaacccattcgagaatgaatgtttgtttaagagatggagaatgtaacgttcgaccgatcattttgctttctagattcccgttccataaataagactttccgtacttgattttactattttatgacttgcggggatgtttgatttgggatttggaagagtttaggttgaaatcataactcttggttccttaaggttggcttaaaaggccaagtttgacttcggtcaatattttgagtaaacaacctcgaaatacaggatttgacggttccaataggattgtatgataattttagacttgagcgtatgttcggattgagttttggatgatgcgacagcgttttggcgcctaatagtgaaagttggttcttgaaggattttgaagttctttaaatttggagcgggtttttgtgatattatggtccaaacggaatttcgagactcagaaaagttccgtaatgtcatttaagacttgtacgtaaaatttggtgtcattcgagtagtataagtacgtttcagcgcattggaagtaaattgaagaacttgaagttcttaagtttgattcaattgttttagggtgtgattcttagttttaatgttgttttgggcatgccgagagtttgagcgggtccgttttatgattccaaacttgttggtatgtttgggcggggccccaagtgctaaccggacgaggctcggaccaagttgagatatgggaaccacagctaagtgcaccaggtctgtcacaaccgcacctgcagttggtcagccacaggtgcgagctcgtaggtgcgggctatgcatcgcagaagaggccaaggaagggcagcccaggttccacagatttggcccctcctccgcaaaagcgggacagcagaagcggtcacccgaccgcaaatgtgacccagccggccagggcaattctgtagaagcagacccttgtccgcagaagggggatcgtagatgcggttctgtgatcatagatgcagaagtcactggggaatttaatatgggacttaggcatttttgactcatttcattcaattgttgggcgattcttgaagctcttagagaggagattccacccaacaccttgaggtaagtgattcctacataatgcagttaaatacatagtttatgggtatattataacatgtgaattggtagaaatcacgtgtttaggtgaaaacccagggttttgataaaatgatattttaccacgaaaatggttatggaacttagtgaaaatcatatatttatgttcctaaggttatgggtaacaactttcttcaaaatttccgaaatccgggcacgttggcccggggatgaattttaggaatcttgcatttagagttggaaaattacttcaatagttgggagatgaacttataagcttatattgatgagtttttacactatttggatagttttggatcgttcgacaccaaattgagggtttgggcataagcatggaccggaaagtaggccttgaaattttcctataggtgaacttaattaatatgtgattagttatgggggttacgtacgcacagagtgatgagagtccgtatgtagctactattcttgattatgtccgggtagttttaggatcacaccatgcttgaggataccattatttgattatatttgttattgtgatagatggaaccaagttgagaattttcaaggattttaaaagcttcatgttgaaatgtctatatttttaaaagaatctagaaaagtgttacgatttatttataaattgatatttgaccacgtcacacgtattatccgcaagcggagtaattccttgaatttatatttgactgcgtcgtacatatgatccacgagcggggtaatagatgcatctatggttcacaccattggaccctcgccagtgcacggtttacatttatgttggatcgggccgaacgtcctcggtggtattcgtgtgtgataatagaactagaaactttttataacttgtttgaattgttgtcgagagatcacttgttttaaataaaggaagtgctttggattcttaaatatgttggaaggattgttcagttatttatctttctttttttgagcttgttgttatctccatatattatgcttaaattagaaatttcatattattatattgttggccacaataagtgtcagagtcgatccctcgtcactgcttcttcaaggttagaccagatacttactgggtacatattgttatgtactcacgctacacttctgtacttaattgtacaatatttgaggtaggtgcatctggtcaccagtcaggcgcgtagatttgatccccctttcaagacttcacggtgagctgccttatgagccattctacaacagctggagtcttctttatgctttatttttctgtatattttcttccctactaatgttcttttgtacattctactagatttctcacatacttgcgacaccaggtcttggtacacacactagtagacttatgattttggtattgtatacatgattacggtttatattcgttgcttccttttaacttggcttcattggtaaatttctaaatcttttaacaaatcaagaattttatccacttagtaatttatttaagtggtaaatcactagtttgatcagtgttgggttgcttagcaatggttgggatccatcacggcctatgatgaaattgggtcgtgacaaggtcacatagggcaagatcgaatgaatagattggctaaggaaggtcatttaggttctttctctaaaattgaaattccaacttgtgaaaattatcttaccggaaagattacacgtaaatcatttggaaagactaagagagctgatttcccatagcaattaatccattctaatatctatggtctaatgaatgtgggggctaggtcgggtgcttatatttcattatgttcattaacaatttcacgcgatttggttatgtctatttgtcacgaacctaaactcaaacctgttgtgatggcgcctatcaatagtactaggccagccgacttccaaaataccacaataattcattaaaagatatgccaaaagacatcatgtttagcagtattccataaaaggaaaaccagagttgaattcaaagatagaaatgcaaaaattaaatccccaaacagcggggtatcactaagtcatgagctactactacaattattctgataacaataaaactaacatagtatgggaaaggttgaaaatacaactacgaggaagatatagaagaagaaagcagggttgcggtctccaagcaactacattattatctctagtgattagcagccactaccgtggcctgatatacctggatctgcacacaaggtgcagggggtaacgtgagtacaccaactcagtaagtaacaagcctaaactatggactgataggtagtgacgaatttaacctcaacggtaaacaagaataaactgtatagaaagtaggcatgctttcaattcaagtatttagctcaaacagtaaagtaaatacaactctggatattgtgatatatatacagtccagttaacctctacgtgccaatgtacagaatgtatgaaatccactatgtacttccactctcaagtgctcaaccactcggtaccgtatatggccatctagcctagggaggatccatcttggaatatatacacatcactgacaacagtcactcagtaccgaggaaggccattctaaccatgtggagaagatccatctctaggtatcaatacttcggacaagatcaatatctagggaagatcaatccctcaataatatcatttatgcccactatgggtgtgcagactccggaggggatcctaaggcccaagcgctatcataatcaatataactattgtggtgtgcagaccgaccccataactgtcactcataatcaagatctcggcctcactcagtcattcacctttatagtctcaccacgggctcacaatgttgtgaaaacaatccggaacaatgatatgattaatcaataactaaccgagactgagatatgctatagaaatgcatgatcatgactgagtatgggaaataagcaaaaactagtgagacgacaacatgaaatgatagctaaggtccaaacaataccggcacaaggcctaaatatgatatctaaaatgatttgcagctcaactatgttattatataatgaacacatggatatcaacaggataaattaaagtcagtaaaaaatgccatggaatcacccagcccataattctcacggtgcatgcccgccacttggcatgtgcgtcacctcagtactaatcacatgacacatagttcggggtttcgaacactcaaaaccaagtttggaagcattacttacctcgaaccaagccaaaatcctactccgcgatgcctttgcctatcaaatcggcctccaaacataccgaatctagtcacaagcaaaataacgcaatcaatataggccaaagaaccaattccaaaagaaaaactattcaattggacatagatcccgaaatcaactcaaacccatccaccgagcccacctctcagaatccgacaaatgtcacaaaactagaaagcccattcactaacgagtatccccataccaatttcttcaaaatctgacatcatttggttcctcaaatccccaaattactctctccaaattccaatccctaacccccaaattttcacttcaaaattccactaattaggtgaagaaacaacgggaaaacaccatagctaaagataatagagctcaatcaacttacctcactgaatgcccttgaatccccttcaaaaatcctcccaaaagctccaaggtctgtgttaaaaatggtgagaatgagcaaaaattcacgaaatcttgtatttataccttctgcacaggtttttctgcacctacggcataaaatgcgcacctgcggtgctgcttctgcgtaaaaaccttcgcatctatggaaaaacacttaaatccctgggaccgcatctacgactaacgactgcatctacgatcatcgcaggtgcgagaatgacatcgcacctgcggaccaacacatgcacatgcgccatctcttccgcttctgcgacaatcgtaggtgcgacgaacatatcacacctgcggactatgccagaccttcttccttttgcttctacggtcacattctcgcttctgcggctcgcacatgtggtttccactccgcaggtgcggttatgacagctgatttccaaattcagcaaatctccaaactttaaacttgatctgttaaccactcgaaacatatctgaggccctagggacctcaacctaacataccaacaagtcatacaccaacctacgaacttggccaagccttctaatcactcaaaacaccatcaaaataccaaattaccctcagattcaagcctaagaacttctaaacttccaaattttgcaaacgacgccgaaatctatcaaaccacatccgaatgacctcaaattttacacacacgtcaaaaatgacaccacaaacctactccaacttttggaattccattctgaccccaatatcaaatttccactaccgaccaaaattgctaaaatccaaactttcgcccaatttaagcctaattctaccacgggcctccaaatcacattccggacgtgctaccaagtccaaaatcacctaacggagactataaaaattcacatccgtgattgtttacacataagttaatatctggtcaacttttccaacttcagccttcacaaaagagactaagtgtctcaaatcctctccgaaaccactccagacccgcaccaactaacccgacatatcataatatggctgaagaacccaaaaagaagcagaaatgggggaatggggctacaactctcgaaacgaccggtcgggtcgttacactatttgatttcttataaatctgaagcacttgaatactttaagaaatatttgaatgaagttgagaatcaattagacaaaagtattaagaccttaagaactgatagagggcatgaaatctatcaaaagaattagaattatgtaatgaaaagggcatcactagataattaactattccttacacacctcaacaaaatggtgtagcagaaaggaggaacaaaacactattgacatgacaaggtgtagcagaaatgagcatgcaaatttacctatccccttttggggagatgcgttattgactacagcctacatactgaacaaaatgccttctaaatcagtttcttccactccttctgagctttagactggtcataacccaaaacttaaatgctttatgaccttagggttgtggtgcatatataaatttttttagcaagtttggtaaattaggtccaaaaggcaagaaatgtatctttataagatattcagaacactccaaagggtatgtgttcattggtgaattagaggatggaactgttattgagattgaatctcgagatgtcacatttctagaaaataattttccgaagaagggagagctaaagaatgtagtggctctttaagaaatgttgaactcaaatagttagcaagtgtcttctgacacagttgataatcaaattgatcataatcttgttcttgacccgaacaggattggtagttcttgatcgggtccaaccctacaccactacaaagtggcaagagtagtcgatgtagcttttacccgagatggtcgggatcgaatccacagggagctagattgattgggaattggattcctatctaaactagaaatgtgtactgctcttaattacacttccaatcataattgttgtttattacttctaattttatactattgagatgctaaattaaactaagagtaaatgcttgtaagattttctaaatagttaaagaggcactagggaagtgactttctcctaggtgaatacttgacgggatctaaagcctaacataaagttgttatgttagggattgtgatatagccaatgaacggaactactcactctatacctctcggtagcttgagtgactttaccctattgactttctcaagaccaattgggtgtcaaaattgtgcaagcaatataggctcaagtcatgtattactatctctaggtttaactctttaattggggctatcaatctcttgattacaccccaattccttgttggactgatgttcccagactcagctctctttctcaagaaaaacccaagtcaaataggcataaattagtattttcaaccaccaattcaacatggaaaacacaaatcagtccaaacatcaactacccataaacacctaagccttagaacaacatacccatcaaatacccgcactagggttgaaccacaaccctagctaatggctctagctactcataataatggaagaaaacagataaatagatgaagaataacccatataatttgattacaaactaagaaattgaagattcagtgttaaactagctacaaattactcaaaatggaataagatcgccgttcacgtgctctggattctaactgataccctaaaaatataaaaagaaagtatttatactaggccaaatatttttggacaaaaataaccctggcggaggtattgcggatcacagaaaatgcacagcgaccgcgatgaggctttttagctaaaatgctcagtctctgaatctggccaccgtggactgcataaaatgcattgcggcttcactgcggtccgcacaaaatggactgcggaccgcattggcttccaatcttcaaactaccaactctttgaatcccctctctgtagaccgcataaaatagattgcagccgcgaagagtcttctgcggggctgggagaaatccttcatggaccgcacttctttaagctccaaaagtgcccctgtctgaactcatccactgcaaaccgcactaaatggtctgcgtctgcggtgagtcttttgcggctgtagtagattttattctacagtagtgtcgtgacttattcttggtacttgtgtaggttttactcctttttgagctggttttgactacttgtcactcttttgaccaaaccctgcaaacaagtacagcatgtaagcctttggggctatttatatacatttttaatccaaaactcaagtaaaaaggagtgtaaaatgaactagaatccctagttatcaactcccccaaacttaagcttttgcatgtccgcaagaaactaaataagtcccacctccttaagagtaaaaccaagaaaatttagctgacctaaagtgacctcatctaacatcaattgggactaacaattgccctcaaatcaaatgaatcattaacaacattcaacttttcaagcaccatggttttagtgcgacataagagcatcaagagttgactcaacccatcaagaaaactctttctactactttggtcattgtggaacccaaactcatactcctcaactctccataaataaacctcacttttaggttgtagcactcagaacgaggattgtgggaaacacactcatctttctcaaagaaaggtcataagtacggctctaagtacgataagctttccccttatgtgagtcaccaataatgtaaggttcattcaactcaagatcatatagggcttttgtggagatataatgaaggcttttggttcagggtaggaaatatttggtctaagtaggttctatcttcccttaagtacttcatttgcttcattttggcacacattctcttgactttttgagtcatttacttctttcttaggggttagagagacacattgtcactcttcttgttcatttcaaaactttttctcctttctaaactttccacacctttcatctctttacttatattgaatccctttatttcttctacattgttcattctttttttgaccttttaattttctttctttttcattgcctttccttttcttcattttgtaccttgtaccactttgttgcattccttgtctctccccccaaacttatgcttttgccttgtgctaaggaaagatcgggtgccaagagagggtcttttttgaacaggtaaaggcttgtatcatggtctttgaaagaaaaaggctttggctcaaaagggttgaatagggatattatcattggtaggctatggaagttttcaagatatcattcggatcaaggagagcctataatcacttctcaagtcaaactacacttaggatttcgcctagataaactttcagggcaagttctagactaatggcatgtgacttggacttgcaattcaaattctcaccacataagctataggattgctaaagagacagagtcaggggcgcacaacaaccttagctaagatttgagcaacacgaatggtcccgaaaaaccacttgatgattatcggccaacacaagagtctcaaggtcagaactttcaccattccatacacaataatttagttttgaccataaaatcaaaggcaaatgtgttaggcccaagtgaagctttacttgaggcaccattactcattagctactatttacacataaacaaaaagaaaaaagactcaaacctttaagaaggttttcacgccatccatcatcgggaagagccacctggttcacacaaattccacctttggaaagaaccgtgacattaagaaaatcaaaggcttattgcacgcaaaactcaaaataagaagctacgaagataaagtaagaagctatgaaagaaaatgcagaaagtaaaatgaatatgtacaataggggatttagacgaatatacataaggggcaaatgaatatatacatcagaaagtaacttatatacataccaaagttgtaaagtacgaaaagttcaataaactagtaaaactatatacataccaaaggtaaaaagaaagcataataaaaagaaagtagtatcatatttacaacccaatgtcatcaaaatagggctaccccctcgaataaaagctagcattgtcctcaatgctaactaacctaaaatagctcaataaaagatagagagtaaagagaaactccctattggccctccgtctgcatggggtcatgagcctgagtccccgggtcctgtgactactcgagaacttgtgacgggatcccaatatcatgttcctacactgggacctgaggcttctctagggcctgaggctggctagaggaacctccctgcgggtcctccaactctatcactgcatcatcaactcgggggatcaccttcttcctctttgttggtctctccatctcctgctccggctcaggatgggctgctagaatcgggtcatgtaataacaactccaatggcaaatgatcagccttcattttctccacttcacccctcaactccttcacagactcctttgatgctcgagtctttctcaacttctttgtttccttcgccagctccttcagtgcttttccataagtacctatatcatctaatatcaacttctggttctccaagcgcttcttctggttgtccagaagctccttgagagtcttctccactaaggctgggacctgtggctgagggggtacggactaggctgccactgagatagaaagcacagacaacttagaattagttgtctgcatccagttgttgatactggaaaaggtttggcttaaatggtgggcagtcaatgggtaagctgaggatgaggggatatttggagctgtggaagtagagggtcctgatgaaatgtatggtgtagttgagagaggctgagaagaagctactactactactactagctcttcagactggccagtaaaagcagtggctttgcctttaggatctttggggttgtcatccctcttgaggctgtaccaggagaaaggtaccttgggtttcactttcacatcaaactttcttttcttcacatcttggtcctcaaagtacatggtcaggaaatttgggaaggggtaggatctatcaccttcattcaccaccctcgtgatcaccctagacataacattcccaacgttgatcgggtaccccgccatgatagatgccaccaaaattgcccgggagataggaagagagttctcatgagtggtggggtccagcctgctgcaaacaaaagtctcccacccttttgccttgaagtttagggttctcctcaaaatttggactcctgctgtcaactatgctggggtggtaactaggagtgccaagtactcttctaaccacggacgagcattctcacccaatgctacctttttaggtataatatttcatcctcctccgaaaagcctaggtagtcgttgattgtcttgccatcaaacttcactgtcaagttttgcaccttagtcactttcgtgccccttttaatgtgggcaacattagcgtagaattacttgactaggtgctcattttcctcctcaacgttgcctgtaaaatagtcccatcccggtctctctctaaattgcctctacacattagggttgtgaggcagaagatccttgccaatgaatctccattcaagtattaacttcctcttgagccaccactctcagaatttgtggtaaccaatctcactgacaaatcttcttttccacacctcagggtttctagttttctccacaccccaggttatggcacacaccctccctcttcattcagaacctcatcatcgatgggatcctctccaggtgatgaaccagtaggttaggtagatgcttcactgtcactaccctcagctgagccctcagacgactcagaagaaattggaactgaagcttgagcagtaggagtgcccggaggtgtatctctcaatctacgcctcttcaacctatcaggaacatactctggcactgaatcagactcagatgccttttgggagggtacatactcacttccctttgaatggtaagcagctctatttgcaacctttattgactttctagtttccttaattgcctgtcggacttgggggcaatctgatcataccacgtcccctaccctgggaggagtctcctttgcctttctgtttatcacctccgcctcgtgatttaaccattgtctgcaaggagaattcatttagtatttgttagtatcaaaaccagaaaaagcaatgaagagtatgattgcagatagttgatagtgtaaagtagaactacagaccgcagtccacaaaaaatgcaatgcggacacaaagagaccaccgcagactgcacaaaatcgcatcgcggtccgcattgaggtggggtcagaatacccactctctaattcagggcaccacggacctcatgaattgtagtgcggtcgtggtaaggcaccgcggactgcagaaaatccactacagttgcggtcctcaaaccttacctctatgaagatttactaccacagtccgcataaaatagcatcgcggactacatagaggcaccgcggacagcagaaaaaccatcgcggtcgcggtaagaaaaactcaacaataccaacctagggtttcaacattcttctcatttttagcctaaattcacatattgtaaacccactaggttttcaattatcattcataactaattaaccctaatctaaataacttgtgcaatcataagctaaaaatttaaagaaaaaaggaagaagaagaagacgtagaactaacaaattaaaagaaaataaaacacaattgaagactaaggaaagattaaaagtaccagtaatgagatgcacacagatgaaaatgaatcagtgattaaattcgtgcagctaggcatgatgaatattgcttttttttctatttggaaagcaaatgagcgaaaagttttaaatgaaggcctaaggtcctatttatagaaaaaggacataggacccactatacctacccaccgcgaaccgcacaaaatacaccgcattctgtgatactcaaacatatgaagcactggggaggcattcactgtggaccacaagaaatgttctgcggccgcggtagggcagcgcggatcgcataaaatgtattgcggccgcgatgacaatctttagagaacctccactttctaccatttaacacttcaaccgcaatgagattttgcccccgcaacaaggccactgcagccataaaaagtacattgtggcagcagtccaaacttcagagagtgcatcatttttccactttggtcctgcactgcatcaaaacaattctacacacatatcacaaccggttagaccaaaagaaaatcctatagtaaaaagaaaatcaaagaaaaacaaaaagaaagacacatgggctgcctcccaagaagcgcctgatttaacatcgcggcacgacacaggttaccatcaaatcactttagacggagcagtgccaccatgtggctgtcatcaatcttgccaagttagtgcttgactttgtgcccattaactctgaagacctccccatttttgcttttcaagtcaagtgcaccaaaatgagtcacaaacaccacttcaaaaggtctactccatttcgacttaagctttcatgaatataaacgtaaccgagaattgaacaagagaaccaaatcacccactttgaactccttgacacgagcatacttatcgtgaaggtacttcatcttgtccttgcacaaggacgaactggagtaggcatggaatcggaattcatcaagttcattaagttgctccacatgaagatttgctgtcacatcccattcaagattcagcttcctcaaagcccacatggtcttgtgcactaactcaaccgatagatggaaaagctttcccaaataccaaccagtatggggacataccaatcagagtcttgtaagcagtactataagcccatagagaatcatcctatttctttgaccaatcggtcctatttgcattgaccgtctttgacaatatactcttgatttccatgtttaagacttcaacttggccactcgcctgatgatgataaggagtagaaactttgtgattgacaccatactttacataaagtatcaaaagctcgattacaaaaatgagaccccccatcacttatgattgctcgaggagtgccaaaccaagtaaaaatgctcttcttgagaaatgcaacaacactccgagcctcattgttgggcaaagtcacgacttcaatccactttgaaacatagtcaacatgtatgtgttcccacacgaactaacaaatgagcccatgaaattaatgccccacacataaagaatatcaacttcaagaatggtattgagaggcatctcatctttcttcaaaattccacctgttctttgacattcgtcgcatctcttcacaagttcacttgcatctttgtacaaagttggccagtaaaacccacaaataagaacctttgaagccgtcctcacccttccatgattgccactatagggagaggaatgacaagcctctaagatactcaattgctcctcctccgggacataccttcggatcacaccatccgtgcagatcttgaacaaatacggctcatcccaatagaagtccaaactatcccgtttgagattcatcctttagttagaagggagctctcacgggattataccagtcacaaggaaattagcaacgtccacaaaccatggcataccattcaccgacatagaagggattttctcatcagggaatgaatcattgatatctaggccatcacgaggcgtcccctcctcctccaagcgggacaagcagtccgccacttagtttttactacacttttggtccacaatatccaaatcaaactcttaaagtaacaagacccattgcatcagcctagctttggaatccttcttcgtcatcaagtaccggagtgcagcatgatcggtatgaactatgactttggcacccatgcgatacggccgaaatatctccattgtgaacacaatagccaaaagctctttctcagtatccatgtagatcacttgagcatcattcattatcttgctcgcataatacatcggatgaaatattttattcactctttgacccaaaactgccccaattgcaacatcactcgcgtcacacatgagctcaaaaggtaagctccaattgggtgcggtaataataggagtgttggtaaacttgtgcttgagaatttcaaaagcttgcatacatccctcattgaacacgaactttgcatctttttccaataatttgcacaagggattaactacctttgaaaagtctttgataaatctccgataaaaccccgcatgcccaagaaaacttctaactcccttgatagaagtaggggggagccttgaaatcactttaatttttgctttgtccaccactataccatgctttgaaattttatggccaaggactatgccctcctcaaccatgaagtgacatttctcccaattaagtacaagattggttttttcacaatgggccaacactctatcaagatttttcaaacattcatcaaacgagtcacccacaacactaaagttgtccataaacacctccaaaatgtcctccaccatgtcggtaaatatgaccatcatacaccgctggaatgtagtcggtgcattacataacccaaatgacatcctagaaaaggtaaaggtaccatatggacaagtaaaggtggtcttctcctgatcttccgaagtaatcaaaatttggttgtacctagaataaccatccaagaaacagtagaaggaacgcccagcaagtctatctaacatctgatcaagaaaaggcaatggaaagtgatccttgcgagtcactttattcaacttgcggtagttcatgcacaccctccacccggtgacagtcctggtaggaatcaacttattttgcacattagtgaccacgatcataccaccctttttcagcacacattgcaccgacgaagtctaagagctatcagagatggggtacacaaccccgacatccaaccacttgatcacctcctttttcacaacttcttgcattgcctcgttcaaccttctttgatgtttgaaggagggctttgcatcttcttcaagaataatcttgtgcatacaataggcggggcttattccctgaatatcaactaaggtccatccaattgccttcttccgcttttggagcaccaccaatgtggcatctacctgcatattagtaagataagaggaaaaaataactggtaaagttgaaatagggcctaagaattcatacctgaggtgtggaggcaacaacttcaactccaacaccggaggttccttgattgagggctttgttggtggagttttcatattctcaagatccaaagagagttttcaaggctcataagagtaagagcccatttcatgtaaagcattgacacactccacccggccttcatcctcatttacatcaagattcaacaataccgcctctagagggtcctccatatttatcattacactagtattatcaactatcactaccatgacaagatccacaaaagagcacacttcagaactgttgggctgtttcattgacttgcacacataaaagaccattttctcatcacccacccggaaggtgagtttcccttcttccacatcaattaaggcctttccagtagaaaggaaaggtcttcccagtatgatcataacctcataatttacctcataatccaagatcacaaaatcagctgacaagataaatttatccacccggacaagaacatcattaattatacccaatggtctcttcattgttctatccgccatttgcaatcttatggaagtcggcctcaattgcctaatacccaaagtcttgaaaactaagtagggcatcaagttgatacttgtgcccaaattacatagagcttttgcaaagtctgcactcccaatggtgcaaggaatggtgaaagcaccgggatcttctagctttggatccattgagtgtactattgcactaacttggtgggtcatcttgatagtctcacaatccatggatcttttctttgtcaccaagtctttcatgaatttagcataacccagcatttgctttagagcctccaccaaaggtacattgatggaaaagctcttcatcatgtcaataaacatcttaaattggttctcatatttctgcttcgcaagcttttgaggataaggtggaggtggccttggcaaatgagccttggatttaggcacaaccgtttctggcatgtctattacgtgttccctaaacggggttcacgtcattctgagtttccacctcggcatcttggatatcaatcctcacttcctcattaacattcttatcaatcactttttcaaccaccaaagggatctcatcctcttgcaactcaacttcatcactcaaaacttcattttatttggaggcattcacatcaccgcctcgtccacttcatgtagttaccgccattacattcccagaattgttcccacccttcgggttgactaccgtatcactaggtagagcccccttagggcaagtatttaaggattgtgagatttggcctaattaaacctccaagtttctgattgaagtattgtggttgccaacatggcattagagtcagcattctttttcatcatttgttcaaacatgattttgattctccctatttcattgttagaagaactaggaccttggtatggaactgggggtggatgttttggttggtgatacatcgggggactttgaaagccttgtccccgatattcttggttgtaattgttccaaccgccctgattgttgtttccaccccagttgttgttgttgccattccaattaccctgattgttttgattattgatctgattgccccaatttgcattttggttgttgttcccccaattacttttcccttgttgctgatttccccaattgccttggggtctccattgttgtttgttggaagaatttcccctttggccttgatagttgttcacatattgcacttctttattatgctcatcataactattatcttggaatccaccactatcattgtcatattgatccgaactcccttggttctgttgacctctttgtcttcttttgttcactatcatgttgacaccctccatagcatttacctgtcgtaaattttgaacctgctgtaactgtgcctttgctagccggttcattgttattgccaactctggttttgccttcccatgatcatggagctcttttgtcatgacccaaactgaagggccatgactagcacccgaccacacttgccgagcaccaacgtacatttcatctaaccttcattattatcttttaaggctgacgagatcaatataaatggtagacctagatcatggacaaccagcaataaaatatgatggcatgcatataaatagcaggggatgaccagacaatcaagaaactacatataaggtatgagctaccacgctactatgaaagactatacaacaaaaactagccgacaaggcataccaaactatacatgagccgacacctgtctatgagcctctaaaagaacataagtgttgcaacatagccggaacagggccccgacatacccataatgtctataacaaaaattgcataccaagaccaaggcaagtccggagaagggatctcgccaatcaccgctgaactagatagtctactgtggtgggggagctgtacctgcctgtctatcaggacctgcagcacgacatgcagcgtccacaaataaaaggacgtcagtacgaataaagtactgagtatgtaaggcaaggaaccataaatgcgatcagtaatgtaagcaaggatagagaatatacaacccgtaacatcttagtacctctgagggctacttacatgaaatgcatgatacatatgtataaatacataaacctttaaagcattcgcctctgtgggcatcatcatcatcatatcgtacccggccataataggctcggtagaatcgtacccggccacgtggagctcggtaaaacccaactgatcagtggttgcacaataggtgccgtacccggccaactatagcgtggctcggtagagtaaaatagatacatatatataatgcatgctcgactcatagaatcacattctaaaccttttggagtgacgtaaggtcggtatcctctgtacacgttattaggactaactcttcactatgaaccttataagaatcaggaagtaccaataacattgataacataagaataagagaagcaacattagcatcaatcgttccataagagggaaaacaatgtaagtactgctagcttctaagagtagagtatctttgaaagctcgttcattacattatgtacaatcggagtcgtgcaaaagaaggaaagggatagtctcacataccttgtatatacttccccaatctcaagctatgcaattgtcaaaactccttagtctacaataagagaaacgatactatcgttatcatttaagcgtcataactattatgtatcgaccacaacctattttacgatgaaacggacagcacctcccctatatatatgacctcacaccattcaaaacaatcaccaaacagcccaaacatcatcaataataaacatattgagcctcccgaaatagtccacacacaacctaatcactccatacatacgacgaccaccgtagttgtgtcaaacaacctggaaatgttacgaataactatcagcccataaccctacataatatatggtgtttcttcacacccttcctcctccaaaactccacaagatagtagtaaaataagcagcccaacaacaacgcaaaacagtccacaaaacaataacattactaccaagcctttcggtatatatctcacaagttctagcttcaatggcttagccgcaacttggataatcttaaatacatatagagtaagaggttccttacctttatacagaaagaacaactccaatttgacctaatttccatgaaatatccctccaatgctgccacaacaacaacaaagcgaaactagcgatcaattagtgtttttcggcactagaatcactttagaaggcttgaaatcacctaggattgatattaagaacatgaggaagtatttacagaacataaaccctttaaaacaacctcccacacgagttggaacgacacaaaaatgagcaacaacaagaagaacaagagacttactagcgccacggaattcccgacacttgatttgtgttgtttgcccttttttgggtcttgaatcttgagagaaccttgagaggatgttcctagggttctaaggtctgaaaatagtgaaaataaatgacttaaaacgggttttagtcatcctatataggtccaaatatcttaaaccgacttagtgggccccatagagaggtgcttggcgcagtctcgcgaaaacgcgaatatctctctactccgagatcgtatcgatgaacggtttaatgcgttggaaactagactcatagatctttaatttagtgggtagataacccagtaattccttgtaaatgttgagaaaagattagaaacatttgacctaatgtttaagtaaaattatgaacctaagttgcgacaacttttgtcgacttttgtttcataactcgtttgacttcaagacttatgatacggatattatatgattaaaataccttcataaatgacctcttgagtgtattaagcaccgctagattacctgaaaatacaagttacaacatccttgattcttttaacttctaatactggttaatcacccttatacactcttgtatcacttaagaccaataggattgacttcttatcatctcaaagataattccttcttggatttatgttaactaatatatgtcatgaactaacacatgtggatatgggttgtaacaccctccccccttaggaacattcgtcctcgaatgtaagggtttatggggagtttaaatcatcgtggattccaatggaaatttccgatcaattttcccctataaaatggtcactagcaaaactttcaagtaattaagcccaacatatggtttcacaagtctacacaaagcattatgcgtatttacattatctacatatcatcattttgtattaaggaggagtattctcaaattattgcttacctcatagagccgtttcttcttccaatgtatcctgtcttccaccagcatccttgttatcttcattctggaataagtaagggtattttgacttcatctccttttctgcttcccatgtcatttcttccatatttttgttcctccacaatactttgacggaagctacatcttttgttctcagcttgcggacttgccgatctaatatcgccactggcacttcttcatatgataggtcctctgtaacttgtacatctttgatagagacgactcgagaagggtctccaatacattttctcaacatagatacatggaataccgggtggacaaattccaattcggatggcaattctaactcataagcaacctgtccaatccgtcgaagaattttatacggcccgatataccttggactcagcttacctttcttcccaaaacgcataatacccttcattggtgagatcctcaggaaaacccaatcaccaacctcaaactctagatcacgacgccggacatcagaataagatttttgcctgctttgtgccgtcctcaatcgctcctgtatcactttcaccttctcaatagcttggtgaatcaaatctggcccatataattctgtttcaccgacttcgaaccatccaactggtgatctacatctcctcccgtatagtgcctcgtatggggccattttaatactggaatggtagctattgttataggcgaattctatgagtggaagatgatcatcccaattccccttaaaatctagaacacatgctcgtagcatatcttccagtgtctgaatggtacgttcagcctgtccgtcagtctgcagatgaaatgcagtgctgagatttacctgtgtgcctaaacccttctggaaagacctccaaaagttagccgtaaattgagctcttcggtctgatataatagatatgggcacaccatgaagcctaacaatctccttgatatacaactttgcataatcttcagccgtgtaagttgtcttcactggcagaaaatgggcacattttgtaagtcgatcaataatcacccagatggagtcaaacttatgataagagcgaggtaatccaataatgaagtccatattaatcacctcccacttccaggtcggaatctctatattttgaagcaatccactgggtttctggtgttctatctttacttgttgacaattgggacactgggctacaaattctgcaatagacttcttcatattatcccaccaatactgctccttgacatcatgatacatctttgtcgagccgggatggatggaatatcgggattgatgaatctcattcataatcttctctcgcaaccctgccacattaggcacacacaatcggctctggtatctcagtgccccatcttttccgatcccaaaagccatacttttacactgttgaatgctttctcttaatcgtactaagataggatcttcatattgtcgtgcttttacctcggctaccaaagatgattctgatgtattctgtacagtaacacctccgtcatcagagtctaacaatctgattctcatattggctagctgatgaagctctttaatcaacccccatctacccgcctcaatatgtactaagcttcccattgatttatggctgagagcatctgccacaacattggctttaccgggatgatacaatatctcgacgtcgtagtctttcaataattcaagccacctacgctgcctcaaattcaactctttctgcttgaagatgtattgtaaactcttgtgatctgtgtagatgtcaacatggacgccgtataagtagtgccgccatatcttcaaaacatatattactgcagccaattccaaatcatgggttggataattcttttcatgcttcttcaatagtcttgatgcataagcaatcacattcccacgctgcatcaatacgcaccccaaacctatacctgaggcatcacaatataccacataaccttttgttccttcaggaagagtgagcactggtgcagatgtcaatcgattcttcaactcctgaaaactaagttcacaagtgtcagaccactggaatttggtagctttttgtgttaacttagtcaatggtgatgatatagaggaaaatccttctacaaaccgcctataatatcctgctagccctaggaagctacggacttctgatggtgttgtaggtctcggccaattctttactgcatcgatcttctgagtgtcgacactaataccctcatcagatatcacatggccaaggaatgctactgagttcagccagaattcacatttggagagcttagcatataatttacgatcctgaagcgtctgtaatactatccgcaagtggcccgcatgttccacctccgaacgagaatacactagaatttcatcaatgaatacaatcacgaacacatcaagatagggcctgaatatagtattcataagatccataaaagctgctggggcatttgttagcccgaacgacatcaccaagaactcaaagtgcccatatcttgtcctgaaggccgtctttggaatatccttctccctaaccctcacctgatgataccctgaacgtaaatcaatcttagagaaatacttggcaccctggagttggtcaaacaagtcatcaattcttggaagtggatacttgttctttatagtagacttattcaactgtcgatagtcgatacacatccgtaacgacccgtctttcttccgcacgaataggactggtacaccccaaggtgaagtgctaggcctaataaagcccttatccagcaagtccttcaactgcaccttcaactctcgcaactctgccggggccattctgtatggaggaatagagatcggttgagtgtcaggtaacacatcaatgctaaactcaatctccctttcaggaggaaggcctgggagttcatctgggaaaacatctgggaattcgttgaccatagggattgattgtaaagtaggtggttttgcctccacatccctaacgtgaacgagatgataaatgtaaccttttgagatcattttccttgccttaagataggaaataaacctacctttcggtgtagcaatgttccctttccattcaatgacgggttcacccggaaattggaacctaaccatcttcgtacggcagtcaacatttgcatagcatgaggccaaccagtccattcccattatcacatcaaaatcaaccatttctaactcaaataaatttgccgaggtttgacgactacaaatcatcacagtgcaacctctatatacccttctagcaatcacagaatctcctatcggagtagataccacgagaggtttacttatcaattcaggttcaatgccaaacttattagacacaaagggtgtaacataggataatgtagatcccggatcaatcaacgcatatacatcataagaaaacacagatataatacctgtaacaacatctggagacgactcgagatcctgtcgacctactagagcataggttcgattttgagcaccactcgaactcggcactgcacctctacccctaccacgacctgtcgactgctgaaaaccccgtgctggaggtcgaactgatgaggaagaaccagacacagatccagtcggttgagccataccatcacctcctctattaggacaatcccgcatcatatggccaggctgcccgcgcgaatagtatgcatcataacctcgacgacacagtccaaagtgggccttgccgcactgatcacaatgtggtgttgggggtctcatctgactagtatccctgggatgttgcgatccagatgcccgcgaactctgacctggaccagaataggatcgatcatatcgaggcctctgaaactgtggaggagcactagctacaggtggcgccgaactcctcgaaaactgtggcctgatgcggcctctgaagtcatcagaataccctgcaaatctcgccctcttatgctggcctctatcctgctccctaactgccctctgctggcgcttacgatcctctagggtctgggcataagcttgaatacgggaaatatccatgccctccaccaaggaggctgtcgtacactcatttatcagatgtggtcccaacccattcacgaacatatgcaccctatcactcatctcggccactatatggggagcataccttgccaaagaatcaaactgcatactgtactctcgcacactcatattaccttgtctaaggttcaagaacttatcagctctagctcgtcgtatctcaactggcaagtagtgacgaagaaaggcctcagaaaattccttccacacagctggaggagggttcggacccctggatctctcccaactatcataccagagaaccgctaaatcccgtaaccgataagaagccaactctactgcctctgtatcactaacatgcataacccgaagtgtacgatgaacctggtcaataaaagtctgtgggtcctccttggggtctgatccggtaaacactggagggtctaaattaataaaatcacgaactcttgtactaactggtttctcagcaacacctgtattctgcctctgagcctgagcagctaccaagctagtcaataactgcaaagcactctgcatatcctggtctggagtgccagacggaggaactggaggcgctgggtgccttctactatcctttggaggagatggagtagatgaggtatgagagggcatctcactttgagcctcactttgtcatgctctgacttggggcacctgactggtaccctctcccactgctgtatcaagccgtctactaatcgtttgcttcctagtcgaaggcatcactaaaaaaacaaggtgaatattagagacgaacacttacgactcaactctacgcacgatctagattcaggaagaaggtaacaaccctagatgtcatgtagcctcctgattataaatgtggcgcgctacacatccataatcaagactctacaagacacggctcatatacaacccctaggacagacttgctctgataccaagtttgtcacgacccaaactgaagggccatgactagaacccgaccacacttgccgagcaccaacgtacatttcatctaaccttcattattatcttttaaggctgacgagatcaatataaatggtagacctagatcatggacaaccagcaataaaatatgatggcatgcatatacatagcaggggatgaccagacaatcaagaaactacatataaggtatgagctaccacgctactatgaaagactatacaacaaaaactagccgacaaggcataccaaactatacatgagccgacacctgtctatgagcctctaaaagaacataagtgttgcaacatagccggaacagggccccgacatacccataatgtctataacaaaaattgcataccaagaccaaggcaagtccggagaagggatctcgccaatcaccgctgaactagatagtctactgtggtgggggagctgtacctgcctgtctatcaggacctgcagcacgacatgcagcgtccacaaataaaaggatgtcagtacgaataaagtactgagtatgtaaggcaaggaaccataaatgcgatcagtaatgtaagcaaggatagagaatatacaacccgtaacatcttagtacctctgagggctacttacatgaaatgcatgatacatatgtataaatacataaacctttaaagcattcgcctctgtgggcatcatcatcatcatatcgtacccggccataataggctcggtagaatcgtacccggccacgtggagctcggtaaaacccaactgatcagtggttgcacaataggtgctgtacctggccaactatagcgtggctcggtagagtaaaatagatacatatataatgcatgctcgactcatggaatcacattctaaaccttttggagtgacgtaaggtcggtatcctctgtacacgttattaggactaactcttcactatgaaccttataagaatcaggaagtacaaataacattgataacataagaataagagaagcaacattagcatcaatcgttccataagagggaaaacaatgtaagtactgctagcttataagagtagagtatctttggaagctcgttcattacattatgtacaatcggagtcgtgcaaaagaaggaaagggatagtctcacataccttgtatatacttccccaatctcaagctatgtaattttcaaaactccttagtctacaataagagaaacgatactatcgttatcatttaagcgtcataactattatgtatcgaccacaacctattttacgatgaaacggacagcacctcccctatatatatgacctcacaccattcaaaacaatcaccaaacagcccaaacatcatcaataataaacatattgagcctcccgaaatagtccacacacaacctaatcactccatacatacgacgaccaccgtagtcgtgtcaaacaacctggaaatgttacgaataactatcagcccataaccctacataatatatggtgtttctccacacccttcctcctccaaaactccacaagatagtagtaaaataagcagcccaacaacaacgcaaaacagtccacaaaacaataacattactaccaagcctttcggtatatatctcacaagttctagcttcaatggcttagccgcaacttggataatcttaaatacatatagagtaagaggttccttacctttatacagaaataataactccaatttgacctaatttccatgaaatatccctccaatgctgccacaacaacaacaaagcgaaactagcgatcaattagtatttttcggcactagaatcactttagaaggcttgaaatcacctaggattgatattaagaacatgaggaagtatttacagaacataaaccctttaaaacaacctcccacacgagttggaacgacacaaaaatgagcaacaacaagaagaacaagagacttactagcgccacggaattcccgacacttgatttgtgttgtttgccctttttttgggtcttgaatcttgagagaaccttgagaggatgttcctagggttctaagttctgaaaatagtgaaaataaatgacttaaaacgggttgtagtcatcctatataggtccaaatatcttaaaccgacttagtgggccccatagagaggtgcttggcgcagtctcgcgaaaacgcgaatatctctctactccgagatcgtatcgatgaacggtttaatgcgttggaaactagactcatagatctttaatttggtgggtagatcaccccgtaattccttgtaaattttgagaaaagattagaaacatttgacctaatgtttaagtaaaattatgaacctaagttgcgacaacttttgtcgacttttgtttcataactcgtttgacttcaagacttatgatacggatattatatgattaaaataccttcataaatgacctcttgagtgtattaagcaccgctagattacctgaaaatacaagttacaacatccttgattcgtttaacttctaatactggttaatcactcttatacactcttgtatcacttaagaccaataggattgacttcttatcatctcaaagataattccttcttagatttatgttaactaatatatgtcatgaactaacacatgtggatatgggttgtaacatctttgtgcaagtgaatgaccgtggggtcaccctgtggcacattggctctactttgccaagcgaaggacgtgtcagccatctcatcaagaatatcacaagcctcatcataaggcaacttcatgaaattaccccctgctaactggtttaccacacactgattggtcatgtttataccccgataagatgtctgttgaatcactgccttagtcatatcattgttggggcattccttgaccatagttctatatcgatcccagattgcatgaaggggctcatttggttcctgtttgaaagataagatttcatccatcaaagctgccatatgtcccagtgagaaaaacttggctatgaacttatcggccaactcatcccatgtagtgatagaatggttgggaagcctctcgagccagtccaaagctttccctctaagtgaaaaagggaataatctcaaccgaagcgcattatctgacagatttgttttcttgcttccccaacacgtatccacaaaacccttgagatgtttatatacattctgatgggaagcacctatgaaataccattgttgcaccaacaaagtcagcatcacatttgtaatttggaaattgcccacccaaatccgggttgggacaattgcactagcatatcctttgtttggaaacacccgaggagccactcttggaggtggcgggggagggtcgggaacattgtcattttgtggtgtcctcttcttagagcttgaggtactatagaaacctcatcatcaatattatcatctacctcctcccctggtggaaggtctccaagaggtgcattgtttgccgccattttgtacctaagtttgtgacatacacaaattagtaacacagaaggaaagataaacaatacacaaaactatttagatagatagcaaaaaccgttagctccccggcagcggcgccaaaatgtgatcgggtccaaccatacaccactacaaagtggcaagagcgattgatactgtcacgccccgaacttcggcctggacgtaacacaacactcggtgcctaactacctgtgactgagcaaccaactggctggctgaatcaacatgtaatatcataacatactaaatgaagaagataaactaacacatgcagatatactgaaagtctgaatgataaaagtcaaagtgtggaaacatacaagtctaaaacatgtatgtatccaacattgcttaacacaaaaagcttgtgactttgtataattgatactctagtctatgaagcttctaatgaagtactgaaaacattgactatctgaaaatactgaaaactataagataattataattccccgaaagtactgaggatcaccaaacaggtgatacgagagtcctagtgctttaaatcattaacctgtaaatcattacctacattgtaagatggaggccccgggcaaaagggacgtcactacatttgaattgcactggtatgtaaagcaactaaaagaaagaattataaatgctaaaactgaaactaagctgataacagagatttgataattgataactgaaatgataactattgaaactgaaacggaaatgataactgataactaaactgataattgaacagaacaaaggaagtaaggatatgaatactccctcttctgaatgatgaacaacttgtttatctgaataagctatagcctcgggcccaatatatatatgcataagctacggcctcaagcccaagtatacatatacgtaactacggcctcaggcccaaaatgcataaagcataaactacagcctcaggcccaaatacatgtgttcaacattcagggatttaaaatcaggaactgagaatcatactgcaatacatgagagtgaaatactgaatcacattgagttacatgatactggaatattggatcacactaagttacataatactggaatactgaataggactaggctgagacatgtattcttgaactgattatgaacactgaaacttcaactgtttatgacatactgagtaatctatactaagactcgggggcatcaaacccaagtctatattgaatacgcactgagcttgcaacgttcagaatgaaagtcatgaatgagttatgaagctaaagaatagaagttctacaacaattcaaggaactatgctaaactatatttctgaggcaattagtaacgtggtaaaagaaatatagtgtagggagaatcattaacattcccaaacatagagagttagcctcacatacctcaatttatccccttagtgatactacaatgatccacaacactaagaaccttcaatctataatagaacatccaatggaaccaatattagtaacaaattccataatttaagccatttaggcatattatcaaacaccttgtaggcataaatctctacatctcatcaccataaagttagttcatctaattaccaccattcatcgataatttatcccatcatcatgattaaccaatttataacttccaacatcacatatatgaccatccatccacatccaaccaataaaattccaacaaatattcatctttcaatctctactatagttatgtaattaaattgggaacttatggcttccaatcaccataacaagagttctattacttattcatacacatatttccttaataaatccatacatgtaagtcaaagggtgtaggattacttttttataagaaatcgtgtaaaaccctcctttgagtttttgaagaaatttcttgaagatctaagtattttatgtgtacatttcatcaatactagtgtagaaatgatagaattcacaccaagataatgggtattgcttaccttgaagatgggaggggttggaggccttgagagagtagaggaaaatcctaaacgtcgtccaaaagaaatgggggaaaatgaatcctgaaattgtgtttttaagcccagatttcggacgcgaaagtggatgctttgcatccgagtagtcctccgctcaggagctcggatgctacgtggatactatggcagcacttcactgccagcccctctttttggacgcagcctcggatgtttcgcatccacatagtcctccgccagcctttggtaatttgatcataacattttgtaggaaagtccaaattacaaacggtttgatgatttagaaaatagactcgaagatctttcatttgataggttttacatcacataaaaccttacatatgtgtagttatgctcatctaaagtgtggtcttgtacttacccatttggaattttaggctttcatgtagttttcaaacttggcttagacttaggtctctctttggacgccaaatcacttatgatatacctcatacacttattatcatatacaattgataaccgttatataaatagttcttgtccgcacacatctgattcatatttacggagtgttacattacccatactcatcctgatagggcttcacatgtctaaaagatcacattaatactcatctaacacatccacaactaatccggatttaaggggtgttacattatctcccccttgggattatttgtcctcgaatgattattttggttgtatcttaggctaacttcggaccttaaattggtttgtgggaacatgaactttcattaacacttccataataaactgaatgaatacacgattactgaactgatgagatactaaactggataggtactagagtgaatggctactaaattggctaaacactaaaagacatggagattgtattataaggtctgaatgagaaggttagatactttcgacatttctcccaaatacctaccagctaacagagcataacactagctccatagagcataataatacgcataacatgatacatatacatgaatacttatttgtcataggtacgtgaattctgaactaacctggatatataaaaactgaactggcacgaattatcgaggattgaactaacgtgaatatctgctcactgaactcacatcaatacctgagtattaagctgtcataaatatctgagtactggactggcatgagtatctgagtactaaactgacttgaatgttctaacatgagatctgaatactaaaaacataaatttcatgacatgagatttgaaaactggaaacaccaatgtcatgacatgagatttgaaaactggaaacaccaatatcgtgacatgagatttgaatactggaaacttgaatattataacataacacatgaaatactggtgcacaaccgctaattattgtggaaattctaactcataagctacttacccaatcctttataggatcctatatgagctgatgtatctgggattgagctttcctttcttcccaaatcttataacacctttcataagtgaaactttttgaaatacccaatcatcaacttgaaactctaggtctctatgttgcatgttcaaataggaattttggcaactctaagctgtctacaaatgatcttgaatcaacttgactttctccatagaccgattgaccaaatctggtcccaacaactccacttcgccaacttcgaaccaactaattggcaatctacaccttcgcccataaaaatcatgctttcaaaatgagcgagataatcctattatcaggtccatatttaccatctccactaaaggatgtgtgtgttctgagataaacacttggttttctgctgttcgactttcacttactgacaattcagacacttgtccacaaagtctgcaagtctcttttcatgtcgttccaccactaaatctccttaagatcatgatacatctttgggaaacttaggtggatagaatactcgaaattatgggcttataatatcttcctccctcacttagtccatctatggttggaacacacaatctatcctggtacctcaaagtacaatcatctcccccttgttcaaaagccattatcttatgcatgtgaatccctatttcagctacaacaagtagggatcatcaaactgtttctccttcactttggctactaaggaggaacaggtcgtgttctagacaacaactccactatctttggtgtccaaaagtcgaactcctaccttggctaagcagtgaacttctttcaacatagttctcttgtctacctaattcatgagctatacttcccacacttgattatcttcttaagcacttcttaaaaacacttatagtattattgtgaactagtctttgacatgtactctaaatttttgagtcccgtgcaatgacactaccctcataaataggcatgactttatagcttttctgtgattactttatcatcaataactaagctcggtgatcattctactcactttgtattttttttacacatgttagacatcttgtggtaattatacaatttttcctcattaccgatctgatttcctttttcatatccatgctaactctttgggtttcaaatcgctaactggactaactaatatttttcacttcaccctttagaccaaaggtcttatacatgcggatccttctatatttgttaggatcctaataaccttccttattttctgcaattctttgcactctacatcaatgacgactcatctcccaacttacttctgagctaggaaaaactaaattattcacataatggaaagctgatgttttcacacatatcatacacaatttaagccatttaggcatattatcaaacaccttgtaggcataaatctttacatctcatcaccatatagttagttcatctaattaccaccattcattaacaatttatcccatcatcatgattaaccaatttataacttccaacatcacacatatgaccatccatccacacccaaccaataaaattccaacaaatattcatctttcaatctctattatagttatgtaattaaattgggaacttatggcttccaatcaccataacaagagttctattacttatttatactcatattcccttaataaatccatatatataagtctaagggtgtaggattaccttttttggaagaaatcttgtaaaactctcctttgagttcttaaaaaaatttcttgaagatctaagtattttatgtgtagatttcatcaatactagtgtagaaatgatgaaattcacacaaagataatgggtatttcttaccttgaatatgggaggggttggaggtcttgagagagtggaggaaaaccctaaaagtcgtccaaaagaaatgggggaaaatgaatcccgaaattgtgtttataagcccatatttcagacgcgaacgtggatgcttcgcatccgagtagtcctccgctcaagagctcggatgcgacgcggatgctatggcagcacttcactaccatcccctcttttcggatgcagcctcggatgcttcgcatctgcgcagtcctccgccagcctttggtaatttggtcataacttcttgtaggaaagtctaattgatgaacgatttgaagatttagaaactgcactcgaagatatttcatttgataggtttttcataacataacaccttatatatttgtagttattctcatccaaaatgtggtcttgtgcttacccatttgaaattttaatctttcatgtagttttcaaacttggcttagacttaggtctctccttggaccccaaatcacttatgatataccccgtacacttattatcatatacaattgataaccatcatataattagtcctcgtccgcacacagctgaatcatatttacggagtgttacattacccatactcatcctgatagggcttcgcatgtctaaaagatcacattaatactcatataacacatccacaactaatccagatttacgaggtgttatagatactgcttttacctaagatggtcgggatcgaatccatagggggctagatttattgggaattggattcctatctaaactagaaatgcatagtgcccttaattacacttccaatcataattgttgtttattacttctaattttatactattgagatgctaaattaaacttagagtaattgcttgtaaggttttctaaatagttaaagaggcactagggaagtgactttctcctaggtgaatacttgacgggatctaaagcctaaggcaaagttgttatgttggggattgtgatatagccaatgcactgaactactcactctatacctctcggtagcatgagtgactttacctaattgactttctcaagactaattgggtgacaaaattgtgcaagcaatataggctcaagtcgggtattactatttttatgtttaaccctttaattggggctatcaatctcttgattacacccaattccttgttggactgattttcctagactcaagctctctttctcaagaagaacccaagtcaaataggcacaaattagtatttgcaaccaccaattcaacacggaaaacacaaatcagtccaaatatcaactgcccatacacatctaagccttagaacaatagacccatcaaatacccacactagggttgagccacaaccctagctaatggatctagctactcataataatggaataaaacagataaatagatgaaaaataacctatataatttgattacaaactaagaaattgaagatacaatattaaactagctacaaatgactcaaaatggaacaaaatcgtcgttcacatgctctggattctaactgacaccctaaaaatgtgaaagaaagtatttacactaggccgaattttctggacaaaaatacccctgatggaggtattgcggaccgcggaaaatgcaccgcggccgcgataaggctttttagctaaaatgctcagtatctgaatatggccaccgcggactgcataaaatgcactgcagctgcagtggattcactgcggtccgcacaaaatagaccacggaccgcattggcttctaatcttcaaactctcaactctctgaatcccttatctgcggatcacataaaatggattgcagccgtgaagaggcttatgcgaccgtgagaaatcctccacggacggcattgctttaagctccaaaagtgcccctttctgaactcatccactgcggaccgcactaaatggtctgcggccgcggggagtcctttatggatgcagtagattttatgctgcaatagtgccttgacttgttcttggtacttgtgcaggtttcactcctttttgagctggttttgactacttgtcacttttttgaccaaacactgcaaacaagtacaacatgtaagtctttgggatatttgtatacatttttaatcaaaaactcaagtaaaaagaagtgtaaaatgaactagaatccctagttatcagttctcaatcccaaaatccttctaacaaatctgaatttcaactatgaaagagtactacaaaaaaaacctaaacgtacttatgagattgaagattacattttcttagtatctcccacggatatggatgagccaaagcctgtgaataaggctttatttagctctggaaaagatgagtgtatgaaagcaatgaaagaagaagtagagtccatgaaaaccaataaagtctgggatctagttaagcttccgcttaggcatagagccattttgaacaaatgggttctcaaagttaaatgcaaagcggatgggtcaatagaaagatataaggcacggttggtagcaaaaggctttactcaagaagatagaatagattatgaggaaacatttcaccagctgtgaagtttacctcaatttgcttacttttggctattgttgcacgtttggatttggaattacatcaaatggatgtgaagacatcttatctcaatggagaactaaacgaagaaatctacatggaaaacttgtaggctttatcgttaaaggccaagaaaagaaggtctgtaaattgaaaagatctatttatggcctgaagcaaccttcaaggcaatggtatttgagatttctcatggagatgatctcgtataatttcaccatgatcaatgaagatcattgcatttatgtgaagaagtccaataggctatttgtaattcttttacgtggacgatatattactggccgaaaacaatttggagtatttgaaaactatcaagtcagggctttcaaagtcttttgacatgaaagatatgggcgaggtaggctatatccttggagttaagatccaaagagaccattctaaaaagttattgagtctatcttaagaaacttatataaataaaatcttggagcattttcgcatgaatagttgcaaatccatggatactcctatagcgagaggtgaaactttaaaccttgaaatgtgtcccaagactgaaaatgaaaaggaagacatgtcttgagttccatattcaagtgttgtcgggagcttgatgtactctatgatgtgtactcgcccagacatttgttatatcataggtctggttagtaggtatcaatccaatcctggaagagatcattggaaagctgtgaagagagttttcagatgcctgaagggaactgcagattattcactatgttattatggaaataatttatacttgagaggatatacagatgctgattgggctggtgatcgaaatgatagaaaatcaacatccggttttgccttcttacttaatggtggtgctatatcatggaaaagtaagaaacaaacctgcacagccctttcaacaatggaagctgagttcgtggcttgtgcgtctgcagtataagaagttgtttggttgaagagattctttgagcatttaaatattacaaagaactctcaggttcccatggctctatattgtgatagtcaagcagctattgcatatacaaaagatcctaagtatcatagcaagatcaaacacattgacatcaagtataactttgtgagagacatggtagcaagtggatggataaattaacagtacatttctacgcaaatcatgatagctaatccttttacaaaggcaatatctagttgggaaatatgttatgactctaggtttgcgaaggatataaatatatttatgtattttaaaatgactttttttattataatatactcatcaatatttgactcttgactttatgcttatatcttgtatgcatgtgatgatgttttgttgataaagtgcgttgaacaagttgcgagattgtctctctcacactagcaatcacctcttacgttaagaatcgtgaagatacgagaccttatagaaccttggataatacgaggttatatttacttgtaaaggtcagtcttgacaactagtcaaacttatgaattttaccattcgcgtatgacttgttttgtatgtcagatgccagtttctcaaaaaggttgtatttgaggattattaaagtgagaaactcagattagatatttgaaggtgtctagaccaagatctgtacggtgttgaatgattaatagaataagtcacacgcactaatacatgatgagaacaccgtaacacctgtttcataccacgtgtgttaacgccactgggatgatgaaagaatgaatccatgcttcttcattgtgtgagatgccaaagaagttatattaacttttattggaataccctttgaccttttattgtctcttgaagtgccaatcaatgttgctacgttagcatgtcactaatagtcatgaatgattcggcaatgcagtgcatgtctaggaaaacaattgatttggaatagaaagattagagtagaaagggaaggcaactaaaaaaatgtagtaaattaacttgtatgaatatgttgaccattacacttaccatgagggtatcaaatgtaattatgaatacaaagtgaaacatgaactcgagttcacctgtttcaaggatgagggatcaaataactaactatttgagtagcaggtgatgtctggggtatagcgagtaataagatccccatgttagtagtgattcctttccgaatgtgatcgaatgtctacatagagtttagaataaccttaataagtttgaaatatattatagctcttgatgctcgcaggttgcacaaactacttgtctgtatgaattaagtgtattatttattcatgatactggtttgagtctagcccatcacgagtgaagtgggagatattggatttcttggttttgggtcgctccatgtgggctgacccaacctatgtaaaagagataagggagttatctataaagaagttactgcacaataaaaggggagaaaaatatagaaaagtggaaagttggttttttagaagaaaatcgtatcttttcttttttaaaaggaaaagtttgcatacgctttcaaatacaactccaagagacagaaaaacttcctcttgaattctccaataaacacacacaaaatctagaatatttagttcgtggataaaactccatttccaagagattcagagtacgacttggggctattattttggtggtgagttcaataactcttcagctgcatcattgacatgtacgctattattgctctctccccgggaattattctaacaatgtatgagaaaaatctgtgttttttgaagcttgttctctatccaaaaattataaatgaagagctaagtttttttaggaaaaaattacgtataacaaataatgaaatttgttattcttttcaattagacaagtcaatttgaaaattttatgtaacaaattgtaactagtcacatgtaacaaaatattaataggcaaataaccagttatatgtgttggatattggatttgggtcgcgggtcgcccatatggactgaccctacccatttaaaggagataaaacctacataggttgcctaaggaggttaaaataaagataaattaaaataaaaaactgttgcacgttagagatagaaggggaacgtgggattgaatatgagcgggcagttttttcctctcttgaaatcctctctctcctttatatatatatatatcttcttcaatagagaaagatagaagtcctgaagtaattctccctcaagaaaacacactctgaaaaaggtatttagatagtgaacaataactttgtttcctgaaaattcagaatacgatttggggaaattcctttggtggtgagttcaacagcttccgttgcgtcaataaggtacacaacttgttgttctcgccccgcgattattaatcaacaatggaatcaaagcctggtagtttgatcctaattgctgccaccatgattgtcacgaccccggttcgccctccgtgaaccatcgtgacggtacctagtctctacgactaggtaagcctaaaatgtggaagataaaccaaatttgcgaaagaaaacaatttataataggaatagagtaataaaacaacgtttacaagtgtcactcggcatacacaatattaactcttaaaacccatacatttttttccaaaatccgaaaacccatgaatcacaagctacgaatataataaaaatgctctaactccggaatgtctacatcaatggaagaaaatagaagggctatcactacaagatagaatggaaaggtactcctcagtttgcggacgcatcagatatacctcgaaatctttggagcagtcgcctcgcctcaagggtgataggactgagtcaaagtacctggatctagacatgaaaaatatgcgcagaaaaggcatgagtacaccatagtggtactcagtaagtgccaaccctaacctcggtcgagtagtgacgaggaaggtcttggccctactgaagttaaataaaataaaaatttcgatagtgtagaatagaacagtataaataggtaaagcagtaaaagtaacacaagataaaaaggcacaacaactattacagagtcaaggtaaacacagaaagaaatatggctcggcaccaaaataacaatcggggatctcccaggataccgtcctgtagtcccaaatatacatatccaatggatctctcgggatctcgtcccgtagtccaactcatagtgcgcggggaatctaccgcaattccattccgtagtcccaaatataaatacccagtaccgggggactctactgggtgcagtcccgtagttccatataactgtgcagggggatctaccggaatctcacatctatagtcccaaataaacagacaagggggatctaccggaatcctacatccgtagtcccaatgtaaatacatagcaacaacaggaaaatattcagcaaatgtcaattccatattaaggcaaacaagtaattctagtctagcatgctgcacagaattcaggtagagcagcttgagcaaataaagcaatcaaatcacttagacattctttcctacactaacaacaagcttatagtacaagtaatataaacaaggaaggaaatacactagtaattatttaatgaaaatcggattttaaacaattagcacaagtacgcactcgtcacctcacgtacaaggcatttcaattaacaataatactaaatcctaaggggaaggtcccctacacaaggttaggcaagccacttacctcgaaccggctcaaaatcaactcgaaaccacgttctttccatgagtactcgactccaaatggcccaaatctattcaatccaattgtataatgtaaataacacttcatgtaactgattctacaattaaattctaagctaatacacgaaattaggtaacatgaccaaaatgcccctcgggcccacatcttagaatcgggtaacatttatattttcagaattctcatactctcacgagttcatgcataccaaaattatccaaattcccaatcaaaattcgaattctaggtctaagaactttcttccaacttttccccaattttcatctgcaatccaaaattaaatgatgaaactaagtataaattaatggaatataactagatagggttaaagagtttttacccaatgctttactcttcaatttcctcccaaaattgccctctcccgagctccactttgatttttccaagttttgaaccaaaccctcgaaatttcatatttctgcccagcgattactgcatctgcggtcaagggagcgcacatgcagtcccgcacctatggaagaatgcatcgcaggtgcaaaaagtcacttaacgggctgggtccgcaactacggtcgcttggccgcatctgcagtatctctgcaaaaacctagccgcacttgtggatcctagagcttggtccaaatctcgctcctgtggcgccgcacctgcggtcccacactcgtaggagcggttatgacaggaaaccaacagctgaagctgctcaaacaaattccaatttcttccgacaaccttccgaaaccatctcgaggcccccgggacctcaaccaaaggactaacaagtctaataccactgcccaaacttgtactaatccttaaaacacctaaaacaacatcgaaacgatgaatcaatcgcgaattcaagcctaagaactccaaaactctaaaaatgtgctttcgatcaaaaagtctatcaaaccttgtccgaatgacctgaaattttgcacacacaacacattggatcaaaatctcactatcgaaccggaaactttaaaaaatcaactttcagcatttcgaacctacattagctacggacctccaaagcacaatccgatcacgctcctaaacccaaaatctcctaacggagctaatggaaccatcagaattccatttcaaggtcgtcttcacactgttctgactacggtcaaatttccaacacttaagctctcatttagggactaagtatccaaaaaatctccgaaactcaaaatcgaacttcccggtaaattaaaatagtagaaataaacacgagaaaatttgttaattggggatcggggcgtaaatttataagacgactggccgggtcgtcatatcctcctacacttaaacatctgttcgtcctcgaacaagcataaagacatacctgaagtagtgaaaagatgagggtaacggctgcgcatatcttgcttggtctcccaggtcgcctcctcgaccggctgaccccgccactgaaccttcactgatgcaatgtcctttgacctcagctttctaatatgcctatccaatattgccactgactcctcaacataggatagatccttgtccaactggactgaactgaagtctaacacgtgcgatggatcgtcgtgatacctccggagcatcgaaacatgaaacactggatgaactccttccaagctgggaggtaaggcaagctcataagcaacctccccaacacacctcaatatctcaaaagggccaataaacctcggacttaacttccctttcttaccaaatctcataacgcccttcataaccgaaacccgaagcagaaccctctctccaaccatataggaaacatcatgaaccttccggtctgtgtagctcttctgtctgggctgtacggagtcttcataggggctgcaattgatgaaaaccccttaacaaaacgactgtagtaacccgccaagccaagaaaactgcgaatctctatagctaaggatggtttgggacaactctgcatggcctctattttcttcggatccacctgaataccctcactcgacaccacgtggcctaagaataccacaaaatcgaaccaaaactcacatttcgagaacttagcatataacttcttttctctcaaggtctgaagcactgtcctcaggtggtgctcatgatcttcctgacaatacaccagaatatcatcaataaagacaatgatgaacaagtcaagatacggctggaacacactgttcatcaagtgcataaaagttgttggggcattggtcagcccaaatgacataacaaggtacttgtaatgaccataccgagtcctgaaagcagtcttcgggatatctggctcccgaatcttcaattgatggtaacctgagtgcaagtcaatcttagaaaacacccgtgcactttgaagctggtcaaacaaatcatcaatacgaggaaaaggataacggttcttcactgtaaccttgttcaactggcgataatcaattcacatacgcatagaacaatcctttttcttcacaaacaagacaggagcaccccaaggtgatatattgggccaaataaaacccttatcaagcaaatcatataactgatcctttaactccttcaactaaggaggagccatatgatatggaggaatagaaataggctgagtgcacggcaacagatcaatgccaaaatcaatatctctatccgagtggcatacccagaagattagctggaaacacatcgggaaaatatcgtactattggtactgaatcaactgaaggggtatccatactgacatctctcacataagctaaatacgtgtcacagcccttctcaaccatacgctgagctttaagaaaggaaataactctactgggagtgtgatctaaagtacccctccactcaacacgtggtacacctggtatagccagcgtcacgattttggtgtgacaataaagaatagcataatggggagacaaccagtccatgcccaagataatatcaaaatctaccatgctgagcaagaataaaccggctctagtctcaaaaccaaaagcaaccaaatacggtcgataaatgcagtccacaataagagaatctcccataggagtagaaacataaacagggaaactgaaaaaatcccaaggtacacccaaatttggagcaaaataagaagacacataagaataagtggagcctggatcgaataaaactgatgcatctctgtgacaaaccagtataatacctgtgatgacagaatcagaggcaacaacctcggtatgggcaggaagggcaaaatatctagcctggcctccccttctagagagacttctacctccccgacctccacctctagctggctgagcaggtgggtagcaactggagctgtaatcatagcctgagaactctgcagggcacaatgtggctgagaagtctgtggaggtgcacccctccaaagtctggggaaatccctcaccatttggtgtgtcaccacactcaaaacaagctctgggaggccgtgactggctcgggccaggtctcctggactgacctctgaaagcacctcgtacaggaggcgcgctagaaaccggatgtgcataataaggctcctaaggcctaggatgagctggaataccattggctactggaaaagctgaatgaacagggcgactcatataacccctaccatggcgatctacagctggggcacgagcaccaggataatggcccgactctcgagacctcttggcctccctctcctctctcttcctagcatgcataccctcaatcctcctagcaatgctcaccacttgctgataagaaatatccatcttcaactcacgagccatgctagacctgatgttgggaataaggccctcaataaaccagcgaaccctctcgcgaacagtagaaaccaaggctggtctagctaaactaatgtaacggatagcatactctgagacagtcatagaaccctagcgcaaatgctcaaaatctgcgcgccatgcgtccctgaggctctgaggagcatactctctcaggaacagatctgaaaattgagtccaagtcagtgaagcagcctcatccggactgtctaactcataggtgtgccaccactcataggcggctcctcgatgttggaaagtagtgaaggaaactgcgctcgatcctgatatacccatggtacggagaataaggcaacactcatctagaaatttcagagcatcatccgatgctagactatagaatacaggaggcttgtacttcttgaacctctcaagccttaactactcatcctcggaaaccactgccctatccttggcatggtcttggactgcaggctatataggaataatatcaaggaccttctcaacatgcactcgctgcttaggagtacgggcggcgggagtctgtgctcctcccccggcctgagacgtagctgcagcaaggggaagcaactctgcctgagccaaagtggtgtaaatgctcatgaactataccagagtctcctgaagggctggagtagtagtagcagtaggcgtatcaggcgcctggactccggctggaactgctggaggtacctcggtggcagctcgtgcaggtgctctcactgcaccacgtgcacgtcctcagcctctaccccggccccagcctctaacggtagcagtagggggcgcgggtgcctgatcatctcgggtagcgcgtgtcctcaccatctgtaagggaatagaaaacaaaagcttataattgtcacatcaaatcttgtacgatacggaaatcaaatgaaatggaaattttcctaacggttacatagcctttcgtagataagtacagacgcttctgtactgatcagtaagactctaataaaccggcttgtgattcatgactcctatgaacctagagctctgataccaacttgttacgaccctggttcaccttccttgaaccatcatgacggcacctagtctctacaactagataagcctaaaatgcggaagataaaccaaatttgcggaagaaaataatttaaaatgggaatagagtaataaaacagcgtttaaaagagccactcggcatacacaatattaactcttaaaaccaatacatttttcccaaaacccggaaacccatgaatcacaagctacgaatataataaaaatgctctaactctggaatgtctacatcaacagaagaaaatagaaggggtatcactacaagatagaatggaaagggactccacggtctgcggacacggcagatatacctcaaagtctctggagcagtcgcctcgcctcaagggtgataggactgagtcaaagtacctcgatctgcacatgaaaaacatgtgcagaaagggcatgagtacaccacagtggtactcagtaagtgccaagcctaacctcggtcgggtagttacgaggaaggtcagagccctactgaggttaaataaaatataaagttcgacagtgtagaacagaacaatataaataggtacaacagtaaaagtgacacaagataaaaagggcaacaacaactattacacagacaaggtaaacacagaaagaaatacggctcaataccaaaataacaattggggatctcccaggataccgtcctgtagtcccaaatatacatatctaatggatctcccgggattccgtcctgtagtccaactcatagtgcgtcgggaatctaccagaatctcgttccgtagtcccaaatataaatacccagtactgggaaaatctaccgggtgcagtcccgtagttccatataactgtgcagggggatctaccggaatcccacatccgtagtcctaaataaatagacaagggggatctaccggaatcccacatctgtagtcccaatgtaaatacacagcagcaacaggaaaatattcagcaaatgtcaattccaatataaggcaaacaagtaattctagtctagcatgctgcacagaattcaggtagagctgtttgagcaaataaaacaattaaatcacttagacatgctttcctacgctaacaacatgcttaaagtgcaagtaacagggaaggaaacacactagtaattacttaatgaaaatatgattttcaacaattagcacaagtacgcactcgtcacctcacgtacaaggcatttcaattaaaaataataccaaatcctaagggaaaggtcccccacacaaggttagggaagccacttacctcgaaccggctcaaaatcaactcgaaaccacgttcttgccatgagtactcgactccaaatgacccaaatctattcaatccaattgcataatgtaaataacacttcaagtaactaattctacaattaaattctaagctaatacgcgaaattaggtaacatgaccaaaatgtccctcgggcccacgtctcggaatcgggtaacatttatattttcagaatccttatactctcacgagttcatccataccaaaattatccaaatctaaggtcaaattcccaatcaaaattagaattctaggtctaagaactttcttccaacttttccccaatttttatctccaatccgaaattaaatgatgaaactaagtatagattgatggaatataactagaaagcgttaaataattgttaaccaatgatttcctcttcaatttcctcccaaaatcgccctctcccgagctccactttgattttttcaaattttgaaccaaaccctcaaaatttcatttttttgccagtgattaccgcatctggagtcaagggagcgcacctgcggtcccgcacctgcggaaaaatgcatcgcaggtgcgaaaattcacttaacgggctaggtccgcatctgcggtcgcttggccgcatctgcaaaaactcagccgcacatgcggatcctggagcttgggccaaatctcgctcctgcggtatataacctcttctatggtgccgcacctgcggtcccacactcgcaggtgtcgttatgacaggaaaccagcagctgaacctgctcaaacaaattccaaattcttccgacaaccttccgaaaccatctcgaggcccccaggacctcaaccaaaggcaccaacaagtttaatatcactgcccaaacttgtaccaatcattaaaacacctaaaacaatatcgaaactacaaatcaactgtgaactcaggcctaagaactccaaaactctaaaaatgtgctttcgatcaaaaggtctatcaaacctcgtccgaatgacctgaaattttgtacacacatcacattcaacactacggagctactcaaacttcaggaatttcattccgaccctcaaatcgaagtcccactatcaaaccggaaacttcaaaaattcaactgtcggcatttcgagcctaaaattagttacggacctccaaaatataatccgatcacgctcctaaacccgcaatcgcccaacggagctaacagaaccattggaatttcattccgataccgtcttcacactgttccgactacgctcaaatttccaacacttaagctcttatttagggactaagtgtcccaaaactctccgaaactcaaaatcgaacatcttggcaaattaaaatagtaaaaataaatacggacaaaataattaataggtgatcgaggcataatttcttaagacgaccggtcatagtaatatgtacttcgataccgataatcgttgtttgaataaggcatttttttttgtgtgccgtaaaacattttttttctgtttttttttcatccgctatcaacagaagatgatctatcaaaagtacaatcagtgtctgtctcattaaaacaaggacaactttttaagaaagagaaatagacttttgtaaaaagcttgaacatgctttcagccaagaaagaaacaacacaaaaaggaaaagaatttttttttacactggctctttgatattattggctctacatcaacgacaaataaaaagtcccaatgttgtcttctgaatgccattattattgtcttctaaatgcctacatgattttccttgaaaatatcagtgtaataatttcctcgattaccataacatataaaaaaaatcatagatgttttgttcaagacaatgacccttgaatattttatttaatggtactgcctctttcttagaatttccccacttaatcaataatgtttctccttttataatgcatgtatggcagtcgaaataagtgacagagattttgtttgtttacaacaaaataattatggtttgttagagatcttctgtacttaatggaatattgtgtggcttcagtatcataatgagtcacttcttgaagacttgcaccctatattctaagaaagaaacattgtctgtttcagtgaattaaaattagtttagtcctgatccctcaattaatattattctataagtaattgtgatatatgttgttacattgaatggttggagtcattcttattatttccttggtcctatttcagatatggctgaacagggacaagttcgaattatttcaattgggagttctcgaagtccaggaagggaacgtcgtcgcaggacttatttctataatgattcagactcggagcctgaagtcatcaagaatatcccaagggcgagacaaaatgcgttaagggattgaagggctgaacgaagggaaagagaaaagaaatttagggagtttaaggaatttaatttttttctgatgtttccgttcctgaaaatatacacctttttaagataaaaagagttgaattggctaattacgtagaaattactgattgaaaagcattaactattttagtgaactctcttcgagagccttggggtgaaattttaactgagatttattatgatgtttggcctagtgcaccttttagcgtaagagttagtgttcgattggtatatggatatcctagcaaacatgtaaattgttattatgagttttattttaatgaaatttatattatgttatttgtcgcactagttacatacattgtttattatatctttttgtaatggattgagacttaaaatatatacacactataaagtgattttaatattaattaaaaatatttagatatagatgatgaatggaaacgtagtgaccgttcgattctatactaaatgtagaattaatattataattaatttttttgagtgtgtaataacatgcatatattaactgaagtatatattgatgagttaaacttgtaatattgtctttaataaaagacatggcatcaaaaagtatcattgctaacttgaacaagggtgacaaactgaatgatgaaaattacgatatctggagtcgtaagatgtggtatgtacttgaagagcaagatgatcttgaaagtattaaccatgtaatgagtcacccagaggagggtaacactgcccaacataggagggatttggaaacttacaatatttggaaaaagaaagattctactgcacgtggaatcattgtaagttcagttgttgatgatctcatctatgaatgtgagcaatatcctactgctcaagccatgtgggcacatttaagggaggcatatgggggtacgactgtgactcgcctttgacagctaataatcaagtttgacacgtacaaaaaacgtcatgatcacggtgtcaagcaacatctaagggtgatgtcaaatatgattgctcaactcaaaagtgttggccatttctctctgatgagcagcaggttcaagcagtgattcggtctcttcccaataattgggaacatttgaaggttaacttgactcacaatgatagcatcaaaacttttgtgatgttgcccgtcatgtggagcttgaagacgagcggcttggtgctgctaaagctgtacctattgccttgtggaagtatcaagttgtacaaagagatcaagcttcaagcgcaagagaaactgaaaaaatgacggaaagggtaaggagaccggagaaggaccctccaagaaaagaaacaagccaaattccaagaaaggagaacgattctacaagaagaaagacaagagcaagatgaagtgttacaattgccaagttctagggcattttgctcgtgagtgcacttagccgaaaaaggtagcatttcaaaacgcatctcttagtgctatatatgtttctaagactgttttactaactgcatcttatctcatgtggattgtagactcaggggccaccgaccatgtgagccgcgatagagaagtgtttatagagtttcgtcgagttccacatggatcaaggcatgtatatgtgagaaataattctaagcttgaagtcaaagggatacgaacttgcagaatggacatgcgtggtggccgatctttgatgttgcatgacgtcctatatgttccaaagattcaacgaaacttagtatatgtgtctgttcttctagatttagatttcaatttgaactttagtcgtagtggtcttagaattactcaagacaatgtttttcatggttttggacatcgttatgatggttttactatgttagattgtaatccttctacgtataactattatgttgaccgttgtgttatggcatgttattctagcaacaataatgttgatgttattacatggcatgcaagattaggtcacataggggaggatcgaatgaatagattggctaaggaaggacatctaggtcctttctctaaaattgaaatgccaacttttgaaaattatcttgcgggaaagattacacgtaaaccatttggaaaggctaaaagagctcattttccattgcaattaatccattatgatatctgtggtccaatgaatgtgagggctaggtctggtgctttattttcattacgttcattgatgattctacactctttggttatgtctatttgatttttcataaatctgaagtacttgaatgctttaagaaatatttcagtgaagttgagaatcaattagacaaaaggattaaaaccttaagaaccgataaacggcgtgaatatctttcaaaagaatttgaagaattgtaaaatgaaaagggaatcaccatacagttgactattccgtacacacctcaacaaaatggtgtagcgaaaaggaggaatagaacactattggacatgataaggtccatgatagcgtaggcaaatttacctatctccttttggggagatgcgttattgactgcaacatacatattgaacaaagtgacttctaaatcagtttcttccacttcctataagctatggactagtcataaaccaaacttaaaggatttacaactttggggttgtgctacatatataaaagattcttttagcaagtttggtaaattaggtccaacgggcaagaaatgtatctttataagatattcagaacactacaaaggttatatgttcattggtgaattagaggatggaagtgttagtgagattgaatcacgagatgtcacatttctggaaaatgattttccaaagaagggcgaggtaaagaatagtgagcctctttatgaaatgttgaactcagatagtcagcaagtgtcttctgacatagttgataatcaaattgatcaagatcttattcttgatccgagtgggagtgggaactctcaatcccaaaatccttctgacgaacctgaatttcaactacgaaagagtgccaggaaaaatatacccaaacgtacttatgaaattgaggattatattttcttgatatcttccacaaaaatggatgagccaaagtctgtgactgaggcttaatcaatccctggaaaggatgagtggatgagcaatgaaagacgaattagagtccatgaaaaccaacaaagtttgggatctagttgaccttccacttgggcatagagccattggaaacaaatgggttctcaaagttaaacacaaagcagatgtgtcaattgaaagatacaaggcacgattggtgtcaaaaggctttactcaagaagctggaatggattatgaggaaatattttcaccagttgtgaagtttacctcaattcgcttacttttggctattgttgcacgtttggatttgtaattacatcaaatagacgtgaagatagattttttcaatggagaactgaacgaagaaatctacatagaacaacctgtaggcttcatcgttaaaggccaagaaaagaaggtctgtaaattgaaaagatctatttatagtctgaagcaatcttcaagacaatgatatttgagatttcacaaggaggtgatctcatatgatttcactgtgatcaatgaagaccatttcatttatgtgaagaagtccaatgggatgtttgcaattctttctctttatgtgaatgctattttattggccggaaacaatttggagtatttgaaaactatcaagtcagggctttcaaagtcttttgacatgaaagatatgggcgaggcaggctatatccttggagttaagatccaaagagaccgttctaaaaagttattgagtctatcttaagaaacttatataaaaaaaatcttggagcattttcgcatgaatagttgcaaatccatggatactcctatagcgagaggtgaaactttaagccttgaaatgtgtcccaagacagaaaataaaaaggaagacatgtcttgagttccatattcaagtgttgttgggagcttgatgtacgcaatgatgtgtactcgcccagacatttgttatgtcgtaggtctagttagcaggtatcaatccaatcctggaagagatcattggaaagttatgaagagagttttcagatgcctgaagggaactgcagattagtcactatgttattgtggaaatgatttatacttgagaggatatatagatactgattaggctagtggttgaaatgatagaaaatcaacatctggttatgcattcttacttaatggtggtgctatatcatggaaaagtaagaaacaaacctgcacagccctttcaacaatggaagctgagttcgtggcttgtgcgtctgcagtataagaagttgtttggttgaagagattctttgagcatttaaatattacaaagaactctcgggttctcatggctctatattgtgatagtcaagcaactattgcatataccaaagatccgaagtatcacaacaagaccaaatacattgacatcaagtataactttgtaagagacatggtagcaagtggacagataaatttacagtacattcctattgcatgatagttgatcctttaacaaaggcgatatctagagatctgtttgagaaacatgttatagctctaggtttgcgaaggatatgaacatatttatgtattgtaaaatgaatttagtattataatatgctcatcaatatttgacccttgaatttttcttatatctcgtatgtatgtgatgatgttttgttgataaagtgtgtcgaacaagtcgcgagattggctctctcatacgagcaatcgcctcttacgttaagaatcgtgaagacatgagaccttatggaaccttggaaaatgtgaggttatatttacttgtagagatcgatcttgacaactaatcagacttacaaatttgactattcgattatggcttgttttgtaagacatatggatgtttctctaagaagatggtttgaggattattgaagtgagaaacttgggttagacatttggaggtgtctagatcaagatctgtacggtgttgaacgattaaaagaattaggaacgcacgccaatataaggtgagaacactgtaacatgtatttcataccacgtgtgctatcgaccatgtgataatggaagaatgaatccctgcttcttcattgtgtgagatcccaaagaagttatatcaacttttattagaataccctttgaccttttactgtatcttaaagtgccaatcagtgttgctactttagcatgtcactaatatccatgagtgatgcggcaatgcaatgcatgtctaggaaagcagttgatttggaatggaaagattcgagtagaaagggaagacgactaaaattttgtaatttaacctgaattcataggtcgaccattacacttaccatgatggtatcaaatgtaattatgaatacaaagttaaacatgaactcgagttcacctctttcgaggatgagggatcgaataactagctactggagtagtgggtaatgtctggggtatagcgagtaataagatcctcatgttagtagtaaatccttttcgcatgtgattgcatttctacatagagctattaaacaaccttaaagggtataagaatattatagatcttaatgctcgtaggttgcacgatctatttactagtatgaattaagtgtgttatacacatggcactagtttgggtctagcccatcatgtgcgaagtgggagatgttggatattgggtttgagtcgcgggtcgcccatatggactgaccttacccatttaaagaagataaaacctaaagaggttacctagggaggtgaaaacacggataaattaaaataaaaaactgttgtacgttagagagagaaggggaacgtgggattgaatgtgagcgggcagttttttcctctcttgaaactcctctctctcctatatatatatatatatatatatatatatatatatatatatatctttcttcttcaacagagaaagatagaaggcctgaagtaattctccctcaagaaaacatactctgaaataggtatttagatcgtgaacaaaagctctatctcttggagattcagaatacgatttgggccaattcctttggtggtgagttcaacagtttccgctgcgttaataagaaatacaacttgttgttctcgccccgtgattattaatcaacaatatgtaacaaaataggtgacatattcaaattgaccgacttttgtttacatattcaaattgtaaatagttgcagcttagcatttcgacgatttaacttattgcattgtacgttattatacctctttcagagaataaaattgatatttatgattatacattatgatgaactccaaaaacttcgcaccaaaataattggacaagaaactcatgtgtgtacaatctatcctagaaagtgtatggtgtatgaatttatataagttttattcaaatgatgttaaaattagatttttagatcatttaaattgcaactgcaagtaggtttgaatattaaatatcaattaataaacctgaaaagatctaagatagaaaatctgttgaggtataatgagttacatatgctttataattacattatcgttccagcaaattagttggatcgtagctcatttattacccgaaattctcaaaacaaaaatataaacaacaaattaaacgccactacatttatatgtttccaattgtaaaattttcaaactggttaccttcaaaatcatgtttttggacaacattaaagctaaaataaaagctccattttataaaaaaatttgggctatgaaccattgatgtttagcttaaagcatatatatttctatgtatatcgcctcatattttacttttgtttcgtgaatttgggatgttaaatgctatcatttatattaatttgaagtgttttcatgtgtaggaataattcgggagcaattgggggcgaaacgcgcaaaattagagccaaaacgaacaaaaccaaaaaaattgtgcatttgggcgccacatgcagtgcctggcgccacccgtggcgttggaacaggagttgaaaattgggcagcgtcctggtgggagcccggcgcaatccagggcgctgctaacatgatttttgtcccattttgccagggacacggtttattcggctttagacctacccaacagtataaaagaaagactaagcctatttttgatgggagagacgcactttggaggaaaaatacacacaagaaacatccgggagcaagaacatctcagatttcttcatcttttctagtattttcaattattcaaaccttatgcaattgtttgctagtattatgagtggctaaacacccattgaaatgggtttgtgatttagccatgcatattgttgtttaacgttgacttaacctcgattataattcactaacatatggttgtttctttaattctgtgtttaactgcttaattgtctggctaacagttaggttctatttactatctatgctatgcttgggaaagccgtgtttatattagagaagaattgaagagagcatgatcttaacccttagggggagcggatttgtggttaggatagcaatatacctagtcaccgtacttaattaaatatcgtaatcttaatgcgttcttaatagactgatttcataggaatataggcgttaatctattttgaataggcgagtagtacttcgggagaaggttatgagagcaattatcgattaattagcaaccgtgagtgaattgtatgagagagagagagagagttaattagaacacaatacgaatggtgaatcgatcacaaccctggaatatttgtctctattgaatacataacaatcattctactgcttaataatttagttattacttagaattgtagtttagtataattaaaatcttgaactcgaatctagcttgactgaataacaatattggtgagttagtgagtagttgatataagtctctgtgggttcgacattcaacttattattttattacttgtacgaccacgtatacttgcgtgtgcgtttgggagcaaaacgtttttggcgccgttgacggggacttaaaaattagctactttgctgacttaagcttttattagttatttgttcaagttttaattgtcagtttaccttgtttgtgttaacagagactcttctcttgaatgcggagaagtagaagcgcaaacaatctccttcctcttgatcctgaaattgaacggacacttcacagattgaggagggaggtcgaagctagaactagaattgaaagagagtaggacatcgtagttcaaccacaaccaatcgagatggaaggtaatgcagagcgtgcagtaatagaagccgcaaggcccaatcttgctaatatgacttaagctattgtgaagcttgagatcccagggcattttcaactcaaatagtacatggtacaactgattcagtccacagggcaatatgtgggtctatctcatgaagatctgcagaggcacattcagaatttcttggaaattatggacacctacaattatccgaacgtttccaaggactatgtcaggccgacaatttttcccttttcactgctgggggaagctaaggaatggttacagaaagagcccatgaactaaatccacacttgggatgatctagcaaggaaattcttaatcaagtttttccccaccaagaagacaaaatcattgaggaatcagattcttgggttcaaacaacgggatggcgagacacttcgttaagcttgggaaagatacaagaagctactcagagattgcccgtaccattatcagactgatggggtattgggacacacttttgttggcgagatagatgaggcctcagagatgaatcttgattcagcttgtggggttagttgcatggcgaaaccatatagtgaaattctactcttgctgaataacttcactgctaatgatcataactggcaaggagatggggattcatgcaaggcaagtaaacagaaggcagtcgggttgattgagcttgatgacttctcggctatgagagctgagatagcaaaattggcaaaccagatgaatagaatgataatgcaacagacacaacaaattcaccatgtacaatagattctttgttgcgaactgtgtggtgaaaaccatatgagtgacatgtgccccacgaatccataatctatatactatatgggacaacagagcaatggtccaatgaatcagaatgcacaatatgggaacacttataaaccaaattggaagaatcatcccaacttctgatggggtggaaatcaaccgaatcagaatcattatataccccaaggaaatttcaatcagccttagaagccacctcaacaggcagaagagaaagggaatgatttgttgaagcggttgttgcttgacaatcaacagctcaggaccgatttcaaaaatttggagcgccaaatgggacagcttgccactcaaaaacactagaccagttggagctcttccaagtgatactgaagctaatcctaaggcatcccttaatgccatgccattgaggaatgggagacaattagaagaggtttagtcgagaaagagcaaacatgtgacttttgatgagaggcaagccactattgaatcaacatcaaaaaaatctaaggaatccgagaagccagctggagaggtggttgctgagcaatccccaccagtggttgcaaggccaccaccttcgttccctcaaagattgcagaaagtaaaagataacaccgcatataaaaagtttcttgatattttgaagcagttgcaaattaatattccgttggttgacatcttacaagaaacgcccaaatatgcaaagtacaataaggacatagtggcaaataaaacggggttgaccgagttcgaaactgtggcacttactaaggagtgtagctcaagaattcaaagcaagttacctcagaaattgaaggacccaggtagtttcactatccaaatactgattggtaaacatgcagttaggcgagccttatgtgatcttggagcgagcatcaatttaatgtcgctatcggtgttcaaacaattggggttgggtgagccacgcccaacaacggtaatcttacagctagctaatcactcccttgctcatcctgaaagagtgattgaagatgtgctggttcaagtagggtctttcatattccctgctgacttcattatcctggactacgagcccaatcaggaagtcccatttattttggggcatccattcttagccacgggccgagatattattgatgtttgcgaaggaaagatgacgatgagagtaggtgatcgagtggaggtattcaatgtttataaagtactcaggttgccaactcactatgaagagttatccatgatctctgtggtggagagtgatgccacattgttagtgccctatatgatccctgtagatcctgttgaacgagtgttgattggggatgacgaagatagtgaagatgaaatgatgggagaaattgagcaagtactggatatgtcctgcagttatatccaggggtttggaaaatttgaggagttggacaggcctgtcactctgacccctcctaagccatctattgaagaagctccgaagctagaacttaagccacttccagcgcatctgcgctatgcttagttggagaactctgagacattgcccgtgattatttcgtccagattgaccaacactcaagaagaaaaattgctcagagtactccgcgagcataaaaaagccattaggtggactattgctgacatcaagggaattagtccatcggtttacatgcatacaatctttttggaagatggacaccgccctagtgtggagtagcagagaaggttaaaccccattatgaaagaggtggtgaaaaaggaagttatcaagttgctcgatgcaggtatcatttttcctatttctaatagcaactaggtaagcccagttgaatgtgtgccaaaaaagggaggaatgactgtgattgagaatgagttaattcctactcgcactgtgacgaggtggagagtctacattgattatagacggctcaacaaagcaacccgcaaggaccatttcccacttccattcattgaccaaatgctagacagattagtcgagcatgaatattattgcttccttgatggttatttgggatacaatcagattgtcatatgcccagaggatcaggaaaagaccacttttacttgtccttatggtacttctgccttcaagcgaatgttgtttggtctttgtaatgcaccagccactttccagaggtgcatgatggctattttcaccgacatggtggaaaaattcgtggaagtggttatggatgattttcagtttttgggtcttcttatgatgattgcttgaggaatttaagcaaggagttgtcccattgtgaagaaacaaatctagtactaaattgggaaaagtgtcatttatagtacaaaaaggcatcgtgttgggtcacagaatatctaggggcggcattgaagttgataaggcgaaggtggaggcggttgaaaaattacctccacctatttcagtgaagggtgttcgaagtttcttgggacacgcgggtttctatcgatgctttattaaagacttttctaaaattgctactcatttgtgcaggttgcttgaaaaagatgtaactttcaactttgatgacacctgcctcaaggcatttgaagaattcaaaaagaagttcgtgtctgctcccattattgtggcacccaattggtccttaccatttgagcttataggtgatgcaagtgaccacgctattggggcagtgttaggctagaggaaggacaaggtgttttattccatctactatgcgagtaagactcttgatgacgcatagctgaattacaccactactgagaaggagttgttagttgttgtgtgggactttgagaaattttgggtatacttggtgggaacgaaagtcatagtccataccgatcatgcagcaatcatgtatttgtttacaaaaaaggaatctaaggctagattaatgcgttggtttttgttgctataagaatttgatgtataaatacgagatcgaaagggaatagagaaccaagtagttgaccatctatcaaggttggaaaatcacgatcacgtggaggagggtggccaaattaaagaagtctttcctgatgagcaactttttgctatcacctaagaccctccaccatggtacgcagtctacgtgaattatcttgtgagtggggtacttcctcctgaaattgaatctgaagctagaaagaggtttctacatgatgtgaacttctactactgggatgagccatatttgtacaagaaatgtactgatcaattgatgaggagatgcattccagaaaaggaggtggaattagtgttatatgattgtcacgcatcaccttatgggggccatcattgaggagataaaatagctacaaaggtactacaatctggtctcttttggcctactctattcaaggatgcccatgcatttgttaagaagtgtgaccaatgtcagagaataggaacaatcacaaggaggcatgagatgcctttgaacaacatcctagaagttgagctttttgatgtgtaggggatagattttatgggaccattcccattgtctagaggaaacaaatacatcttgctagcagttgactacgtgtaaaaatgggtggagccaattgctttgccaacaaatgatgccatggtggtagctgcttttgtgaaaaagaacatattttcgagatttgggactccacgtgccttaattagtgatgagaggacccatttttgcaatcggttgttgaataaccttctagctaaataaggagttcgccacagagttgctacaacatatcatcctcaaacaagtgggcaagctgaggtgtcaaacagagaaagaaagcaaatattagagaagacagtgagtatgaacaggaaggattgggctgcaaagttagatgatgccttatgggcgtgtagaacttcatataaaacgccaattagggcgtccccttacaagcttgtttatgggaaggcatgtcacttgcccgttgaactggaacacaaggcatactgggccattaagaagctaaacatggaccttgaagacatgggcgagaaaagacttttgcaattgaatgggttagatgagtttaggctgcactcttatgaaaatgctaagctctataaagaaaagacaaaaagatggcatgacaagcatatcaagccgcgtcactttaagccaggccaacatgtattattattcaattttaggctatgattgttccctggaaatctaaaatcgaggtggtcaggtccgttttaggtggtgagagtcactccttatggtgcaatcgagttgcaagctttaaatggtgaaaggaagtttttggtgagtggtcatcgagtcaagcactattaggaggaatgattaatcgtgagaagaccaaggttgtactcgctgataagtaagctagacactgcgtcgtgccgcgatgttaaatcaggtgcttattgggaggcaacctaatttttattgctttccttgtttaacttcttaattttcttttagaatagttagagttttgcattttctttgtaggtatagaaatttgagatataatggtgtaggacgtgtaaattgggtacatataaggctcagaggatcgggttgtttcaaaaataaattgcgaaaacagcgcccagcgctgcctggggcgctggaaagagaatgaaaaaaaccccagcggcatgcagggcgcgaggcgccgggctgggggcggatcaggtaagtttttttatttttttattttttgtttctttgctttctttattaacccatgctcatttaaccccacccaaatacccatttatactaacattctaacctatcctaatactcatacccactcccagtccaacttaaccatcacccaaacccacccaaacacaaaaaccaacatcaaacgttgaaaatttctatagcttctgtcgcgtccgcttcttcctctccaaattttctcagtttttttttctctcttgctctccttctccagtctacaggtatgttcttcttcttcttcttcttcttcttcttcttcttcttctctttctttttgtgttttaatgaatagataattatatacatcccattcccaaaagccccaatcccccaattttttatgtagttcttatgtaatttttatggtgggtggcttgtgttggtcgaaattgtgtgactaatgtgtatacggagtagtaaactagaattccctctacttcattgaaaattagaaggtccaccatatttcaccattgttgaattagaagcacacactttatgcccgcaagatgtttgctaaaatgcttgaaagaggattttggtgcaccggtgaagtatgagtaaccgagtatatttgtgtatgaattttggctaagtgtggggtgtgtagggatgcttttacatgctagggggtatgtctttgatgcaatacatgttcctacaccatctatcttatataatgtatattgtagaatcttgtagatttgactaatttagtatagtctagtagttgtgaaaggtgcgtaccatacacctcttgcttaacttaatgtgaattcgcgtatccataatcaatcattatttgtgtggcatggggaagccttgagtacccatagctttagggtgcaacacttctacatgttggatccaaaattgtgacatagtgtacattatgccttcggttttaagtgtggggtcattttatgacttgcacgacaaccttaggcatatttcttgacaagttctcacatccatgtttatttgtgttgtaggatactatggatcgtgatggttctagcaaaggaaagagcattggaaagtcctccacaacctctccagtgcccaaaaagcgaaagcggggagaaagctctcatggcaatccaaaggataacaggtcgccgagggatctcagcaggtgccattaaggccgaggcctcatttggatttggtcgatgctgcagctatttcatagcacaaggacttcatgccatctgggcagtacatttctgaaattgggattaataccatgaccttagaaagaaacttcccggaggtacttggctggctgcgaactctaaatatgcacaagttcttggaatgcccgggacctgcaaacctgagcatggttcgagagttttatgctaactgggattaccaattggacacttcacgtgtaagagggaaggatgtgccgatggataaagtgtctttatgtgactatttgggggttgagaatactaatccaaggagactccaacgatttatcagaagcccaaaatataagttgatacgtcacactctttgtggcgtagattccaatgctaagtggataaagaagcagggcaacattcacctttctatggttcgctccgacttcaacaaagctgctaaagtatgatagaattttgtacaagcgagactcatgtcggcgaagcacagcagcgattgcactcgcactagagtatgtgtcattttcttcttaatgatcggttgatccaataatgtggctgtgattatgctcagtgagatggcccgcacgagatttggcgacagattaggcggttcttcttcggaaacttgctcacttagcatatgctatttcgaggagtgccggagtaccccggacatgatgaggtggtggaggcaccgtcagggcttatagacatcaatctctattagagacatcgtcaaaacgcacccccgcagcccgtatggagcgagatgagagcttcaataggtacctttataactcgatgaacatactcatgagcagggcaggtattacaaatgaggagcgtatgcatttacgtaatgacttgtccagcacgtccaaggagatgttggggattgcacatggcagccctgttcactcgtcggaggacgtcaactctattaagggctcaaacactgaggatgaggatggaaatggtgctatggggcccatgactttggtgcctctaggaccggatgatgatgagcccagagctactggtggagggcatgctgcggaggtggactccacctaacagggagtttttcttttcaccctactccatatttcatttttacttgcatcgagggctatgcatagtttaagtgtggggtgggaggaatactacctgtgctgtagttatatattttgtatcaacttgtttgatttgtttcttttagtagtgatagtgtagttagtctagtgtagtttagtagctttaaaaaaaagagaaaaaaagcataaaaatacaaaagaaattttttttttttgaaaaaagctcggacttttcccgacgatggatcttttggacaattttcttgagggataaaattctaatttaaaaaaaacaccaaaaagttttttttagaatagctaggtagtattccttggtttttctttgggcaccgattcttttccaaggatgtagctcgaaccgggtacttcttttttttttaggattagtttaggaagaaactgagtcgctctgagatacccatggacatggttgttgctagcacattaggctatgacatacactgtatctttcccatgtatttgttttggattgtgaagcctgagtaaagtaaatagcctattttgtgacgctctctctcagttgtttgacttgtatgccacataatgcaatattgcttaaatttctcaattatgtgcgcttgctcgacttgagagttgaacagaaccgtcttgattgagtcatgtgcaacatgtgtgtgaggatttgtgattttctgttctattctctgtattctagaacttgccccatgtgttaattgaagcgaaattgtaagttgtgctaatctaggagatgacgtaggcattttcttgcttgatcatggatgtgcttgtcacataaaaataaaattttccattgctagccctttgagcctatagacctttcttttggcacccacattacaagtcatgctcctattttgttcttaatttgatattgattaaacctttacctcctaaggcacttagtcgctaaaagaagtaaagtgagatattggggagtagtttttgagtggaaccatggaagggcttgttggtgcaccaaagttgaaataaaaagacactagccaatgaaccttaatgtatggagtgtgtgaaaaaaaaaaagagaaagaaaaatttgcaagaaaaggaaaaaaatatgatagttcaaataatgtagaaaaatacacacctccaattcacaatgatttgtgctagtggaaacatagaagtgcttaattgaaaagagggttatgttgtatatgacaagtgaattgattgagaagaatatgtgcttgaattgtgaatgtagtgtattaaagtgcttaggagggttagtcactatttctaaatgtatcatacccgtcccttaacctacattacaaccttaaagttctaattgatcctagatttggctagcttaaattagtagagatatacactacgggaaagcttatggtacgaccacgggatgcatatgaactctttgtgagagtgaacgaattttgttcaattgtgtgatatccttaatctatattcaaaagtatatttgaatctgtggactatttatattcactcttttgtttgttggtgagggcacatgatctcatgaatgattggtaatattataaacattctcgttggataagtgcatgaattgagggtgcttagtggttgcaagtcggcttttgaggttgggtggtgacaaataggttgctggaattgaaatattatacttgggcatacttaaatggggaaaatgtgaaattttgtgtgttcatgcttgtgtgccggtattgatcatagtcaagggtatagtgtgtggttaaaagttaagatgctcctctataattgagacttgcacgtagttgggggtttattagatagtctcattgctcgagggcgagcaagagtctaagtgtggggtatcgatgtttagcttaaagcatatatatttctatgtatatcgcctcatattttacttttgtttcgtgaatttgggatgttaaatgctatgatttattttaatttgaagtgtttttatatgtaggaatgatttgggagcaattgggggccaaatgcgcaaaattagagccaaaacaaacataaccaaaaaattgtgcatttgggagccacaggcagcgcctggcgccacttgtggcgctggaacaggagctgaaaattgggcagcgccctggtgggcgcctggcgctatccagggcgccgttgacgtgatttttatcctattttgtccgaaacacggcttatgccgccctagacctacccaacacgtataaaagaaagactaagcctatttttgaagggagatacgcactttggaggaaaaatatacacaagaaacatccgggagcaagaacatctcagatttcttcatcttttctagtattttcaattattcgaaacttatgcaattgtttgctagtattataagtggctaaacacccattgttctggggttgtgatttagccatgaatattgttgtctaatgttgacttaacctcgattataattcactaatatatggttgtttcttcgattctgtatttaatttcttacttgtttggccagcagttaggttctatttactatctatgctatgcttgggaaagctgtgtttagattagagaagaattgaagagatcatgatcttaacccttaggggaagcaaatttgtggttaggataggaatatacacagtcaccgtgcttaattaaatatcataatcttaatgcgttcttaatagattgattttataggaatataggcgttaatctattttgaataggcgagtagtacttcgggagaaggctatgagagcaattattgattaattagcaaccatgagtgaattgtatgagagggagagttaattagaacacaatacgaatggtgaatcgatcacaaccatggaatatttgtctctattgaatacataacaatcattctactacttgataatttagttattacctagaattgtagtttagtataattaagctcttgaactcgaatctagcttgactgaataacaatattggtgagttagtgagtagttgatataagtctctgtgggttcgacacttgacttatcattttattacttatacgaccacgtatacttgcgtgtgcgtttgggagcaacaaccatctcaagaaggaatacgagcattttctacgagattcctaaacaaaaagtcacctaattttagggcataatttctatactatgacagtataaaaaatgtatattatcagatcatgcatattaaaatatttcactgatcgtgtataaagtcattttgacatgtaagtaagtctagttgatgattatgacttcactaacttcgctagaaaatctgatatttcaagatgtaattcacattgactgaaaatgatgtacccaaaacaattgaagtatagacattaagggcaaaattactgattattacattttataaagatgaatctactcttcatcaatgcctacaaaataactaaagggtagtggaaatgatgaggtccattcaatcttaacaagagatcttgtattcaagcccggaaaataaatatacttttggtacagaacactttcttcctttaaatgagtcatatgcattgagaatctgaattattcgaaccaattaccaaatgattatatcaaaaaagataattgataatgaaaagggggaaaaaaagagagaacaaaataccaaaacaaggtatctcacgaattcacgatatatattcgaaggcaaacaaatgaaaaaaatagacaaaaatgcgtacatattttttctagactcatgatctatccattatttctggaactgggctctctgtaatactttctaaagatggtttccacttagaatctcttctttctcttcttctttttatttctcccaaaatatcctctaatcttttctcttctttgagtttcaactgaagaaataacatttctagttcttctttagtcaaaactatctttattctcatactattatttccttttttctccgtttcttttttggccttgagaatttcacttgttttttcctctgtttctagttcttgatgaatactttcctctatttcttcccttcgtaaacatgcttccatgcaatttcccattatattgaaaaccctaataaatcgttctttcttctaagaaattgatttttttaatagtaatttgctgtttctgagctgaaagaagaggaaaaaaacagccaaacaataattttgtgtgggtgtgagagagaagagagaaaattgtgaagtgttaacgatagtgcatgtgatggtgatttgactttttatagagaaagaataaacacgtattgaataaaatattgtattagttaattaaaacgagggacttcgctttttgttataatcatctgataattcgttttgcatttaacctatttaaggaaaaaaatatttttatcaaggatcgtttcattctcaaatctcgaatattacactctacagttaaaagttgaggattctcatttattcgatcgcatcttatcgtaatagaaattttacattatttatccatctacagtagcgaactcgttattccccgaggaaaaaaaactcgttattcccaactgccacgcgtccttccaggtcatgctagagcctaagacgtaccgtgttgcaccacattcatatcgtcaaagatttaaaagcttgtctattaaagttgtaaatttgaatatgatagttacgaacttttcaaacattttgaaaattgaaacgccccaaattaaaataaaaagagtgttatattaaacaaaatgtaaagacaatatttttctatctatataatgtattagtgcagtttgaagtgatcaatttatgcctttgactgatattaactcgtaaacgtttgatttgtaaatattttctgcatttaataaacacataaaaataagtaaaaaaaaaagaaaacttatataaatagttggtaaaagaattcttatatgttaataaaaattttaacaagaatatagggtttacgtaaaagttactgggttcctcggaaccaatatatcgtactccagaaccgctcctgtctatacataaataatacatatattatatataaattctaaatatattatatatttatcgatcatttttaatttaacgtattggatgaacgattatttaagtcaattattcaatactttagaataatttaattagcttttaaacttacctcccaaatattaattagctgcggaaaggggttggggtagggatcagagagtaggcaacgatataaatgtcggtattgagtttcatggaaagagaatactacgtagttgctattctaacatgtcagattttgtcccacttaatatttttatatttgttgaatattcttttccaatagctagctagcctagagttgcattagtactactctgttccaatttatgtgaacctgtttgattgagcatggagtttaagaaaaaaatgaagacttttggaatttgtggtcctaaacaagtccaaatggggcccagagtatttgtgtggttataaaagtttctcattaagagtagcgttgtaactttaagctaaattgttaccaaatttaaaaagaattcattctttttggaacggactaaaaaggaaatattagagtactatatttgattttgtcctacttcgtacttttatctttttcttacttgaatattcctttccagtagctagctagctggaaattgtactactaccgccatccaagctttgctttagtgttaagaacacaatacatgaagtcatgaacgtattcgagttaaatgcacgttatgtattttaagtaaaaaagcatatagaataagcatattatttactgagtttcaaattttgcataattggttcctaaagacttataggttatatataaaaagaattgcactattactcttcaatatttaacaaacgtgcaatattatctaaggctgcacgtgacatgtagtgattaataaagtgtgtggattatgataaactctgaggttcaaatttgacaaaaacaaaaaatgtccaaacataaacaccactgtcataaaaaaatcatccaacttgcatcttttcaagcaagtattccttggcaataattcgttatcttactcttttgattaacttttttttttaaaaaaaaggagcattgcttcccccttggttataccattattgaacgcaagaacagttgacaattaattaacgctgcaatttcaatttgctaaaatatgaatgcagaaaagcaaaaggctaatcataacagaaaagtcctttctacgctgcatgcatgtgatggagccacatccaactgcagtcccacttcacctccaaataacaactgtccctctctttccttcctcacattatacacaataaggattaaggagagtgagatgactcgataggtcatccagagttttagaacttaatttcgtatttagaagcctctaatagcttttttaatttttttttgatttgcgtgcgcagtctagaagtttttccagaaagcttttatgttaaaaactgataaaatatgaaattttccttaaaaatttatttgaattaacttcggtcaacgtttcgagcaaacagacccgaatccatattttggcagtcccaatgggtccatatcgtgatttggtacctgggcgtatacttgaaatcgaattcggaggtccctagcttgagttattgatttttgtcgaaaattaaaagtttaaaggttaatgatttttaagaattgaccgatatttgattttgttgatatcgggtccgtattttggttccggagtccggtataggtccattactatatttatgactcgtctgtcaaatttggtgagaaatggagttggtttgacgtgatttggacgttcggttgttaaaatagtagttttaaagttttcttgagaatttcatttgatttggagtccgattcgtagttctaggcgtcattttggtgttttgatcgcgcgagcgagttcgtatgaggtttgtgggcttgtatgtataattggtttgagccccgatggctcgggtgaatttcgaataggctacaaatggttttagatttagaaaatctggtttttcttcagcttcagctgtcatctagtttccttcttcgcgatcgcgaagagtgatcagggcagggtgggatttacttcatcgcgaacgtaatggttgggtcgcgaacgcagagtgttaggggttttaccctcagcaaacgtgaacagcctctcgtgaacgcgtagttttagggacctggtgttgatacccaatttttccctatgtatttcttttacatgcaaatactttcagatatcatagacatacatatataagtatgcccaagtgttttagtatttttcctattttttaagagatttttaaattgatttattgctcaataattattcccaaaattatcactttggtgaataacttattttattctcatatttataccaaaatataggtaggttacttttcatatatttttacaaattaatttggtattttaaaagctaaattgcatataattgcaattttagcctcctttaagatttaatagcattttataattatgaaactggttccaatatttttaaattaatattcatatactattaacggatccagtgcttttaatttatttttaatttgctttcaaaatcattttttactaattttataaaataaaaagggaaaactggctatttaaattttggcctcagttcgtttcaattgtagccccattacatttcgattttagcctaaaattgacccaaattcaaattcaaatttggaccatcccaattccttttgacccaacccctaacccaactcaaacgacccaacccggttccccacctaccttcttaaatctaggccgttgatcattcggatcaacgaccactattcgccctaccataattaaacacaggtgactaccctaatccctcattctcacttggcccgcttcctttgaatcctaaaccctctcaaatcctctcaaaaactctccgaaaccctagcctcctcctacccccttttcaaccaccggtcaccggaatccatggcttctcaggccatggatagttggtactcacctatcttcaccagtaagccagggttgttcgaagcttcgaggcctgaccttgacgattccctctccgatcttctcagacctttgatttcatggctcctccggccatgctccggcatattcaagacttaggagcctgattcttgacctctccgactcaagatcagacctgtttccaagcctttctcatttctagggtttctccgaaaccctaagctattcaaggtcctttcaccgttattttcttagatctatactgtatctatacttttcttgccatctaaagtgttttccccaaaagtttcttttcaaaatcgtttctcttcgattttagggtttctgaaaggattttttgggaaaaatctttctgatttttcttcttctttactttatgtgtgtttgtccataccctgctggtgtgattactctttattacgcatgtactatcttctaccttttcttttctgctatgcatgttactcctgttaatccctgcttagttttctttactcttttactatgtgtatttaccgttaagttatttgatcttgtttactggactctgttcatgttcttacatgcttcatctacttgtgttcacgtttgtattatctccttcttctgaacttgtttagcttccgagttttctcaaatatgttcttcatgatttttcttcctttgtcattcaaacgtgctatcatatctattttgttgagactctgaaacaaatgacttgctttctcacttccatgtctgattcaattttgaaaccctaggatttggggggtttcctttgacgattttgatttttgtgttcgagttaaggctacactttgggaccctgaactctcagactcactatgagtctgcaaattgaacctgtatctttttgcttatgattctgaacttctcttcgatcaaactctcttctaaataatttgacagcctcttcttgattcacatatttgtgtcctttatatatgagaactcttctttcaaaaggttttgccaactactaattgatttcgaattcctttaatggtgtttacttgattgctactgattttccctaattgaacctttctttaccctttttctgacttggttcattcgaacaaagcttgtagctttgattttactggctatttgattaattccctttccttatttttcacaaaccatgtaccattggacttttgccttaaataaaccctgtgtatttacccttattatgttactttggaaaaggttttaatcaaattctttccgtaattgtcttatgcccattcgaaagcagaatcccttaaccaaagggagactttatgtgattgattgcaaactatttccttaccttttcttacttgttttctgcactataaaaggggactacccttctacacttgaacacactttgaattgcatactcttacacacacacactcaattacaatactctttcaattctctactctcttctaagatcttttgtactgcttgcttgcaatttggcttacaagacttctgctttcacttatttgtttccctgaaactcgtatgtcctaattttaattccagcatcatccctatgtgtttactttacagttgcgacactcttggctattttcctgttcatgttttgtattgaatatgctactctctctttgcatctgctgtttgttgtgaattccccatacccctactcccttctatatgtttgagttaaggtttatggctgtgagcacgtgatttttgtttcgcacgacaatcgctccaaaagaaataataaaataataataattggccccactgtacaaattttggattttttacatggcactttgttggttatttgcgatttttgcccatttttactttattaaaacaaaatacaaaaaatgtgtgtgtcatgcataattcgaaccgtaatccggtcgttaaatagaaaatcatgaataggcatcttcgtccgtgattttattttgtttgattttacctgttttgaattatttttagtgtgtgtgcaaataattgtgttgagtgtgtatttaattttaatttgatttttgcttagttttgtttttttaaaaataaataagaataataaaaaaaaagaccctttcttccgaattgggccaatttattaaaattggcccaaacaagcaatgcccaaaccaggcctgcccggtccagtccagctgatgcccagagagtccaaacgacgtcgtttgggtcgtgcctgatctgggccgttgatctcagagtgatcaacggccaagatcaattccccataacccaccaataaacccgacccgtctcacccggaccgaccccaaccctttacccttgaaacgacaccgttccacttaagccatcagatccagaccgtagatctagattgatctaacggttgagatcaatccacccactaactatataagttcataaccttaccctgcccccctatccaataccccagccttcgtctccacagaccaggcccctaaaccctagccgcccctgtatactttcgccatgaaagccggcggcatggacgccggtgaccttccccttaacaccctagaacccccttgccatcctaaacatggatctgttaaccatgtagttcgaatccctccccaccttctcgaatcttcattcgaagattcgagtcaaaactcgatctacacagtttaaccccagtttcacaccagacactccccagacccccctcgtgaccaaaccatacttggtttggtccgagtctgaccagggaagcatgaatcccggatctgagttttggaactttgtagttcttcatcactggcccatgtccgtccgagccaaagagattaaggtctaatggaccttaatcgaagtgtttctcatctgagaaacacttcgattaaagtccgttcagccttaagaaaggtctgtccaaatccgagttcaaacttttaacttttcaagttttaaggtgagtctgctttctttcctttatttgttttagtccgtgtgatttgttttaaaagtctgttcatatttgttttaattttatcaacttttgtttgtccactttacttgaacctctgtgtttgtctgaatcccccctcctattctgataaggcatgtgcattggttgtattccaaatttgtactgactaactgattcctcgaagtataattttgtttaatcagtataagtcgagtcatgtgtcccatgcttttgaatgtctgatttttggctacgcttgtgtatgttaatgctaatatagtcgagtcgacatgtgtcgtcaattagttttagctatccgaacaataacaaatcgacttacttctgctaagcatttgatgaatcaattaagaaccagttttggtttacctatagctgtttgaattgatcagtaatgtaaaagggatgtttggtttaaattctgaattggaaggcatgtgcactcgtgcacaacatgtgcattggtgcacctcatgtgctttgtgcacagcctgtggcctgcataaaggtctttgttaagttttaaacaatttgacagaatatgctgtcagatatattctactgcccataccttgctttaagtttaaaaagtattaaaccttttacaagttaagtctgccagggaatgttgatggaggttatatacttaaaaaactaattggaatctaaaaaggggaaggcacatgggagggtactgtgatattctaaaacaggctgttaaaaggggtagtgtttaggcttataaagaggaggacttgggagatagagaacgggagcagatctgagaaaagacagacctaagagaggattagaggttagagaaccctgaaaatttacagaagagaaatacatacactgtgaggatagaaaagaaaaaagaaagagttgacagaaatagaaagagagcaagaaagagataaaacagattaggaaatcagaaatttggtcttgtttgtctgaacttcatctattgtcaatacattaggcagtgttgcttcttctaaatttcaatcgagattattgttagtgttttgttgcatttggtatattccggaattggattgtctggagcattgttgccatcacactgtgtgctatttcgtttggctgtttttttcttcaactctagttccacctcgcaaaagaatcttttctgttgtgctgttctgattgctgctgctattctgctcactattgttgctgccctgtcctgctgctattgctagtcctgtttctttctgctgctgatttccacatcttcttcttcttctcctttgcattttcagcatttccaggtacacatttcaagtcccatattgatgtaattaaaatagttggaaagcatgaaatgaaaaaaggttgaagaagttcaagtatttgttgtaatattcatagtacattaacaggcctgtgaaaattgattagtttataattcaacagttcgaaagtatgtactgatattcgactgagtttaccctgttgtattttagctcggtagttgtttgtcagtaggggcatgtatacttcgtccttatacaatactgctcctgtttcatttagtcttttttagttaagactagtccacataagtttagttaagttcaactcgagaagtgttcggattaagtgttgtatttcgtttagctcgtacatgattccttgtcaaactaaagtattttactttgctagttatcctttaatctagtccaaataagttcagttaagttcaactcaagaaatgttcggattaagtattgcatttcatcaatctcatatgtaatcttttgttcgaccaaaacattctcgcaaggcatgacgttttttactttataagtagttaatcagaaactgacaagaatccggattaggcaaaagcctataattgaattagcatgtaccttttcttctagttttagagacaaatgcattagaaatgtagccactttaggatatcctttctaaaatagagatgagcctcgccaaataaagatgcaaaattgcggggccctcaataaataaccatgataattatttagaattcaggataggccatttaataaatttcatggccttctacaaagataataacgcgttagattctttaggagcgactttaagtaaactatattcttaaaatcgggtgcattgactgtgacgtggtttgagatgcatttctacgacgttgcaattctataaaaataatgataataataaaagcgatttaaacttaataaaagcacataagacacaacatgtatttaaatcagatatttagccattataacaatttaagcgaccgtgctagaaccacgggattcgagggtgcctaacaccttccctcgggtcaacagaattccttacttagaatttctggttcgcagacttcatttggaaaagtcaaaaatttcctcgatttgggattcataataaaccggtgacttgggacaccaaaaaccaaacctttcccaagtggcgactctgaattaaataaataatcccatttcgaatattgtcacttaaattggaaaaactccacccgcgcatcttacccctcggggcgggcgcgcaaaaaggaggtgtgacagctctggcgactctgctggggatgtaacccagaaccactggttcagggttcaagaattcgagcttagaataattgttatatttggctttattatctgatctttattacatgtttttgcataacgtgctaaatgttgtcttttaccgctttgatattatctgaactgtatataaactgtgccgaaacccttctcttctcaccttcggggagaagctcgctggtcgagactccctattctgttagtgtcaatacctgaaataagaaagaggtcggacaaattacaaagccggacgatctcgcgggtccccggtacgtagccctctcctcgactcgagttgtccgctcgggtacccagtcgagaacaaatacccaggttacgaacctagaataacttgacttcatgccggatccctagtaggaacgtttatttgcatcatgttgcatttaacttagggggctcaacacaggggttgggtccgtctaggacagacaacctgaaatgaaaagaccatcctgctacatcttgtttgttttgcgcatttatttgcttcagatctgcatgctgaccggtttctaaaaaggggaaaaatagcagcgtagggagataattacttatttttggaaaaataaaaccaatgtccaagtagtgtcaaaaccttgccgaaatttttctaaaaaaaaatgaaaacaaaaactatctttttattgagagttattaaaaaaaaatatataaaaatttttcttttatcgctttcaaaatcaaaaaaagaaaaagaaaaggtatttattttaaaaaaaaaatgtgttgtttcttttgtagtaccccttttataaattcagactaatagtccgaatattgcctagaaaagaaaatatttttctttagtctttatcttttttcaaaaaataataaaaatacttattcttgatttctaggtttgtttgattttctctattcatgatatgcccgaactacgccggtttgattctcaccggatgtgagatacgtaggcaaccctcgtcgggttcaaccccatttttgctaaaatagccaaaatcaataaatatataaaaaatgtgtcaaagagtcgtaaataaatcgggtgacgttgttttgtcataaatagccgaatgttcctgaaagggacgccggaaggctgactttgtctaaatagccacctttgggtcttatttagcatttttacccagtagacccacacagccttaaaatcttcatccccgaagtgtttaaaggccgtgttcaaaacttgatcccctctgtaaaaatatttttgagtcagtcattcttgttaaaatcaccttaataaatgtgcaggatgagcacgatgcaaaatgaacatttttcaataatgaccaaaatccctgtcaagttacggctatggtggaatgatctaggtgttgaaggacaaaatgaggttaagaaatatctgaaaggtcttgtgggtctgttggaaatccaacctcggggagatatcataagggctttggttacctattgggacccggcgcacaatgttttccatttctctgattttgaattcaccccgactttggaagaaatggccggatacatcgggaatgctgagcttcccttgagggaaaaatacttggtcgccccaagagtcgtcacggtacatcggttcctggattcattgaaaatacctagaacagtccacaacccggatctagcagccggattctgtactccatgcttcatatatgataggtacggtcacgaggggggattcaataatccaatcaacaaactgtgcagcaaaggagttcgtcagaagtgggacgagcacagacgggtagcgttcatgataatgttcctaggtcttctggtatttccgaggaaagatggaaacattgatttgaagatatctggggtcgtcagcactttactcacgcaaagtgacagtactctcgcgccaatggtggtatctgacatctttcgagctctcacagcttgtaaagctgggggaaatttcttcgaaggttgtaacttgctcctacagatatggatgaccgagcacctctgccatcgttccgagatgttgagccatggttccccggaaaagacccgcatagaagaatcttacgcgagaatcaaagagatcatttggcccaaaggagtcctggcatggacctcgttcttacaagctcttactgccagccaaatacaatggacgttgggatggttgccttttgatgagatcttatatatgtcggcagctaaaactcatttcttgctgatggggcttaagagcattcaaccttacgcacccggctgagttttgagacagttcatttcttagcactcaagcagtcgagataagtcctaacggacagttcccagaagcaaagattcgccaaatctggaacgagggtcaatatttgaaatcagatacttgcgtgcgggatctcgccaaaggagaaacggcgccaggttaccttgcatggtatagaagggaactcgagcatgaaaggccagctaagagaccccacatccggaatttcaccgactcatcgcaaaggcattgggattgggtagcaaaggaaagaggctattgtgctgaaatcagcaggttaaagcaacaagtagaaggcatgaaatacgagcacaacgtgcaaattgctaccgatctaggagaacggaacaggttaattcaagaaaatgaaatgctcagagcccagatcaaacagataaggttggatgcagataaacagccaaggcgtcgatcagacgagcacctgataaaaaggctaaaaagcgagatcagagaatggcaagatggtttggagaaatctgaaaacgtcatagcagagctcaaagcacagtgggatacaagagcagataagcatcgtcgatacctgaatcaattggaagacgaccacgaaaaaactattgctaaaataaagagagagatggctgcacttgagatcaaagcggttaatcaggccaagaatttccaaattgagagcagatactggtgcgactcaatagcctagatgaagttggaagtacggcgactaaagcatcagcatgtacaagatgctcaagtcttcgagatatgcagcaatcagataaaacgcctgctcgtagagaagaagcaaaccagagataggatcaaggctattgcccatgccatcaccagacgatgtctacgatgtgagaacatgtccagcgttaccgtcctctcggcagtaatgggttatgtcaagcagactatgcacgagctggagcaacttgagaaggatatcacgcctaaggccgcggcgaggccgaacgatgccccgcggaaaccaatttttaaaaccataatgcactcataagtcaaatctgtatcttagcactttccgcctgggtgatttttagtctattttttgagtctagttttattttcaaagtttgctctttcttttgcaaaatgtagcttgtaatagaacgtttcaacaataaagaggttttcttttacgctcatttgcgtttttcgaactacgtaatgatctgattcacgtaggcatcatgatacgtaggcaatcctcatcggatccggtcgcatttcttttactgcaaaataaaacaaaaagaaaaaaaaagaagaaaaaggaaagaaaggaaaaactaataaaaggaaaaatgccggaatgacgcatgctctcgtagcaaacatatagtaatctacttaactgtataggtgcatcatgcccaacgtgagattaactatctgttatttgctacaaattaaccgtgcgtttgtcgttgagtatttccagggtttttgaaaggacggttggtttggtgaaagtctggcctcgcactcatatttcacgaggtcaaggagaagtgttcaactacctgttgttagggccagaagcagtactcacacttacttcaccaggtcaaaaggaagtgtggaaatgtctttagaaattccattgcaaacaatccctgtttccgaggaaagctcgatctcaaccgtcctcacacctgaatccacaactgcggaggaaaataggatcctacggctccgcatgttggaaatgctggacgactggaacaacgggaaagagccgccaagtgtcgtccccggattccctgaattattctccaggtcaagtggaacgtctaatgtccccataaattatcctgctactccatttgggtacccagccacctcagccttctctgctggatcgccttctgagcctcatccccgaatgtcggccaccgatgcaagcatgaacatctttactgcatcgccttgcccggttacggcacaacctaccacatacaagccaagctttgactcatcctcttttacattccaagcaccatcgttctcaatggaaccaaccaggttcgctaccaacactaatcctctaccgcctcagtgcgagcttgcacccgggcaggatcagaaccccagaattgcagaacaaaatgagattgccaagagaatgagaagccttgaacaaagtttgaagaatatgtaaggattgagcggacaaaaaagcgtctcttacgccgacctgtgcatgttccctcacgtgcacctgccaacgggtttcaagacccctaagttcgagaaatacgatgggcacggtgaccccattgcgcatcttaagaaatactgcaaccaattgcggggagccggcggaaaagaagaactgctaatcgcatattttggggaaagtctagtagggatagcttcgaaatggtatatggatcaggaaatgtcccgatggcatatatgggatgatctcgccagagattttgtaaaacaattccagtataacatcgacattgcaccagaccgaaactctctgtcgaatttgaaaaagaaaccttcggaaagctttagaaaatatgctattaagtggcgtgaataggcgtcgagagtaaagcctcccatggatgaagtggaaatggtcactacctttctccaggctcaagcgtctgactatttccaaaacatgatgtcggccatgggtaagccattcgcggaagcgatcaagattggagagatggtggaaaataggttgaaaacgggtaggattctgagtcaagcagccataagggcaacttcccaggccatccaaagcgggtctggaggaacgacgagggggaagaagaaggaagaaacgactatggcagcctctgaagcaagggagtatcgtcatcccaggcccaattttccggaaagagccccacaacactattacccccactcaaatttggcatatgctcatcagccttatatggtcatgaatgcccaaccttataaccatccaccacaacaagccaaccgaggcccagctccacctcccagaaatcagcctccttaccgcaaccactataacccacaacccccgcagaataactaccgcccccaggagccacctcgacggcggacttttactcccatcggtgaacaatactctactttgttccctaagctagtccagttgggtttcttgcaaccaattccccaaacgaggcaaaacccaacatcgccttcttacaaagccggagtcagatgcgcctatcattcaggagccgagggacatgatacaaacgactgctggtcattgaaaagagtggtcgaaaatttgatagagtaggggaaaatagtgctaagggacgaagagatcccaaatgtgactaacaatccattgcccgctcacaataatgggccgctgatcggcatgatttgtgaagacaaagagttcaaccctgctttgaaagccataattgccattgtcgacacggggaagaggcctgaaatagaccagaaatcagaaaagggggaggaggccaaggctgtaaagagcaagcctgaaaagaaggtggagaagaaagtggtaccagcaaagggtggagttctttacataccacgaggtcaagccgagaagacgcacaacttcgggatcaaaaagacaagacctatgtacgtgccgaaaggggcctatgtggtccgggggacgattcaaccacctcggctgaatgagccagtggttatcagacgcgtgccacaaaagccaatgaccaacccgtccacagtaccgtggaattatcaaaagactttggtaatgtacaaaggtaaagaggtcatgggagaacttccaagaaatactttcattggagggtactcaaatacccaagaactgaacaacgccacacaaaggcgcttccctccaaagaagcctgtgagtgttgaagaagcggaagtgttcttccaacaaatgaagatgccggattacgaagtgatagatcagctgcgcaagtaccctgagcaagtatccatgctgtcattattgatgaggtcgactgagcatcaaaagatcctattgaaaaccctgaatgaagcatatgtaccagttgaaacctcggtggaacaactagagcagatgacagaaagattcttcgctgtcaaccaaatctctttcagcaaaaatgatttacccccagaaggagcagcacacaacaaggccttgcatttaacagttaaatgcgaggactactatgtcaagagggtaatgttggatggaggctcaggcgttgacatttgcccgctctccacgctacaaagaatggaaattaggactggaagaatccgacccaacaatgtctgcgtaagagctttcgacggcatcaagagagataccatgggagaaatagacctgttgttggtcataggaccagtcgaattttgagtaaccttccaggtgatcgacatggacacatcctacaatttcctccttggcagaccttggatccatgcggcaggagccgtaccttccactcttcaccagatggtgaagttcgagtacgaagaccgagagatcgtggtccatagggaagatgagcatgccatttatcgggacccatccatcccgtaccttgaaccaagagaaggaagcgaacatacggtctatcaagctttcgaggtcgtactggcagagcagtacgaagagggaataccctgcccccagcctttcttgtctaatgcctcggttatggtggccaaagagatgatccggcacggatttaggccagggaagggacttggacgaacccttcagggaataacagaacccattactttgccagtcatcaagaaaccttttggactaggcttcaaacctactccagcagacgaagaatgggcaaagaagaggagagatgagggctggaagttacctcaaccactgccggatttatatgcaactttcatcgggccaaggtacgttgaagaagatgatgaggtcttaacagctgaggaaatcgaggatatatgtggggcaatgagggaaatgctctacgagatccacatggtccaaccaggtgaaggaacgagcactgcagagatgctgtacatggggccgagcgcccaactccaaaactgggaggccacgccattcccgactagacggaagtccggttagacatgtcctgccacctttactgtgtcacaagttatcccaggacataacttgaacgttttcttcttttcaattgttgctttgaattcctagtcgtaaacattgctgtcttccaactttccaaagaaaatatatataaaaaaatcatcattgctttcctattctttcttttgttctgatttttattagttttccttttatcttccttttcagtcctaataatgcggctttaaatatgacatgcttgcggacttcacgcccagatcacaatgagttatttaactgcgaattaatgaacccagaaccagaatatgatgcggaggaggcttttagggagataaactgagagttggaatatttcgagaataaacctaagccaaatctgaatgacactgaaccagtaaacttaggaaccccggaagaagtccgggagaccaagataagcattcacacggacaagaaaacgcgagaggcgataattcaacttcttcttgaattcaaagacgtgtttgcttggtcatatgatgacatgccgggactaggtgttgatctagtggttcataaattgcagattcatcctgattgtcctccagttcaacaaaagcaacgaaagttcaaaactgaggtcagtgacaagattaaagaggagatcaccaagcagctgaaaacaggagtgatccgggtagtccaatatacaacatggttggcgaatgtggttccagtaccaaaaaaggacgggaaaactcgagtatgtgtagattaccgagatctgaacagagcaagtcctaaagacaatttcccgttgcccaacatccacatcctcaggtactgatggatgaagaggacgccgagaaaactgctttcaccacgccttggggcacctactgttaccgggtcatgccatttggtctgaagaatgctggggctacttacatgagggccatgacatgatgcaccaggaaatagaggtgtacatggatgacgtgatagtaaagtctaggacgcaggataatcacatccaagacttgaggaagttcttcgagaggctaaggaagtatgacttgaagctgaacccagctaaatgtgctttcggagttccgtcgggcaaacttttgggcttcatcgtaagcaggagaggaatcgagctatatccaactaagataaaatccatcagagacctacctcccccgagaacaaagaaagacgtgatgagtcttttgggcaggttgaattacatcagtaggttcattgcccagctgacaagcacgtgcgagcccatattcaagctgttaaggaaagacgcggcgatcaaatggacagttgagtgtcaagaagcctttgataaagtcaaagaatacctttcgaatcccccggtcttggtccctccagaaccaggaaggccactcttcttgtatctgacagtcttggagaactctttcggctgcgtcctcgggcaacacgacgtaaccggaaagaaggagcaggcaatttactacttgagcaagaaattcaccggctacgaggccaaatacactctgctggaaagaacatgttgtgctctcacatgggttgctcaaaagctgagacattatctccaagcccacaccacgttcctcataagcaggttggatcctttgaagtatatatttcagaaaccaatgcctactgggagactggctaaatggcaaattttgcttacggaattcgacatagtttatgtcactcgcacggcaatgaaagcccaggcattagcagatcatttggccgaaaatccggtcgatgaggaataccagcgattggatacctactttccagatgaagaggtaaacaccgtagaagtgatctcggaggaagctcatgtttggaagatgttctttgaaggagccatgaacgccaagggtgtagggattggggcaatattgatatcgccttccggtcagcattatcccgccacagctagactgcgtttcttttgcacaaataatacagctgagtatgaagcctgcattatgggcatgcatatggcaatcgatcaggatgtcgaagacttactgattatgggagattctgacctgatcatccggcaagctcaaggcgaatgggaaactcgggatgtcaaacttatcccataccaacaacatgtggaggacctcagcaagcgctttacatcaatagaattcaggtacattccgaggtgtcacaatgaactggcagatgcacttgctactttggcttcaatgctaccttacccgggcaacgcccacgtcgatcctttggaaatccaaatcaaggaaagacacggttactgcagtgtaatcgaggcgggatcaaatacgcagccttggtaccatgacatcaagaggttcctgaagacgcaagaataccccgagcacgctactggagatcaaaagaggaccattaggcaacatgcaagtggtttctttttgagcggtgaattgttatataagaggaccccggacctcaatctcctaagatgtgtcaatatcgaggaagcgaaaaagatcatgcacgaagtacacgcaggtgtgtgcggacctcacatgaacgggtatgtcttagcgaagaaaatccttagagcaggttactactggatgaccatggaaaatgattgctttagcttcgttcggaaatgtcatcagtgtcaggtgcacggtgatttgattcatgcacctcccacggaactgcatcccatgtccgcaccttggccatttgtcgcttggggcatggacgtcattggaccaattgaaccaaaggcctcgaatggacacaggtttatattggttgccatagactacttcacaaaatgggtagaggctataaccctcaagtcggtcactaagaaagctgtggtggattttgtacactcaaatcttatctgtcgcttcggtattcctgcgactatcattacagataacgcagcaaacttgaacagtcacttgatgggagatgtatgcgagcaattcagaataacgcataggaattccacgccttatcggccaaaggccaatggtgctgtggaagcggcaaacaaaaacatcaagaagattttgaggaagaccatccaaagttcccgacagtggcatgagcagttaccatttgcattattagggtaccgcactatggtacgcacatcggtgggagcgactccttatcttttggtttatgggaccgaggctgtaataccggcagaggtagaaattccttcgcttcgaatcattgtcgaagcagaaatcgaggacagcgagtgggtcaagactcggttagagcaattgactttgattgatgaaaagcgaatggccgcaatttgtcacggacagttataccaacgaaggatggcccgtgcttacaacaagaaagtccgaccccggaatttcgaagtaggacaattggtactgaggcgtattctgccgcatcatgaggaagcaaaagggaagtttgctccgaattggaaaggcccatacattgtaaggaagatattgccaagaggagcattgtatctaggtgatatcgaaggaaatgaccccgacacagcagtaaatgcagatgcagtcaagaggtactacgtctaaatcatactccagtggtcctgacacgtttgaaaatggcgaaggttttattccccactactccccaaacactacccaattctctctaccaacttttgagccgcttacaaaacaaaaaaaacaaaaaaaaagagaagaaaacaaaacaaaacattgattgaggcctgaactacgtttgacttgattccgaaaggatacgtaggcagcctctccctgaggttcagtcacaccaacaataaaatcccattcaccctgaaattgaaaaccggggcacgtcgagcagttgagaagttagtatcatctacctctctttaccgagtacaagccttcaaatcaattaccaaatgtggtgggaaacccataagcgtcgcaaatggagaccagcacactctgaattgagagaggtaaaatgagagagtctcgtcggtgaaaaccttcgggcaccacgaggaaacgggagtaaagaaaccaaaatgagagagcttgtttagtaaaaactcgcaaagagtgctatcaagagatgacaggaagagaaatgagagaggtcagccagcgaaaacccgcaaagggcgctgttggccgaaaaggaatgactccaccccaaggaggtctcggcaaagttccaccaggtttggaatcacagatccgttctggtccagagaaacgcaagttcgtggaatatcaggcgtccagtccaaagagcatgtcatgtcatctaaagccagcgttatcttcctcagataagtctttttctcgtcccgaaaagggcactcccttcccaaaatttgttttctcctcaaaccccttttgtgttttaaccccaagttcaggatacaccggaaaggacaggtggcaggtttgtttgcacggaattccgtctcatgaaggaaagcgcctcgtttcgttggtacgattgcccaagcttgatggatcatgacgtttgatggtgtttaaagaggaaagagagaaatcctccccagcaagtccgccttcaaataaatccccacagagtctccccctgtacaaatccccacagagtctctcctattgtacaatctcccacagagtctccccaatatacaaaaaataaaaaataaaaaaaatggaatctccccagcatatcccagcgagtccttttgtaaaaattccccagcaagcttaccccaacaaatcctagaaatcccgctttgaaataaatccccagcatgccccattgtacaaaaatccacacaaaggatccactttgtaaatattccccacagagcttcctttttgtacaaattcccacaaaatacctccaataaaatccccgttgagaacctccaagcaaaacgggacacacaaaaaaaaagaaaaaaagagccttacgaagcaagtcatcacagaatccggaaatacaagcctgagcagtctaaaagtttcgccattcgaatcaaatcaatggcgggacttcgcaacaaaaatagagacgcaacaaagcaattgggaacgatcaaggtcaccgaaccgaccgtcatttccgaactaacaattgttctttgtctgaaaagttgaaacaggtataatccaagacaaccgtgcaagaagcaggtgtcgcccaaagaagaaggtacacgggtacaagaaacattttggcaataaggaattcactcaaaaggtaagttcccgcaaaactcccttttatcttctattaaaacaagaaaactcaaaaaaatagatcgtgtagtattctcgaactttatccccagccaatcagcattagggttttaaaccctaaactgaattttccttttagtcagcattagggttttaaaaccctaaactgaactttttcctttcagccagcattagggttttaaacctaaactgagctttttccatgcaatcagcattagggttttaaaccctaaactgaactttttcctttcagccagcattagggttttaaaccctaaactgagcttttccatgcaatcagcattagggttttaaaccctaaactgaatttttcctttagtcagcattagggttttaaaccctaaactgaactttttcctttcagccagcattagggttttaaaccctaaactgagcttttccatgcaatcagcattagggttttaaaccctaaactgaattttccttttagtcagcattagggttttaaaccctaaactgaactttttccattcagccagcattagggttttaaaccctaaactgaatttttcctttagtcagcattagggttttaaaccctaaactgaactttttcctttcagtcagcattagggttttaaaccctaaactgagcttttccatgcaatcagcattagggttttaaaccctaaactgaattttccttttagtcagcattagggttttaaaccctaaactgaactttttcctttagccagcattagggttttaaaccctaaactgaattttccttttaatcagcattagggttttaaaccctaaactgaatctttctttagtcaggttttaaaccctaaactgactttttcctttagtcagcattagggttttaaaccctaaactgaactttttcctttcagccagcattagggttttaaaccctaaactgagcttttccatgcaatcagcattagggttttaaaccctaaactgaattttccttttagtcagcattagggttttaaaccctaaactgaactttttcctttagccagcattagggttttaaaccctaaactgaattttccttttaatcaacattagggttttaaaccctaaactgaatctttctttagtcaggttttacaccctaaactgaattcttcctttgcaaagcgttggggtgttaaaccctaaaccgaacctttccccagctagtcggtattagggctccaaccctgaactgagcatgcatatcctctttcatcaattttatgaacttcctggcgaataattaacaaaattttcctagtgaaactggggcagaaaatttcgttcgtttgttttctcccgcaggtctaacctcgagccacatggatcgaaacgacccatgagatgagtcccagttcggaatcaaagaaaaaaaaaagagagagaagatgtcccgagatatcggaaggcagattgactccaacatttgattaagatcctgaaccctgccgatcgcatctcactcagtatcccagaggttaaacaagtcgccgtgacttgcaagcatcaagattcagatcgaagtctacaagcagaatcagctaagacccaagatcaagtcgtaaaagaatcatagataggaatcttgtaactagcagttgacatgcatataagtagttagttcagtttccaattttcgtttggttgtaataaggcgtttagtgatacagcagtgacaacagcaacagcagtagcagcaagcattgcaatcccatggtagtcccagctaccaaaacttctcgaactacattgacctgattcctgtttagcccaggatatgtaggaaatctttgaagcaagattcggtcagatctttcaaaaacatgcttcatacggagtggtccataggcaaaaatcgctcatacacgctcactttatctttgcacggaaactcttcgtgtttccgaacaaagaggggcagctgtgagcacatgatttttgtttcgcacgacaatcgctccaaaagaaataaaaaaataataataattggccccgctgtacaaattttggattttttacatggcactttgttggttatttgcgatttttgcccatttttactttattaaaacaaaatacaaaaaatgtgtgtgtcatgcataactcgaaccgtaatccggtcgttaaatagaaaatcatgaataggcatcttcgtccgtgattttattttgtttgattttacctgttttgaaatatttttagtgtgtgtgcaaataattgtgttgagtgtgtatttaattttaatttgatttttgcttagttttgtttttttttaaaataaataagattaaaaaaaaagaccctttcttccgaattgggccaatttattaaaattggcccaaacaagcaatgcccaaaccaggcctgcccggtccagtccagctgatgcccagagagtccaaatgacgtcgtttgggtcgtgcctgatctgggccgttgatctcagagtgatcaacggccaagatcaattccccataacccaccaataaacccgacccgtcacacccggaccgacccaaccctttacccttgaaacgacaccgttccacttaagccatcagatccagaccgtagatctagattgatctaacggttgagatcaatccacccactaactatataagttcataaccttaccctgccccccctatccaataccccagccttcgtctccacaaaccaggcccctaaaccatagccgcccctgtatactttcgccatgaaagccggcggcatggacgccggtgaacttccccttaacaccctagaaccccctttgccatcttgaacatggatctgttaaccatgtagttcgaatccctctccaccttctcgaatcttcattcgaagattcgagtcaaaactcgatctacacagtttaaccccagtttcacaccagacactccccagacccccctcgtgaccaaaccatacttggtttgttccgaatctgaccagggaagcatgaatcccggatctgagttttggaactttgtagttcttcaccactggcccatgtccgtctgagacaaagatattaaggtctaatggaccttaatcgaattgtttctcatctgagaaacacttcgattaaagtccgttcagccttaagaaaggtctgtccaaatccgagttcaaacttttaacttttcaagttttaaggtgagtcttctttctttcctttatttgttttagtccgtgtgatttgttttaaaagtctgttcatatttgttttaattttatcaacttttgtttgtccactttacttgaacctctgtgtttgtctgaatccccccctcctattctgataaggcatgtgcattggttgtattccaaatttgtactgactaactgattcctcgaagtataattctgtttaatcagtataagtcgagtcatgtgtcccatgcttttgaatgtctgatttttggatacgcttgtgtatgttaatgctaatatagtcgagtcgacatgtgtcgtcaattagtttcagctatccgaacaataacaaatcgacttacttctgctaagcatttgatgaatcaattaagaaccagttttggtttacctatagctgtttgaattgatcagtaatgtaaaagggatgtttggtttaaattctgaattggaaggcatgtgcactcgtgcacagcatgtgcattggtgcacctcatgtgctttgtgcacagcctgtggcctgcataaaggtctttgttaagttttaaacaatttgacagcatatgctgtcagatatattctactgcccataccttgctttaagtttaaaaagtattaaaccttttaaaagttaagtctgccagggaatgttgatggaggttatatacttaaataactaattggaatctaaaaaggggaagacacatgggagggtactgtgatattctaaaacaagctttaaaaggggtagtgtttaggcttataaagaggaggacttgggagatagataacgggagcagatctgagaaaagacagacctaagagaggattagaggttagagaaccctgaaaatttacagaagagaaatacacacactgtgaggatagaaaagaaaaaagaaagagttgacagaaatagaaagagagcaagaaagagataaaacagattaggaaatcagaaatttggtcttgtttgtctgaacttcatctattgtcaatacattaggcagtgttgcttcttctaaatttcaatcgagattattgttagtgttttgttgcatttggtatattccggaattggattgtctggagcattgttgccatcacactgtgtgctatttcgtttggctgtttttttcttcaactctagttctacctcgcaaaagaatcttttctgttgtgctgttctgattgctgctgctattctgctaactattgttgctgccctgtcctgctgctattgctagtcctgtttctttctgctgctgatttccacatcttcttcttcttctcctttgcattttcagcatttccaggtacacatttcaagtcccatattgatgtaattaaaacagttggaaagcatgaaatgaaaaaaggttgaagaagttcaagtatttgttgtaatattcatagtacattaacaggcttgtgaaaattgattagtttataattcaacagttcaaaagtatgtactgatattcgactgagtttaccctgttgtattttagatcggtagttgtttgtcagtaggggcatgtatacttcgaccttatacaatactgctcctgtttcatttagtcttttttatttaagactagtccacataagtttagttaagttcaactcgagaagtgttcggattaagtgttgtatttcgtttagctcgtacatgattccttgtcaaactaaagtattttactttgccagttatcctttaatctagtccaaataagttcagttaagttcaactcaagaaatgttcggattaagtattgcatttcatcaatctcatatgtaatcttttgttcgaccaaaacattctcgcaaggcatgacgttttttactttataagtagttaatcagaaactgacaagaatccggattaggcaaaagcctataattgaattagcatgtaccttttcttctagttttagagacaaatgcattagaaatgtagccactttaggatatcctttctaaaatagagatgaacctcgccaaataaagatgcaaaattgcggggccctcaataaataaccatgataattatttagaattcaggataggccatttaataaatttcatggccttctacaaagataataatgcgttagattctttaggagtgactttaagtaaactatattcttaaaatcgggtgcacattgatgtgacccaaatccaagtctcgacggagtcaaatgtgttaacaactacgggtgcattgactgtgacgtggtttgagatgcatttctacgacgttgcaattctataaaaataatgataataataaaagcggtttaaacttaataaaagcacataagacacaacatgtatttaaatcagatatttagccattataacaatttaagcgaccgtgctagaaccacgggattcgagggtgcctaacaccttccctcgggtcaacagaattccttacttagaatttctggttcgcagacttcatttggaaaagtcgaaaatttcctcgatttgggattcaagataaaccggtgacttgggacaccaaaaaccaaacctttcccaagtgacgactctgaattaaataaataatcccatttcgaatattgtcacttaaattggaaaaactccacccgcgcatcttacccctcggggcgggcgcgcaaaaaggaggtgtgacaatggcctggcagtatccaaattgctgctcaggtctgaacctgatcctcaatggatcttaactcccaaaatgtggcctagtagactggttagggtgtgccagcactccttattgttgggtatgaccaccagtttacgctggacttcccctaattcccctctattgcgcttgcacttactcttagcctctaagttcttccccccccccctcctatgagccttgccttgggactttgagttccttctaagcttggacatttgagggttggcccttccacactacactataatctgattctgtaatgatatttgggggtgtaagcattgcctggagttcttgaagctccttggaactttgacacatcccaaataagagaaaggctttggaaatctgatctttggaagttggtttatttcatatttcagacctggggtctgaattaggctctccttggttgaaatctttaatttctggtatatttcttatctttttcttattcattctggattgtaataaactgctggggtgttcgtgaaaagggagggtcagtcctgcatgcaaaggggtagataccatgttcatagggaattactatacttctgaaattctgcatctcatgtagataccatgttcatagggaattactatacttctgaaattctgcatctcatgtagataccatgtccatagggaattcctatacttctgaaattctgcatttcatgtagataccatgttcataggtttttctgcacttcatatagataccatgtctataagtcatttttgaaattctgcatatcatacaggtaatatgcctataggacttcttgcattttgcatatgcatctgtcactaggcaaacctgtttataagatttaaataactaactgcatatagatgaccggtcaataggatttctgcatgacaataacaacgcttaaaatcagtaacgcctagaaagcatgcctataggagctatcaaccaaacgtgaatcatcaactcgcttataagcctaaaattagtagcaataatgtttaacgcctgcagatcttatgtccctgtaattgacaattcttttttctgcaatcagtttacttctttatttctgaaactaatagatatcatgcctataggttccatttaacacctaggcaagcgttagggtaaaaactataattgcatcaatctttgataattacaaccagcaggcaggcctaatttggacatcttatatgaaaatatgtgataaatcagcctgccttaatgtttaagtttaattcagacctaatcagtacgtgtaagacatgctaaactatatgattttctctgatttaaggaggtttatttgagccatatgtgcttacttgctttcccaatacttgctgtatatgttttgaatgtcaccttagaattttatcctttttaaaaaactgcaaaagccccagctccctcccttttaggattagtagtcacatatgcctccgggactgataggattgggacgggtaatagcatgcaataagtaacgatactattccgtgctttaataccttaacggggtgggaagggtagatatggagatgatgaccgatgatttaatatcacgtgcgaccccccttctttgaggagtgattgctgggtattgcattgaagtgatccatattaatagtaaacctaggacccccctccccttatttgctttcatctcttttcttgaaaccattcaaatctttttttcataaatttttgtcccctctacttaccttcaaaagttttcaacctaattgcaatgttgtatgcaagtccttatttaagccttgattgtttacttgtaaagccacaattgtaacatggccgggaccacactagtggatcttgaggggtgcctaacaccttcccctcgagagaatttctagccgaactctgattttttccaactcaaacctttcttaaagtgtcctaatgcactataatcattaggtggcgactcttcaaaattccaaaacccaattctcgaaagggaatagagttgtcctcccaatgtcgtatacccgacttcgacccgtagaaaaaggggttgtcgacagcatggcgactatgctggggaacttctttaggattttaccattgcatgttgcttgtgactttactatctcattaattgctttatttactgtcttttattctttcactacaaaactgacttggctcttcatgtcttttctttcctttaactgctttcctttactgctttatttcaatactgttgtgattactgcaattattgtaatcatttatcttatgaacatggaaatacatgtcaatttatttcattcttgtaaactgcatattcaacatcatattccactcgtgccaaacaaagactatagcgacgcttataatgagtggttgcgctcttccaatattatcaccctttaaagttggcaaaggcgtatttgtggtaaaaccagtcgatcagtggtgcagtcgacggttccgtgcctttccctcttgagttgtccactcaaaggtacctgtctaataccccaatagaaaccttactctgtttaactgtgcatgcatcatggtcaaacctagccgagtcagttatgttgtctgcataatgactcattaagataaccttgtccaaagtccactgggtttccttgaaacccaaacggacaccaccatattctgtacatttatttggtgaactaaatgcttttatgctgattattggtattaaatagtcgagtccggtgggggtgaggtcttaacccttttgttttgcagaaaatgaatgacaaagttcctgacttcggtatggtaaacataccttcactcttgcagacttggtggagaaacctcccaccgagcaaccaaatcaacgaatggaaagatagagtcaccaaggctagtgagaagctagaatacccggagtacagcttgctggaattggaagggaaagtgaggaaaagagtcatcgactgtcaaaatgttgaggaaggcaaaggagaacgtctggcgatagcatttttactggaaaatctgcgtgagctggaggacttgatcaacaagaacattcaacctgaagaatgtccttctaggaccaagtagttaggagtctttcttttcgcttttaatgtaataaggccaatggtcattagtgacatttttactttccgctattttagtgtcgttttgggattcgtcttatttttgtcaataaaatgaggcatttagcattataagttctccaaattaacttgtcgctaggcctacttcgggcacaacgaggcacccaaattaggacatgatttatattcttgcacaatatgtttaaatattgcaacattttttcttcataatccgcactaacttgttaccttttttgtttttattttcttttattattcccctcccaaaggttagttcgtgcattatggcaccatcatcatatagtacaagatccaagggccctccacctcctcctcctccaagtcctatccggaacaagaacaaaggtagaatgggagattcaagctccagaaaggaaattgaaagaattgagattcctcaggataccccgatttctaaggaaactgctgcccaacttgagcagaaattattgaagtttcgagaagaactggaccaagttcgaaacttgtcaaatttatcattctctctcactgatcctgatgtcaactttccaaatgctcaaaatcccgtacctccacagaacaccccataaccacagatgcagcctactcatgctcaacactgcaacacatgccacactccaaacaatactccactactcattcctgaaccactgaacaccacaaacgaccacctccacaacactcccatctacgtagataccataccccactacactcaaccaatcccaagtgcacctgagtctgatgacaaggactctcttatcagaaacatggcagcagaactcaagaagttgatcagtcgagtccagggcatggaaggaaacaaaggtatagaggggatgaattatgaggacctctgcattcagccagatgttgaacttccggaggggtacaaacctcccaagctcgaaatgttcgatggcacgggagataccagagtccatttgaggacatattgtgataagttggtcggagtctgaaggaatgagaaaatccgtatgaaactcttcatgagaagtctgaagggggatgctttatcctggtacatcaatcaggaccctaagaaatggacaagctgggtaggtatggcatcagatttcatcgataggttctgattcaatatagagaatgcaccggatgtattctacatccagaatttgaagaagaagcctaccgagacattccgcgagtattttactcgttggagatcagaggctgctaaggtcagaccggctttagaagaggaacagatgaacagattcttcgtccgggatcaggatccacaatattatgagaggttgatgctgatcgagggccagaaattctccgatatcatcaagctgggggaaagaattgaggaaggcattaagaatggtatggttactaatcttgaagcattgcaggccaccaacaaggctttacagtctggtggcacgtctaagaagaaggatgtgagtgccgtgatggtcgcacagggatccaaatcaccactaaaataccacacttactcgtcacctccacttacatatcagcctatcccgaattaccaagtacccccaccctcttaccaaaatccaccacccgtttaccaatcatctccacctcccacatatcaacccatttcacccagatactctcaacctgcacctgtttaccaagattataatgcccaaccctctcactaccaatcacctcccactcgccaaaatttccctagacccagaccaaattttgaccgcagacctcccagataatatacagctatcgctgagccaattgaccagctgtatgagaaacttaaagctactggttacgtctcccctatccctgccataactttagaaaatccttcacagtgggtcaaccctaataacatctgtgtgtaccactccagcatgaagggacataccattgatgagtgtcgctcattgaaggacaagattcaaactctgaccgccaataaggttatcgtagcaaaggagcctgctcctaatgtccgcaacaaccctctgcctgatcacaaaggtggagacattcacatgatcgagatcgaagatgactgggaccccaaggggtcgataggattgattgctgagggcgatgagccaaagaaaccagcggtcatgcttaacccaattgttgtgcagaatcagccctccaagggagatgaagtaaatatgtttatacctctcgaatttgaagcaccttcttctgcaaaggcgcccagaccaattaaggttgagtttggagtcccgaaggcacctgcacctttcgaagttgctgtgttaccaccaagggtacctattcctatagcaatgtcagacataacaccgttccactcaaatgccataccatggtattacacagctgaagcaagaaggaaagggaagaccaagatgggagaagcaattgctgcgcagggtatgaccagaacaggtagggtttacactccagagcacctagttgagtccagtaagcaagcctctggacggactactgaaactgggcccaatgatctttggaggaaaatacaagctaaggagtattcggtcgttgagcagttgaacaaaacacaagcgcagatctccatcctagctcttctgcagagctctgacgcacacaaaaatgccttgatgaagatattgagtgaagcttatgtgcccagcaacataactggaggcgaaatggaaaatatggtagggcaaatactggaaagccacaaaatcaccttccacgaagatgagctgccaccggaaggactgagtcacaacaaggccctgcacatcaccgtgcaatgtgaggattacttcatcactagagtcctgatcgacggaggatccaacctcaacatctgtccgctgatcactctcagaacattgggaaagagtctgcacgagattaaagatggagccattaatgtcaaagccttcgatgggtcccaaaggtctactattggagatattagcctatgcctgcaaatgggaccaacttggttcgacgttgactttcaagtgatagatgtcccagcatcctacaacttgctgttgggacgaccatggatccacgccgttggagctatagcatcgaccctgcatcaggcagtgaagttcaaatggaatcaccaagaggttattattcatggcgatggtagcaaccccatatatagtcgccagaccatcccgatgattggaggcagaaggagaataggcggagaaacataccaccacattgaaagggtcaacgctgtagacaaggataaatggtgggataacaagattaaaagtatcttgaattggtgtgggtacgaacctggaaagggactcggcaaaaacctccagggaatcaccaaacccatcaagctgaagaaacatggtactacatttggtttggggtatgaatacacttggaaggagttcaatgactggtcgccaccatggcacggtccctactatccactggagcatccgataccttgcctggagcagactttccagccgacagacatcatatatggatcagaggaagatgaagcattggcagccatgaagaatctatttctggaagatgatgatatggactgctctgttattttcgaggaggaaggggaggaagacccttctatacaagctgtgaaccaaggagaacgcctcagcaattggtcaatcagaaccaccagggcccgaaaaccttcggggtagcaaggctaaactaaagcaccatgcatcacatttttactttttactagctgattttatttccgcattgtctttaattttgaaaagagctctgatattcaaaacaattatgaattcaatcaaagcattttagtttattatatatctcgctcttattattttttctatcattcactttattttacacaacattactattacttgccttaacgatgaaccaacgattgtgacttgcaatgagataacgcaacaaacagatatggattcagaagaggatgatataccagaagaggtcatcatagaggttgagaattttgagaatagtcctaagtctaacttggatgaaactgaggtcgttaatctgggagatacagagaatgtcaaagaaacgcgcatcagtgttcacctgtcaccatcagaaaagaaagagtacacggaattcctaaaggaatatgaagacatatttacctagtcgtatgatgatatgactagtctcagtacatccattgttgctcacaaactgccaacagatccaacatgtccgccggtaaagcagaagctcaggaaattcaaacccgacatgagtttgaaaatcaaagaagaggttaccaagaaagtcaaagctaggttctcagggtagtagagtatccaacatggttagccaacatcgtgccagtgccaaaaaaggatgggaaagttagagtttgtgttgactatcaggatcttaaccgggccagtcctaaagacgacttccccttgccaaacatacacattctaattgacaactgcaccaagcatgagttacagtctttcgttgattgtttcgctgggtatcatcagatatggatggacgaggaagatgcagagaaaacggcaaataatgccattcggtttgaagaatgtcggtgccacctacatgagagccatgactaccatatttcatgacatgatacacaaggagatcgaggtatatgtggatgacatcatcatcaaatccaagaaatcaagggatcacatggaagacctaagaaagttcttcaacagactgaggaggtacaatttgaaaacgaatcccgccaagtgtgcattcgggttcctgctggtaaattattgggtttcatcatgagtcgtcgaggaatagaattggatccgtcaaaggtcaaagctatccaagaattgccaccgccaaagaacaagaaggacgtgatgagtttcctagggagactcaactatatcagccggttcatagctcagtccacggtcatttgtgaacctatatttaaaatgttgaaaaaggacgctgccaccaagtggactgatgattgtcagaaagctttgacagaattaaggaatacctattaatgctgccggtcttggttccgcctgagccaggaagacccctattactttaccttgcggtattggatggagtatttggttgtgttctgggacaacatgatgaaacaagtagaaaggagaaagccaactactatctcagtaagaagttcacaccgtacgaggcccgatattctcttttagaatgcacttgttgtgctctgacttgggtcgcgcagaagttgaggcattacttctgtgcttacactacttatctcatatccaaaatggaccctttgaagtgtatcttccagaaacccacgcccactgacaagctcgccaagtggcaaatcctgctacgtgaattcgacattatttatgtgatccagaaagcaatcaaagggcaagccttggcggatcatctcgccgagaatctcgtggacggagaatacgagcccctaaaagcgtatttttctgataaagaggtatctttcataggagaagatattgcagaatcctatgatggttggaggttgtttttcgacggagctgcaaatttcaaaggagttggcataggagcagtcctagtatcagaaaccggccagcactacccagtatccgccaagctcaggttcccgtgcatcaataatatggccgaatatgaagcctgcatcttggggctcaaaatggccattgacatgaacgttcaggagttgctagtgatcggggattcagacttgctcatacatcaggttcgagaagagtggacaaccaagaactctaagatacttccctacttgcatcacatacaggagttgaggaaaaggttcacaaagacagaatttcagcacgtccccaaagtccagaacgagtttgctgatgcattagctactttatcatccatgatccagcatccagatataaatttcattgatcccatcccagtaaagattcatgatcagctagcttattgcgcccatgttgaggaagaagcggatggaaaaccatggttccatgacatcaaggagtacttgacaacaggggaatatccagaacttgccaacgctactcagaagcgcacacttcgtaggttatccagcaacttctttcacagtggaggaatcctgtacaggactcccgatttgggtttactaaggtgtgtcgaagcaaaagaagcatccaggctattggacgaagtgcatgcagggacctgcgggcagcacatgaatggttttgtcttagcaaagaagatactccaagtaaggtatttttggatgactatggaaacagattgtatccggtatgttcgcaaatgccatcactgtcagatacattaatatatgataaaggtgcctccaaacgggcttactgcaacaagctcaccatggccattcgccacttgtggaatggatgttatcagacctatcaagcctgccgcatcaaatgggcacaggttcatcttagtggcaatcgattattttaccaaatgggtcgaagcagcatcatacaaggcggtcactaagaaggttgtgacagatttcgtctgcgaccacattatttgtcggttcggaattccgcaatcaatcatcaccgataatggttccaatcttaacagcgacttgatgaaagcaatatgtgaaacattcaagatcaaacacaagaactctatagcctacaatccttagatgaatggagttgtggaggcagccaacaagaatatcaagaagatactaaggaagatagtcgaaaggcacaaacaatggcatgagaaattatcattcgccttatttggataccttaccacagtccgcacatcgaccggagcaactccctacatgctgatttggtacagaggcggtcatccccgccgaggtagaaattccctccttaaggatcatacaagaagcagagttggatgatgcaaaataggtaaaaggtcgctacgagcagttagcccttatagatgggaaaaggatgaatgtagtttgccacggtcagttgtatcagaacagaatgtccagagccttcaacaaaagagttaagccaaggaagtttgcaccagggcagctagtgttgaagaaaatattcccacatcaagatgaagccaaggggaagttctctcccagttggtagggtccgtaaatggttcaccgggttctaactagaggagcccttattcttgcagagatggatggagaagtctggccgaagccagtcaattcagatgcagtgaaacgatattatgtgtaacacttatgattccctttatgatgtaatttgaactacgcctgacctgattcccgtttaagaggggatacgtaggcaaccctatgggttcggtcacaatttaataaaaattccatttttccccgttattggaactggggcagaattttgaggaggacccttaaaattccgaagttgattttagcccatgcatcaccagaagccccagctcagtaaactggggtagaattttgaggaggaccctcaaaattccgaagacgatttgtttagtcattcagcacagccgtcagaaatgtccgcccagcaaattggggcagaattttgaggaggaccatcaaaattccggagcgaaagaggttgcaatgtcttgaaccacgtcgcagtcgttggttcatctaaagaaaactattttcgattatatacttacgttatatttactaaatcatgcataactattatccgaattgctgttgattagcgacgctaccccaatgacacacaacgtcaagagcccggggaagacgaactaaccttttccccttacagaactcacgatttttctttggatgcatgcactcgacttgtagtatcgttaagtatatttatgtatgcatactttcccaagaatgcaacttctcagaatcatcacttgcctgcaattgctatctgtacacaatttctcaggcagtcatattgtcataatcggctatcagctaagagatcttactattaatcatccttttacattctttcactgcataaggctacttatttgcctttcgagactaagttttgtctccatctgtattttgcataaggctacttttctgccttctgaggttaagctctacctccatcatcatctgcataaggctacttatttgcctttcgagactaagctttgtctccatctgcattttgcataaggctacttttttgccttccaaggttaagctctacctccatcatcatctgcataaggctacttatctacctttcgagactaagccctgtgtccatctgcattttgcataaggctacttttttgcctttcgaggttaagctctacctccatcatcatctgtataaggctacttttctaccttccgaggttaagctatacctccatcatcatctgcataaggctacttatctgcctttcgagactaagacctctctccatctgcattttgcataaggctacttttctgccttccgaggttaagctctacctccatcatcatctacataaggctactcttctgcctttcaagactaagccctgtttccatctgcattttgcataaggctacttttctgccttccgaggttaagctctacctccatcatcatctgcataaggctactatctgcctttcaagactaagccctgtctccatctgcataaggctactctatctgcgttttgagactaagcattatctccatcctgcatggctgaaatatcgcctctttacttttctcgcacggctgcaacatcgccaccttcatttaaattttgtaccggctgaaagatcgccaacctattcaaaggcatcatagttcggaggcaccatctacatggcccgataacattatttcatggcctgcgaatttttatttacgctcttcatagcccgggacgtcatggtccaaggacgtcatcctaaccgtccaaagacaacattcatggtccaatgagaacttgcatcacgtttaaatttatgtacaatctatgttgtatttcccacttgcaggtacaccggctagcaaacggccgtctcagtggtagcgatcccgctccggttcttgcagcctatcagacttcaactatccttctcaacttaggcatcgcgtccgttcctttcaataactctatcggcatatttcgtcgatggatcctgaactacatatggcctgattcctgtaagaccagggatatgtaggcagctcaagagccagagctaagtcagaattctttgcaaatcgtctctttcagtcaaaattggccatcatatctttacccgacaactctttcatccttgccgggtaaagaggggcagctgttgatacccaatttttccctataaatttcttttacatgcaaatactttcaaatatcatatacatacatatataagtatgcccaagtgttttagcatttttccaaatttttaagagatttttaaattgatttattgctcaataattattcccaaaattatcactttggtgaataacttattttattctcatatttataccaaaatataggtaggttacttttcatatatttttacaaattaatttggtattttaaaagctaaattgcatataattgcaattttagcctgttttaagatttaatagcattttataattatgaaaatggttccaatatttttcaattaatatttgtatactattaacggatccagtgcttttaatttgccttcaaaatcattttttattatttttataaaataaaaagggaaaactggctatttaaattttggcctcagttcgtttcaattgtagccccattacatttcgattttagcctaaaattgacccaatttcaaactcaaattcggaacagcccaattgcttttgacccaacccctaacccaactcaaacgacccaacccggttcctcacctaccttcttaaatctaggtcgttgatcatttggatcaacggccactattcgccctacaataattaaacacaggtggctaccctaatccctcattctcacttggcctgccgactttgaatcccaaaccctctcaaatcctctcaaaaactctccgaaaccctagcctcctcctacccccttttcaaccaccggtcaccggaatccatggcttctcagaccatggatagttggtactcacctatcttcactagtaagccagggttgttcgaaactttgaggcttgacctcgacgattccctctccgatcttctccgatcttctcagtcctttgatttcatggctcctccggccatgctccggcatattcaagacttaggagcctgattcttgacctctccgactcaagatcggacctgtttccaagcctttctcatttctagggtttctccgaaaccctaagctattcaaggtcctttcaccgttatttgcttagatctatactgtatctatgcttttcttgccatctaaagtgttttccccaaaggtttcttttcaaaattgtttctcttcgattttagggtttccaaaagttttacccttattatgttactttgtaaaaggttttaatcaaattctttccgtaattgtcttatgcccgttcgaaatcagaatcccttaaccaaagggagactttatgtgattggttgcaaactattttcttaccttttcttacttgttttctgcactataaaaggggactacccttctacacttgaacacactttgaattgcatactcttacacacacactctcaattacaatactcattcaattatctactctcttctgagatcttttgtactgcttgcttgcaatttggcttacaagacttatgctttcacttatttgtttccctgaaactggtatgtcctaattttgattccagcatcatccctatgtgtttactttacagttgctatgctcttggctactttcctgttcatgttctgtattgaatatgctaccctctctttgcatctgctatttgttgtgaattccccatacccctactcccttttatgtgtttgagttaaggtttatggcctggcagtatccaaattgctgctcaggtttgaacctgatcctcaatggatcttaactcccaaaatgtggcctagtagactggttagggtgtgccagcactccttattattgggtatgaccaccagtttacgctggacttcccctaattcccctctactgcacttgcacttactcttagcctctaagttctgccccccctcctatgagccttgccttgggactttgagttccctctaagcttggacatttgagggctggcccttctacactacactataatttgattctgcaatgatatttgggggtgtaagcattgcctggagttcttgaagctccttggaactttgactcatcccaaataagagaaaggcttttgaaatctgatctttggaagttggtttatttcatatttcagacctggggtctgaattaggctctccttggttggaatctttaatttctggtatatttcttatctttttcttattcattctggtttgtaataaactgttggggtgttcgtgaaaagggagggtcagtcctgcatgcaaaggggtagataccatgttcatagggaattactatacttctgaaattctgcatctcatgtagataccatgttcatagggaattactatacttctgaaattctgcatctcatgtagataccatgttcatagggaattcctatatttctgaaattctgcatttcatgtagataccatgttcatagctttttctgcacttcatatagataccatgtctataagtcgtttttgaaattctctatatcatataggtaatatgcctataggacttcctacattttgcatatgcatctatcactaggcaaacctgtttataagatttaaataactaactgcatatagatgacctgcctataggatttctgcatgacaataacaacgcttaaaatcactaacgcctagaaagcatgcatataggagctatcaaccaaacctgaatcgtcaactcgcttataagcctaaaatcagtagcaataatgtttaacgcctgcagatcttatgtccatgtaattgacaattcttttttctgcaatcagtttacttttttatttctgaaactaataggtatcaagcctataggttccgtttaacacctaggcaagcgttagggtaaaaactataattgcatcagtctttgataattacaaccagcaagtaggcctaatttggacttcttatctgaaaatacgtgataaatcagcttgccttaatgtttaagtttaattcagacctaattagtacgtgtaagacatgctaaactatatgattttctctgatttaaggaggtttatttgagccatatctgcttacttgctttcccaatacttgctgtatatgttttgaatgtcgccttagaattttatcctttttaaaaaactgcaaaagccccagctccctcccttttaggattagtagtcccatatgcctctggggctgataggattgggatgggtaatagcatgcaataagtaacgatactattccgcgctttaataccttaacggggtgggaagggtagatatggagatgatgaccgatgcgctaatatcacgtgcgacccctcttttttgaggactgattgctgggtattgcattgaagtgatccatattaatagtaaacctaggacccccctccccttattttctttcatttcttctcgtgaaaccattcaaatctttttttcacaaatatttgtcctctctatctaccttcaaaagttttcaacctaattgcaatgttgtatgcaagtcattattaagccttgattgtttacttataaagtcacaattgtaacatggtcgggcccacgctagtgcatcttgaggggtgcctaacaccttcccctcgagataatttctagcccttaccggaactctggttttttccaactcatacctttcttaaagtgtcctaatgcactataatcattaggtggcgactcttcaaaattcccaaacccaattcttgaaagggaatagagttgtcctcccaatgtcgtaacccgacttcgacccgtagaaaaagggggcgtcgacagcatggcgactctgctggggaacttctttaggcttttaccattgcatgttgcttgtgactttactatctcattgctttatatattgtcttttattctttcactacgaaactgacttggctcttcatgtcttttctttcctttaactgctttcctttactactttatttcaatactattgtgattactgcaattattgtaatcatttatcttatgaacgtggaaatacatgtcaatttgtttcattcttgtgaactgcatcttcaacatcatattccactcgtgccaaacaaataccatagcgatgcttataatgagtggttgcgctcttccaatattatcaccctttaaagttggcaaaggtgtatttgcggtaaaaccagtcgatcagcggtgcagtcgacggttccgtgcctttccctcttgagttgtccgctcaagggtacctgtctaataccctaatagaaaccttactatgtttaactgtgcatgcatcatggtcaaacctagccgagtcagttatgttgtccgcataatgactcattaagataaccttgtccaaagtcctctgggtttccttgaaacccaaatggacaccaccatattctgtacatttatttggagaactaaatgcttttatgttgattattggtattaaatagtcgagtccggtgggggtgaggtcttaacccttttgttttgcagaaaaatggatgaaaaagttcctgacttcggtatggtaaacataccttcactcttgcagacttggtggagaaacctcccaccgagcagccaaatcaacgaatggaaagagagagtcaccaaggctagtgagaagctagaatacctagagtacaacttgcttttgcaatatttgatattattgagtcaattgtggctagatatgagtggtttggaggcagattagaggggaaaggccccggtagagttctgaattgattgtggagtgaggtaagtgttgagcttaaccttaacttgagggaattaggaacccttagactatgtgctatatgaatttcatgtgttgcagtgtatattggattggcctgccaagacggtgaccttagtcttgctagggttgcctcgattagagtggagagggattcctagctattttaccagcatggttatctcttatgtgaaggctcggcttatggttgagacggggtgtttagcttatttggcttatattcgcggttctagtgtgaaaattccttccatggatttagtacttgttgtttatgagtttccaaaggtgtgtcctgcagatctgcaggggatgccactcgacataaacattgacttctgtcttgatttggctacgggcacccaacatatttctattctgccataccttatggccccgctagagtttaaagaaatgaaggagaaattgcaagatttacttgagaaaggcttcattagacctagtgtctcaccctagggtgtgtatgtgttgttcttgaagaagaagaatggatcgatgaggatgtgcatagattatcggcagttgaacaaagtcaccatcaagaacaagtatccattgccaaggattgatgacttatttgatcaacttcagggtgccaaggtgttttcaaagattcatttgaggtctggctaccatcagttgaggattagggcatccgatgtccctaagacaacttttcagatttgatatgggcattatgagtttctagtgatgtcatttggtttgacaaattccctagcatcatttatggatttgatgaaccgggtgttcatgccctatttggattcctttgtgattatgtttattgatgatatcttgatttactcccgtagttgagaggagcatgagcgacatcttcggattgtacttcaaactcaaagagacaaccaattatatgctaagttttcaaaatgtgagggtttcttggggcacgtagtatcgacagagggcattcagttggatcctaagaagattgaggcagttcagaactggcctagacccatttcagctacggagatccgaagtttcttgggtttggcgggctattaccgtcagttcgtggaggggttttcatctatagaagccccattgaccaggttgacccagaagggttccccctttaaatggtcagacgagtgtgaggcgaacttttagaagctcaagactgctttgacaacgacgccaatgttggtgttgcctacaggttcaggatcttacacggtatattctgatgcatctagtattggacttagtgcggtattgatgcaggatgacaaggtgattgcatatgcatcacgaaagctgaaggttcatgagaagaactaccatgttcatgacttagagttggcagtcattattcatgcaccgaagatttagaggtactatctttacggtgtgtcgtgtgaggtattcatggatcatcggagcttgcagcattttttcaaacaaaaggatatcaatttgaggcaggggaggtggttagagctattgaaagactataatatcaccatcttgtattatccctggaaggtcaatgtagtggctgatgccttgagtagaaaggtagtgagtatgggcagccttgcgtacattccagtcggtgagagaccgcttgcatcagatgttaaggacttgaccaatcaattcgtgagtttggatgtttcagagcccaatcatgttatagcttgtacagtcgctcgatcttcattgtttgagtgcattggggagcggcagtatgatgaccctcatctgcttgtctttagagacacaatgcaacatggaggtgctaagcaggttactataggagatgatggatttttgaggatgcagggttgtgtttgtgtgcccaatatagatggacttcatgagtacattcttgaagaggcctaaatttccctgtattttattcatccggatgcagccaagatgtatcaggacttgcggtagcattattggtagaggaggatgaagaaggatatagttgcatatgtagctcggtgtctaaattgtcagcaagtaaagtatgagcatatatttggtggtttgctttagaagatagagattcctgagtggaagtgggaacgtatcactatggattttgttgttggactcctatggactcagagaaagtttgatgcggtatgagtcattatggataggctgatcaagttagtgtatttcattcctgtggcagttacctattattcagagtggttggctgagatttacatctgcgagatcgtttgtcttcacggcgtgcccatatttatcatttttgatctaggtacggagttcaccttgcatttttggagggcagtacaatgtgagttaggcacacaggttgagttgagcacaacatttcatcctcagacggacggacagtccgaacgcactattcagatattggaggagatgttttgcgcttgtgttatagacttcggaggttcttgggatcatttctttccacttgtggaatttgcctacaacaacagctaccaatcgagcatttagatggatccctatgaggtattatagggatctaggtacggagttccctatgaggtatttagatgggtaactgccactgcctgtggcagttacctattattcagagtggttggctgagatttacatctgcgagatcgtttgtcttcacggcgtgcctatatttatcatttttgatctaggtacggagttcaccttgcatttttggagggcagtacaatgtgagttaggcacacaggttgagttgagcacaacatttcatcctcagacggacggacagtccgaacgcactattcagatattggaggagatgttttgcgcttgtgttatagacttcggaggttcttgggatcatttctttccacttgtggaatttgcctacaacaacagctaccaatcgagcatttagatggatccctatgaggtattatatggcaggcggtaccgtttgccagttgggtggttcgagccggtggaggctcggttgttgggtacagattcagtataggatgccttggataaggtcaagattattaatgattgacttcacacagcttagtctaggcagaagaattataccaaccataaggttcgtgatgttgcctttatggtcggagagagggtattgctcgaggttccacccatgaagggtgtgatgaggttcggaaagaagggcaagttgagacctaggtatatcggaccttttgaaattcttgagagagcgggagaggtggattacaggcttgcattaccacctagattatcagtagtccatccgacgttccatgtgtccatgctccggaaataccacggtgatccgtcccatatgctagatttcagctcaatacagttggacaaggatttggcttatgaggagaagccggtggctattctagcccaacaggttcgacagttgaggtcaaagagttatccttcagtttgagtgcaatggagaggccagttggttgaggcatctacttgggagtccgagtcggacatgcacagtagatatccacaccttttcaccagccaagtacttttctaagtccattcgaagacgaatggttgttttagaggtagagaatgtgatcacccaataaacatctaaagttttaaaacctaattctgtgtttccaagcctctaatagcttctttaagccttcctcaatttgcgtgcgcagtccaggaatttttttgaaaggcttttatgttaaaaattgataaaatatgaaagtttaccataaaattttatttgagttgacttcggttaacattttgagaaaacaaacccggatctgtattttgacagtcccggtgggtccgtatcgtaatttgggactcggcgtatgcccaaaatcaaattaggaggtccttagctcgagttattgatttttgtcgaaaatcgaaagtttaaaggtttaaggatttttaagaattgacagatgtttgattttgttgatatccgtattttggttccagggcccggtataggtccattactatatttatgacttgtctgtcaaatttgataagaaacagagttagtttgaggtgattcggacgttcagttgttaaaatagaagttttaaagtttttttgaaaatttcatttgatttggagtctgatttttagttctaggcatcatgttggtattttgatcgcacgagcaagttcgtatgaggtttttggacttgtgtgcataatttgtttggagccccgagggctcgggtgaatttcggataggctacggatggttttaaacttagaaaagctggtttttcctcagcttcaactgtcatctagtttccttcttagcgatcgtgaaggtaatctcgcgatcgtagaagaatgatcttggctgagtgggatttacttcatcgcgaacacgatacttgggtcgcgaacgcagagtgttgggggttttatcctccgcgaacgcgaccaacctcgcgtgaatgcatagctttagggacctgggggaggggagctgactttacccttcgcgaatgcggaacatggctcgcgaacgcgtaggttggtgggtgtaagcgtttgcaaacgcgaagggtatctcgcgaacgcttaggtctttgggccactgccttccgcgatcgcgtcaggccctttgtgaatgcaaagaaggcctgacacacagtgatttaaacatttcaaaaatgaaatttctcccatttttcataacccttccgttagagctcggcctaggagtgattttgaagagaaaactcaacatcaattcataggtttgtacactttaactcattttcttccatttctaacataatccattaattcctagccctaatctttgttcttccatgatagaaaactagggatttaggaagaattggggttttttgtaaatttggaatttagtcctcaatctgaggccggattccgaaattaattacataattgggctcggcggtgaatggattttggtccgaacctctggttttgaccaagcgggcccagggtctatttttgactttttggagaaaagtttgaaaattctaaatttatgcattgtaattgattccttttgcaatatttgatattattgagtcaattgtggctagatacaagtggtttagaggcagattcttggggaaaggccccggtagagctctgaattgactacagagtgaggtaagtgttgagcttaaccttcacttgagggaattaggaccctcggactatgtgctatgtaaatttcatatgttgcggcatatatgtgaggtgacgagtgcttatacgtcgccgaattacttgttttccctgattttctgcttttccttaattatctccttccctgtcttaaattttatatgctctagatacctatcatgcttaattgctacttgttaatcagtgtttccttctgttaatattgttagatcctttcatattttcatgatttgccttaacttacttacttgcaccttctaattgtcatttaccggattaacttgctgtgtagtatcacctatatgaatttctgtgttgtacaaggtttcttttttgattcagcttggtatttattgatcgtaaaggttcttgcgatttgaattattgatttgactatgcacatagagtatttggtactaatatggtgggatcgggttgcaagccgcaacaggtgaaataaggatggattgatatggtgaaataagggtgaatttgtactgatatggtaggatcaagatgcacgccgcaacaagtggaataagggtggattgatacggtgaataagggtgaattatgtgggatcgggtttcgcgccacaacacacacacacacacacacacacacacacacacacacacacacacacacacacacacacacacatatatatatatatatatatatatatatatatatatatatatatatatatatatatatatatatatatatatgtgtgtgtgtgtgtgtgtgtgtgtgtgtgtgtataatttactattgttgatattgttacagtaaaataagggaggattctgtgttgtacggtgggatcaggttgcacaccacaatagccaacgtgtttctatttccttaagttgtgttggttttctgtattttcacttgaaactatatggtttggtaattctgatcgtcaattgcttaattcttgagattttagctattatcttcagttcgctgtcatattttgttccgtatttccttttctgcctttattatatattgcgtacaagttttagtgtaggtgacctgccttagcctcgtcactacttcctcgaggttagtctcgacacttacagagtacatagggtcggttgtactcatactacattctacacttcttgtgcagattttggagtcggtcctagcggtggttattagcgtgctcagattgaacagcttgtggagatttgaggtacaactactcagtgtccatagctcttagaatgcctttccctttttatttggttgtgtagtttcttttcagacaactttatgttatttcaaactcttgtatgtatgcgctcatgacaccaggtccgtagttgcatcagacatttggttgttttagcttctgcatttttactttggattatcgtagttattttagttccttctcattaattaatttaaactattaaaaatggataaaatgttctaatgttggctttcctagaaagttgaatgttaggcgccatcagggccccgacgatggaaattccggattgtgacagagagagcctacgtatttgatgcaaacctatcactactagcgttggagatcaaaattaaaaaaaagggtatacgtttggtccatttaaccaattttgaattaagagggtgcttggctaagcttataagctggtcaaactagcttataagcacttttcggcttatctatgcatttagtaaagttaaaagagcttataagccaagggtaacgacccgactggtcgttttgcttttcagaaccctgttcccttaaataaaactttctgtgcttgctttaactaatttacgacctacggggatggttggtccaagatttggaagagtttgggttgaaatatgctcatttgattccttaaaattttcttaaaaggctaagtttgactttggtcaatatttttagcaaaaggacctggattagtattttgacggtcctggagagtccgtaagaaaatatgggacctgggcatatgcccgggatcgaatcctgaggtccctagcccgagtaatgaaattttattagaaattgttaaactgaaattttaagtatttaaagaaactaattaatgattgatcatcttggtatcgggctcgtatattggtttcggagcctagtacaggtctaatataacatttaagacctacccgcaaaacttggtgtcaatctgagtagtataagtacgttagaagtgaatttaagaacttgaagttcataagtgtgattcaattggttttaggaggtgattcatagatttagcattgtttcgggtgttccgaaggttcgagcgggtctatttcatgatttcagacttgtcggtatgttcgggcggggctcgaaagccccgagcatcaatcggacgaggctcgagtgaagttggaaaagttgcaaagggctgaagcatctggtatctgtcataaccgtacctgcggttggacggccgcaggtgtaagactgcagaagcggttgccctctcgcagatgcggccaaggcaggatagtccagaaaccgtagaagcggctccatagaagcgacttcaagaccgcagaagtggtcccagcccgcttggcccttctgcagatgcgacctcttcctcgcagaagcaggaccgcagatgcggtcccctaactgcagaagtggaaatcgctaaagcagtgagcttcatttaatacgggtcctaagtcatttttgccacttttcactcctcctttgggcgattttggagcttcgtagagaaaacttccacctagcaccttgaggtaagtttatcccacctattcctagtttaatatttgtgtcttaggtagattaaacactaggattaatgtaaaatcatggggttagagcaaaacctaaggttttgacaaaagttggatttgaccacaaaatttgctatgaaatgaattagaaatcatatattattgatccttaagttatagagaacaaatttcttcgaaaaatttcggaatccgggcaagtgggcctggggtcagattttaggaaactagtgttaagggttggaaaattgcttaaatagctagaatacgatcttgtgagcttatattgactagttcctacctcattttactagctttggatcagtcggctccaaattgagagtttgggctcgtttttggcattgggaagtatacattggagcgaggtaagcctcctttctaaccttataagagggaattgtccccataggtgtaataattgaataaattgctactatatgcggggcctacatacgcactaggtgacgagagtccgtgcgtagctactattatgctatgtccgggtagtctaggacccaaaagcatgctctatgtgatattcttgtaacttcatgtttaattcggatttgtataaatcatgttgattggggtaaatcagactagtaagaggaacattatctttcttgaccttttaaagagaaattgattatttttgtgagtaactgtttcccagatatacactattgtcttcttgttgttgtgttatttatatttgaccgcgttgcatgtttgattcacgagcgggataatagatgcatctatggttcgtgtcgttcaaccctcgatagtgcataatttacttttttgttggttcgggccgtatgaccttcgacattacttgcgcatgttttacttagtatttttctatggactgaacttcgtatatgtcttggaattcaaatggttaactatgatataatcaagaaaaaggaaccgttatttcttgccatgaaatgctatttaagtgtactatccatgcttagtataaattctttctcatattatttgaccctagtaagtatcaagtcaacctatagtctctacttcttcaagattagacaggatacttaccaggtacatattctttatgtactgatactacacttaggctggtttatttccagcggatccagcaacatcgcaggcaggagggggagcacagagccctactgcttaggcccctggacatgcagctgtagtatatcagactcctcttggtgcactacccgcagatggggcctagccagtggctgcagtggcgccctagcccagaccagctgcggatggcgagccgcagaaattgttggatagatggaccagacttcaccctcctgtcttcgggggtgagcgtcatgaggatgcccaggacttcatagacaggtgcagggacagactgcacaacatgaggatattggagtcgcatggggttgacttcattactttttagctagagggtagggcccgtagatggtggcagtcttatgttcttggcaggctagcaggttcccctcccctcacttggggtcagttcacacagttattcttggataggtatattccaccctctgagagggaagtgctgcggtatcagtttgagcatctggagtagggttagatgtcggtgaccgattatgaggcaaggtttttttgagttgtctcgtcatgcactcatgatacttctcactgatgcacagagagtgcggagatttgttgcggggttgcaccccggtattcgagctagcatggcccgagaggtggagatgagtactgagtatcagctagtggtagagattgctcgcaggattgagggatatcgctagaggggtagagagtagattcagtaggataagaggccccgattttcgggagggttcagaagtaccctagctaggggtagaggtcacttcgggaggggtcagcccagcaggaccccgtattcaggaccaccaccacctccccgaggtgctccaatgagaccttatttcagtgcgatgctggagagttcttccgcccaccagctatttagggttcctccagtgggtattctggtcatcagggttcttccagtgcttacttcagtgccatgccaaagagttcatatcgcccaccagccattcagggttctttgggtgggtattcgagttagcaggctcagacttcagggcagcagactatggttcctaggggttgctacgagtgttgagatccaggtcacatgaagaggacctgcccagagttcggggtaaggcaatacaacagggtcagcagcccatgattccagcaccgattgcacagcctctcagaggtgggggacagatgggaagaggccgtcctagaggtagagtccaggcaaggagagttcagtcagctactgctcagtccgatagaggccagccaatcggtgctccaaccagattctatgcccttctggctaggccagatgcattggcctcagatgccgtcatcacaggtattattttcgtcagcggtagagatgtttcggtattatttgctccagggtctacttattcatatgtatcatctctgtttgctcgtttcctagttatttctcatgagcctttgggcactcctatttatgtgtccactcttgtgggtgattctgtggttgtggatcggatctaccggtcctgtgtggtcacattctatggtttcaagactagagcggatctctttttgcttgatatgattgactttgaggtcatcccgggcatggattggttatctccatatcacaccatcctagcttgtcatgccaagactgtttcattagcgattccagggttaccgaggttagagtggaagggttccatagctgatacatctagtcgggttatctctttcctaaagggtgtttggcttatctagcttatgttcaggacaccactgcagagtctccaatgattgattcagttccagtagttcgggagttcgccgatgtgtttccttctgatcttcctagcatgccaccggattgcgatattaatttctgtattgatttggccccagacacccagcctatatctattgcactgtatcgtatggctcctaaagagttgaaagagttgaaggagcagcatgaggagttgttagcaaaggggtttgttagacccagtgtattactttggggtgcactagtgttatttgtgaagatgaaggatgagactatgcagatgtgcattaattaccgccagttgaacaaagtcaccatcaagaacaagtatctgttgcctcgtatcaatgatttgtttgactagttgcagggtgctagggtgttttccaagatcgaattgaggtcagggtatcatcagttgaagattcgggaattggatgttccgaagactgcattccggactagatatggccattatgagttcctggtgatgtcctttggcttgactaatgccccaacaacattcatggacttgatgaacagggtattcaggccttgtattgatttatttgtcgtcgtcttcattgacgacatcttgatatactcacgtagcctgggggagcatgagcaacatttgagagtaatgcttcggaccttgcgagagtagaagctatatgctaagttctccaagtgtgagttttggctagagttagtggcattcttggggcatgttgtgtcgggagagggtattaaggtggatcccaagaagattgaggcagtttagagttggccacgtcctaccttagtgatcgagatcaggagtttcctggggttagcaagttattacagatgattcgtgcatgacttttcatctattgcatcacctctaactagattaacccagaaaggttatcctttccgttggtccgatgattgtgaggagagcttttagaagctcaagacagcgttgaccacgacaccagttcttgtattgccttccggttcagggatgtatacggtatattgcgacgcttagcgcattggcttgggatgtgtattgatgcaggaggggcgagttattgcatatgcttcacgtcagctgaaggtttatgataagaattatcccgtgcaagatctagagttggccgcaattgttcatgctcttaagatatgaagtcataatctgtatggggtgtcatgtgaggtttatactaatcatcacaacttacaacatttgttcaagcagagggatcttaatttgaggcagtgcagatggcttgagttactgaaggattatgacatcaccattctttatcatccgggcaaggaatgtggtcgcggatgccttaagtaggaaagcagagagtatgggtagcttggcattcattccagcaaaggagaggccactagctttagacatttagtccttggctaacagacttgtgagttggatatttccaagcccaaccgggttcttgcgtgtgtggttgcttagtcttcactattggggcagatcaaggcccgacagttcgaggatccacatttggcggttctcagagagacggtgctacagggtagtgccaatgaggtttttatcggtgaggatagtgttttgcgactccagggtcacctatgtgttcctaatattgatggtctgagggaggggattctagaggaggcacacagttcacggtattctattcatccgggtgctacgaagatgtatcgtgacttaaggcagcattattggtggctgaatataaagaaagacttagcggagtatgtattgaggtgtttgaattgccagcaggtcaaatataaacaccaaaggccgggtagcctacttcagcagatgcatatactagagtggaagtgggagcgcattactatagactccgtggttgggttgccccggactttgcggaagtttgatttagtgtgggtcattgttgacaggttgaccatgttgctccccttcattccagtggtgactacttgtacagcagagaggtatgctcagatctacattcaggagaaagtccggttgcacggtgtgcctgtttccatcatatcatatagaggccctcagttcacttcccatttttggagagttgttcagagtgagttggggacccgcatggagcttagcacaacattccacccttagacagatgggcagtcggagcggacagttcggatcttggaggacatgctcagagcatgtgtgattgattttagaggatagcgggatcaattcttacccttagcggagttcgtgtacaaaaatagctatcagtccagcatagagatggctccatacgaggctttatatggtcgacggtgtcattctcctatcgggtggtttgagcctggtgaggctaagttatacgatacagatttggtgcaggatgccttggacaaggtaaagttgatccaggagaggcttcgcacagctcagtccagatagacgagttacgcggatcagaaggcgcatgatgtatcatttatggttggcgagaaggtcctcttgaaagtctcgccaacgaagggtgttataagattcgagaagaagggcaagctgagcccaaggtttattggcccatttgaggtgttgaggcgagtcggagaggttccttacgagcttgatttagcccccagcttatcgggagttcacccagtttttcacgtgtctatgctttgaaggtatcatgccgacttgtcccatgtgttagacttcagtactattcagttggattagagtctgagttatgaggaggagccagttgccattattgatagacaggatcgccagttatgatccaagaggatttcaatggtgaacgtccagtggaagggccaaccagtcgaggaggcaacctgggagtccgaggaggacgtgcggagcagatatccacatcaattaagcacctcaggtacttttctatgtccgttcgaggacgaacgtttgtttaagaggtggagaatgtaacgtcccgactggttgttttgctttttagaaccctgttccattaaataaaactttctgttcttgatttaactaatttacgacatgcggggatggttggtttgggatttggaagagtttgggtcgaaatatgctcatttgattccttaaaattttcttaaaaggctaagtttgactttggtcaatatttttagcaaacggacccagattcgtgtttggacggtctcggaggatctgtaggaaaatatgggacctgggcatatgcccgggatcgaattccgaggtcactagcccaattaatgaaattttattagaaattgttaaactgaaattttaaggatttaaagaaactaattaatgattgatcacattagtatcgggctcgtatgttggttccggagccaagtacaggtccaatataacatttatgacctacatgcaacatttggtgtcatctgagtagtataagtacgtttaggcacgttagaagtgaatttaagaacttgaagttcataattgtaattcaattggttttaggggctgattcgtagatttatcattgtttcgggtgttctgaaggttcgagcgggtccgtttcatgatttcagacttgtcggtatattcgggcgggaccgggagccccaagcgtcaatcggacgaggctctagtgaagttgaaaaagttgcaaagggctgaagcatctggtatttatcataaccgcacatgtggttggacggccgcaggtgcgtgtcacgtctcggatttcccaccctcgagagtcgtgatgacgcctactggtgaaagctaggcaagccaagttattctaattatttaaccatttccagttttaaaccattatcagtgatgtgtaaagctgataattaatcttaaaacaaattacgaaagtctaaatacatatctacctagaatttggtgtcacagcttcataggcggtctaagaatactacatacaaagtatgaaagttaaaatatacattgtttctgaaatgagtaaaggaaacaggataaaggaacgataggaggtgatgccaaggcccgcagacacctgcaggactacctcgggtcgcttgttggactgaaggcaacaaccccactgcggtccgaagtctacaacactgggatctgtacaaaagagttcaaagtatagtataaacaaaaccgaccccatgtgctggtaagtgtcttgcctaacctcggcgaagtagtgatgatgctaggaccagactactaaataaacttgtgcagttatatcataaacagccgaaatagaagcagataattagaattaatattgggcaggggaaacatgcttcggttaataacaaataacaatagaatatcaagagaatataaagaaaccaaaatccaattactagcacggataaggaaaacaaatgcagagtttactttcatttcacatctcgttgtaggtgtgcaacccgatcccatttcatgtatctcgttgcaggcgtgcaacccgatcccatttcatatatctcgttgcaggcgtgcaatgcgatcccatttcacatatctcattgcagacatgcaacccgctctcatttcacatatctcgttgcaggcgtgtaacccgatcccatttcacatatctcgttgcaggcatgcaacccgctcccatttcatatatcttgttgcaagcgtgcaatccgctcccatttcatatatcttgttgaaggcgtgcaacccgctcccatttcatatatttccgtggcggtgtgccacccgatcccatttataaatcaataataatcacaaaagaatcccggcaagggaacaataatatcaagacaacatcccggcaagggagcaataatgataataacatcctggcaagggagcaataatgataataacatgttaagcgcaataaaccacaacggagtcataacaattacaatacaagactcatggacatgcttgacaccgacgtatagatactcatcaccatgccaatacgccatactccacaattaacacgtagcaaataagacatgactcctaatacctcaagctaaggttagaccaaacacttatctcgatgccacgaatataattcaagcctctactatcgctttacctcgtgattccaccaccaattcgctcgtatctagccacaagttacttaattacatcaataaatgctaaatgaatcaatcctaatgcatgaaaatgagttttctaaagttttacccaaaaagtcaaaatttgccctcaagaccacatggttaaaacctgaggttcgaaccaaaacccgattacccattcccccatgaacacaaatatataatttgttctgaaatcggacctcaaatcgaggtccaaatcctcaatttttgaaaaacctaggttctacccaaaacacccaatttccctaatgaaaatcattgattttgagttgaaatcaagtgaaaagatgttaaagattgaagaaattagttagaaatcacttacaatcgatttggaagagaagtcgcctttgaaaatcgccctagagagtttatgttttgagaagatatgaaaaatggttgaaaatgcatctaagttatgaacttacaagttgcaggtatcgtaattgtgatcagggttcgcaattcgaactcaggctctgctaagctcgcatttgcgaaaggactttcacatttgcgaagtcgcttttgcgataaatttgtcgcatttgcgacgactggggagttcagtgcatcttcacatttgcgaagggactttcgcatttgcggaatcgcttttgcgataaagtcgtcgcatttgcgacccaaggcagcccaggacacttgtcgcatttgcgagccaggcctgaagcataccagataaaatttgcaacatcctaagtccaaattctaatctgtggcctatccaaaactcactcgagccttcggggctccaaaccaaacatgcacaccaacctaaaaacataatatggactcgctcgtgcattcaaatcaacaaaatatatcaacaactatgaatttagcatcaaaatcatgaaatttcttaagaacttcaaatttttccaattttctcaaatacgatccgattcacgtcatctcaagtccgtttattgccaaatttcacagacttatcttatatcacatataaaacctgtaccgggttctggaaccaaaatacgggcccgataccatcaagttctaaacacgtatcatttccaaaaactcaataatattccagaaaataagtttctttaaaaattcattacttgggcttaggaactcggaattcgattccgagcaaattcccaagtcccttatttttctacggaccctccaagaccatcaaatcacgggtccgggtccgtttatccaaaattttgaccgaagtcaaattagttcattttaaagtcaaaattaattatttttcacagattttcacataatggcttttcagctacatgcttggactacgcacacaaatcgaggtgatgctaaaagaggtttttaatgcctcggtaaatggaattcatttctaaaacaagtgatgacccaggtcatcacattctccacctctaaaacaatcgttcgtcctagaacggacataagaaggaagtacctaagacggggaaaagatggggatagcggcttcgcatattggactcggactcctaggtcgatgcctaagtaggctgacctctccactagacacgaacagaaggaaaactcttcgatctcaactgacgaacctgccggtctagaatatctaccggctccttctcataagacaagtccttgtccaactggacagtgctgaaatctaacacgtgggatgggtcgctgtgatatttccgaagcatggacacatgaaacactagatgcacggctgataagctcagcaacaatgcaagtatgtaagtcacctctcccactcgatcaagaatctcaaatgggccaatgaacctagcgctaagcttgcccttattcccaaatctcatcacgcccttcataggcgacactcgaagcaatacctgttcatcgaccatgaatgccaaatctcaaacattgcggtcggcataactcttttgcctggactgagctgtacaaagcctatcctaaataatccagaccttgtccaaggcatcctgtactagatccgtacccaacaaccgaacctcccccagctcgaaccattgaactgatgaccgacaccacctaccatagaaaacctcgtaaggagccatctggatactcaactagtagctgttgttgtaggcaaactctgctaaaggcaaaaactaatcccacgagcctccaaagtcaatgacacaagctcggagcatatcatccaaaatctgaatagtccgctcggactgcccgtccgtctgatgatgaaacactgtgctcaacgcaacccatgtgccccaactctcattgaactgccctccagaaatatgaggtaaactgcgtacatcggttcgaaatgatagacacgggcacaccatgaagacgaataatctcccggatatggatctcagctaacctctcggatgaataggagactgccataggaatgaaatgtgctgacttgaacagcctatcaacaataacccatactgcatcgaacttcctccaagtctgtaagagtccaacaatgaaatccagagtgatctgctcccacttccactcgggaagctcaatcctctaaaacaaaccaccgggtctctgatgctcgtacttaacctgctgacaattcaaacatcgagccacatatgcaacgatatccttctttattctcctctaccaaaaacgctgccgcaaatcttgacacatcttagcggcaccgggatgaatagagtaccaggaactatgggcctcctataaaatcaactctcggagtccatctacattaggcacacaaactcgaccctgcagtctcaaaactccatcatcacctaaggtaacctgcttggcacctccgtgctgcatcgtgtctctaaggacacacaaatgaggatcatcatactgccgatctcggatacgctccaatagaagaacgagcgactgtgcaagctaacactcggttgggcttagaaacatccaacctcacgaagtgattggccaaagcctgaacatccaaagcaagcggtctctcaccgaacggaatataagcaagactgcccatactggctgacttgctactcaatgtattagccaccacattggcctttcccggatgatataagatggtgatatcatagtcctttaatagctccaaccaccttgtctgcctcaaatttagctccttctgcttgaacaaatactgcagactcttgtgatccatgaaaacctcacatgccacgccatacagataaaacctccaaatcttcaacgcgtgaacaatggctgacgggtccgggtttgtttacccaaaattttgaccgaagtcaaattaattcattttaaagtcaaaattcatcattcttcatagattttcacataatggtttttcggctacatgcccggactgcgcatgcaaattgaggtgatgctgaaagaggtttttaaggtcatcacattctccacctctaaaacaaccgttcgtcctcgaacggacataagaaggaagtacatgagtcgaggaaaagatggggataacggctccgcatatcgaactcggactcccaggtcgatgcctcatcaggctaacctctccactgaacacgaacagaaggaaaactcttcgatctcaactaacgaacttggcggtctagtatagctaccggctcctccttataagacaagttcttgtcaaactagatagtgctgaaatctaacatgtgggatgggtcgccgtgatatttccgaagcatggacacatgaaacactggatgctcggatgataagcttggtagcaatgcaagtctgtaagccccctctcccactcgataaagaatctcaaacgggccaatgaacctagcgctaagcttgcccttcttcccaaatctcatcacgcccttcataggcgacactcaaagcaatactcgctcaccgaccatgaatgccaaatcttgatccttgcggtcggcataactcttttgcttggactgagctatatgaagcctatccagaataattcatcccttgtccaaggcatcctatactagatccgtacccaacaaccgagccttccccgactcgaaccatccaaccgacgaccgacaccgcctaccatacaaagcctcgtaaggagccatatggatattcgactggtagcaattgttgtaggcaaactctgctaaaggcaaaaaaagatcccacgagcctccaaagtcaatgacacaagcttagagcaaatcctccaaaatctgaatagtccgctcagactgcccgtccgtctgaggatgaaatgttgtgctcaactcaacttgtgtgcccaactctcgttgaactgccctctagaaacatgaggtaaactgtgtacgtcgatccgaaatgatagacacgggcacaccatgaagacgaacaatctcttggatatggatctcagctaacctctcggatgaataggagactgccataggaatgaaatgtactgacttggtcagcctatcaataataacccacactgcgtcaaacttcctccgagtctgtaggagtccaacaacaaaatccagagtgatccgctcccacttccactcgggaagctcaatcctctaaaacaaaccaccaggtctctgatgctcgtacttaaccttctgacaattcaaacaccgagccacatatgcaacgatatccttcttcattctcctccaccaaaaatgctgccgcaaatcctgatacatcttagcggcgcctagatgaatagagtactgggaactatgggcctcctctaaaatcaactctcagagtccatccacattaggcacacaaactcgaccctgcaatctcaaaactccatcatcacctaaggtaacctgcttggcacctccgtgttgcatcgtgtctctaaggatacataaataaggattatcatactgccgatctaggatacgctccaataacgaagaacgagcgactgtgcaagctaacacacggctgggcttagaaacatcaaacctcaagaactgattggccaaatcctgaacatccaaagcaagcggtctctcactgaccggaatataagcaagactgcccatactggctgatttcctagtcaaagcatcgaccaccacattggcctttcccagatgatataagatggtgatattatagtcctttaatagctctaaccaccttctctacctcaaatttagctcattctgcttgaacaaatactacagactcttgtgatccgtgaacgcctcacatgccacgccatacaaataatgactccaaatcttcaacgcgtgaacaatgctgccaactccaaatcatgaaccagataattcttctcatgaatcttcaatgctcgtgaagcatatgcaatgacatttccatcctgcatcaacaccacactaagtccaacaggatgtgcatcacaataaactgtataagccatgaacttgtgggcaaaaccaacaccagtgccatagtcaaatatgtgttgagcttctgaaagctcatctcacactcgtttgaccacctaaattaggcacccttctaggacaacctggtcatcggggctacgctatctctacaaacagacgatagtagcctgccaatcataagaaactccggatctctatagcttatgctggtctagaccagttcttaactgccttaatcttcttcggatcaacctgaataccctctattgatacaacatgaccgaggaatgcaactgaactcaaccagaactcacatttcaaaaacttggcatacaactgactatccctcaaagtctgaagaatcactctaagatggtgcttgtgcttctctcggctgcgggagtagatcaaaatattatcaatgaatactatcacgaacgaatccaagtaaggcctgaacactcggttcatcaaatccttaaaatttgctggggcattttcaacccaaatgacatcaccaagaactcaaaatgcctgtaccgagtgcagaaagctgtcttagggacatcggatgctctaatcctcaactgatggtagctagatatcaagtcaatattcaaaaataccttgacaccctgaagctgaccaaacaaatcatcaatcctcggcaacagatacttattcttgattgtaaccttgttcaactaccgataatcaatacaaattctcatcgatccgtcctacttcttaacaaacaacatcggtgcaccccaaggcgaaatactaggtctaatgaaacctttttcaagcaagtcttgcaaattctccttcaactctttcaactcaggcggggccatacgatatagcgggatagaaatgggttgagttccctaagccaaatcaatgcaaaagtcaatatccctgtcgggtggcataccgagcaggtctgaaggaaataccccagaatctcacgaacaacaggcatgaaattaatagaaggaacctcagcactagaatcacgaacataggccaaataggccaaacacctcttctcgaccatacgtcgagccttcatatatgagataacactacgggtagaatgactaggagtccctctctactctaaacgaggtaaacccggcaaggctaaggtcatagtcttggcatgacagtccaagatagcgtgtaaggtgataacaagtccatccccaatatgacatcaaaataaaccatgtccagcagaagcaaatctacacgagtctcaagactcctaatcataactatacatgaataacggactcgatctaccacaatacaatcacccacaggtgtagacacataaatagaagcactcaaagaatcactagacatgaccagatatggtgtaaaataagatgacacatagaagtacgtagatcctggatcaaataaaatcaaagcatctctacaacaaaccaaaaaagtacctatgattactgaatcggaagcctcagcctcgggcttggctggaagagcataacatcggggttggtccccaccaccctgaactacatctctaggacagcctgctgcaggctggcctccacctctagcggcctgagctccacctctaatacctctacctccacctctagcacctctacccccacctctagctggttggggggctttagaacactcggtgcctgaaccatggcacgggaacactactgctgagaattacttggtgctcgagggcaatatctagcaatatgcttcgtgtcgcaataagtaaaacaagcccttggttgctagggctgacgaccttggaaactctgaagcggcggtgtactgataagagctggtggtgcactgttggtctgctgatcagaatactacatatgagaaccacggccacctgaagcaccatgagaatcctgaagtgctgactgaaaaggccttggaggatggcatctaccatacgaatctctacctccagacgaggtaccattgaatcggcctgaatgacgaggccttttgtcagacccctgaccacctccctgcgataaaaccatctcaactctcctggccacattgaccgcctcctggaaaaaaatctcactcccagtctccttggccatctgaagtcgaatcagctaaataagtcccttaatgaacctcctcaccccttctctctcggtgggaagtattataagagcatgacgagccaagtcgatgaatctggtctcatactgagtaacggtcatagatccatgctggagacgctcaaaccgcctctgataggcctctctttgagtgatagggagaaacttctacagaaataactgagtaaactactcccaagtcaaagctggtgatctggctggtctagccaagcaataatctctccaccaagtcttggagaatccagacaagcgaaaagtagcaaaattgaccccattggtctccactatccccatgttcctgagaacctcatgacaactatctagataatcctggggatcctcagaagatgcaccgctgaaagtagtagtgaagagcttggtgaacctgtccaacctccacaaagaatcggcagacatagctgctccatcacttgtctgagctaccgcacccaactgaactgctccaactagctgaactgctggagtctggaactggggagctaccagctccggagtgcaagtagcaggagtctaagctcctcctccagcctgagagatggttggggctataggaagcaatgctgcccgggtgacactctccataaggcccactagatggaccagagcatcctgcagtatgggggtagcaataaactcctctgggacctgagctaggcccatcggaactgtcgaggccagaacctcatcatcaatgtcaacctaaggctccgccgctggtgctgctgctctgggttgagctctacccctacctcggcctctagcacggcctcggcctcgccctttgcccctcgtgggagatgatgctgggggctcgggctactggtcagtggatgaggaatcacatgttctcgccatctgcgaaagaacagagtcgaaattcaattagcattgagaaaccaatcagcacgaccggaaggaataaatgtgaagtttttcctaactttgtagcctttggaagataaatacagatgtcttcgtaccgatccctcagactttactaagcttgtatatgaactgtgatacccatgtaacctagagctctcataccaacctatcacgacccgaatttcccatcctcgagagccgtgatggcgtctactggtgaaagctaggcaagccaagttattctaaatacttaaccttttcagtttttaaaccattatcagtgatgagtagatatcatgcaattagcgaaaattattaagctgaacacaaaagctgataattaatcttaatacaaactgcggaagtctaaatacagctctacccagaatttggtttcacagcctcacagacggtctaagaatactacatacaaagtctgaaagataaaatatacattgtttctgaaatgagtaaaggaaacaggataaaggaacgataggaggtgacgccaaggcccgcagacacctgcaggactacctcaggtcacttgttggactgaaggtagcaaccccactgcggtctgaagtctacaacattgggatctgtacaaaagagttcaaagtatagtatcagcaaaaccgaccccatgtgctagtaagtgtcttgcctaacctcggcgaagtagtgatgaggctaggaccagactactaaataaacctgtgcagttatatcataaacagccgaaatagaagcagataattagaattaacattgggcaggggaaacatgcttcggggaataacaaataacaatagaatatcaagagaatataaagaaaccaaaatcgaattactaacacggatagggaaaacagatgcagagttcactttcatttcacatctcgttgcaggcgtgcatcccgatcccgtttcatgtatctcattgtaggcgtgcaaccctatcccatttcatatatcttgttgcaggcgtgcaacccgatcccatttcacatatctcgttgtaggagtgcaaccagcttccatttcatatatcttgttgcaggcgtgcaacctgctcccatttcatatatcttgttgcaggcgtgcaacccgctcccatttcatatatttccgtggcagcgtgccacccgatcccatttacaaatcaacaacaatcacaaaagaatcccggaaagggaacaattatatttcagcaatatccggcaagggaacaataatgataataacatgtgaagtgcaataaatcacaacggagtcataacaattacaatacaagactcacgggcatgcttgacaccgacgtatagatactcatcaccatgcctatatgctgtaatccacaattaacacgtagcaaataagacacgactcctaatccctcaagctaaggttagacaaaacacttaccccgataccatgaacacaattcaaacctcaactatcactttacctcgtgattccaccgccaattcgcacgtatctagccacaagttacttaattacatcaataaatgctaaatgaatcaatcctaatgcatgaaaatgagttttctaaagttttacccaaaaagtcaaaaattgccctcaggcccacatggttaaaacccgaggtttgaaccaaaacccgattacacattcccccacgaacataaatatataatttgttttcaaattggacctcaaatcgaggtccaaatcctcaatttttgaaaaatctaggttctacccaaaatacccaatttctcccatgaaaatcattgattttgagttgaaatcaagtgaaaagatgttaaagatagaagacaattagttataaatcacttacaaatgatttggaagagaagttgcctttgaaaaattgccctacagagtttatgttttgagaagatgtgaaaaatggttgaaaatgcgtctaagttatgaacttacaggttgcaggtattacaattgcaatcagggttcgcaattgcgatcaaaggctctgctaagctcgcatttgcgaagtcgcttttgcgataaatttgtcgcatttgcgatgactggggagttcagggtatcttcgcatttgcggaatcgcttttgcgataaagtcgccgcatttgcgacccaaggcagcccaggccacttctcgcatttgcgactcattgctcgcatttgtgagccagacttcgcaattgcgaagcctacaagcctgaagcataccagataaaatttgcaacatccgaagtccaaattccaatccgtggcctatccaaaactcactcgagccctcggggatccaaaccaaacatgcacaacaacctaaaaatagaatacggactcgctcgtgcattcaaatcaccaaaataaatcaaaaactatgaatttagcatcaaatcatgaattttcttaagaacttcaaattttctcaaatacgatccaattcatgtcatcacaagtccgtttattaccaaatttcacatatttatcttaaatcacatataagacctataccggacaccgaaaccaaaatacgagcctaataccatcaagttcaaaacacgtatcatttccaaaaaactctataatattttagaaaataattttctttaaaaattcatttctcgggcttgggatctcaaaattcgattctgggcagacgcccaagtcccatatttttctacggaccctccgggaccgtcaaatcacgggtccaggtccgtttaccctaaatgttgatcgaagtcaaattaattcattttaaagtcaaaatttatcattttcacagattttcacataatggcttttcggttgcacgcccggactacgcacgcaaatcgaggtgatactgaaagaggtttttaaggcatcggaacacagaattcatttctaaaacaagtgatgacctcccacattctccacctctaaaataacagtttgtcctcgaacggacataagaaagaagtacctgagtcagggaaaagatggggataacgactctacatatcggactcggactcttaggtcgatgcctcagcaggctgacctctccactgaatacgaacagaaggaaaacttttcgatctcaactgacaaacctgccggtctagaatagctatcggctcctcctcataagacaagtccttgtccaattgatgcagtgtgggaaggtgattggttatgcatcaagacaattgaagaagcatgaaaagaattatccaacccatgatttggaattggctacagtaatatatgctttgaagatatggcggcactaattacacggcatccatgttgacatctacacatatcacaagagtttacaatacatcttcaagcagaaagagttgaatttgaggcagcgtaggtatcttgaattattgaaaaactacgacgtcgagatattgtatcatctcggtaaagccaatgttgtggcagacactctcagccataaatcaatgggaagcttagtacatattgaggcaggtagatgggggttgactaaagagcttcatcatctagccaatatgagaatcagattgttagactctgatgacggaggtgttactgtacagaatacatcagaatcatctttggtagccgaggtaaaagcacgacaatatgaagatcctatcttagtacgattaagagagagcattcagcagtgtaaaagtatggcttttgagatcggaagagatgggacactgagataccagggccgattatatgtgcctaatatggcagagttgcgagagaagattatgaatgagattcatcaatcccgatattccatccatcccggctcgacaaagatgtatcatgatgtcaaggagcagtattggtgggataacatgaagaagtctattgcagaatttgaagcccagtgtcccaattgtcaacaagtaaagatagaacatcagaaacccggtggattgcttcagaatatagagattccgacctggaaatgggaggtgattaatatagacttcattattggattacctcgctcttatcataagtttgaccctatctgggtgataattgatcgacttacaaaatatgcccattttctgccagttaagacaacttacaaggctgaagattatgcgaagttgtatatcaaggagattgttaggctttatggtgtgccggtatctattatatcagaccgaggagcttaatttacagctaacttttggaggtctttttagaagggtttaggaacacaattgaatctcagcactgcatttcatccgcagactgacggacaggctgaacgtaccattcagacactggaagatatgctacgagcatgtgttctagattttaagggaaattgggatgaccatcttccactcatagaattcgcctacaataatagctaccattctagtattaaaatggccccatacgaggcactatacgggagaagatgtagatcaccggttggatggttcgaagtcggtgaaacagaattatatgggccagatttgattcaccaagcttttgagaaggtgaaagtgatacaggagcgattgaggacggcacaaagcaggcaaaaatcttattccgatgtccgacgtcgtgatctgaagtttgaggttggtgattgggttttcctgaggatctcaccaatgaagggtattatgcgttttgggaagaaaggtaagctgagtccaaggtatatcgggccatataaaattcttcgacggatgggaaaggttgcttatgagttagaattgccatccgaattggaatttgtccacccggtattccatgtatctatgttgaggaaatgtattggagacccttcttgagtcgtccctatcaaagatgtacaagttacagaggacctatcatatgaagaagttccagtggcaatattagatcgacaagtccgcaagctgagaacaaaaaatgtagcttccatcaaagtattgtggaggaacaaaaatatggaagaaatgacatgggaagtagaagaggagataaagtctaaatacccttacctattccagaatgaagataacaaggatgctggtggaagacaggatacattggaatgtgaaacggctctatgaggtaagcaataatttgagaatactcctccttaatgcaaaatggtgatatgtagataatgtaaatatgaataatgctttgtgtagccttgtgaagccatatgttgggcttaattgcttgcaagtattgctagtgaccattttataggggaaaattgatcggaaatttccattggaatccacgatgatttaaactccccatgaacccttacattcgaggacgaatgttcctaagggggggagggtgttacaacccatatccacatgtgttagttcatgtcatatattagttaacataaatccaagaaggaattatctttgagatgataagaagtcaatcatattgctcttaagtgatacaagagtgtataagggtgattaacaagtattagaagttaaatgaatcaagaatgttgtaactcgtattttcaggtaaatctagcggtgcttaatacactcaagaggtcatgtattaaagtattttaatcatataatatctgtatcataagtattgaagtcaaacgagttatgaaacaaaagtcgacaaaagttgtctcaacttaggttcataattttacttaaacattaggtcaaatgtttctaatattttctcctaatttacaaggaattatggggttatctaccaaccaaattaaatatctatgagtctagtttccaacgcaataaaccgttcatcgatacgatctcggagtagagagatattcgcatttttgcaagactgcgccaagcacctctctatggggcccactaaggcggtttaagatatttggacctatataggattcctccaacccattttaagtcatttcttctcactattttcagaccttagaaccctaggaacatcctctcaaggttctctcaagattcaagacccaaaaaaggggcaaacaacacaaatcaagtgtcgggaattccgtggcgctagtaagtctcttgttcttcttgttattgctcatttttgtgtcgttctagctcgtgtgggaggttattttaaagggtttatgttttgtatatactccctcatgttattaatatcaatcctaggtgatttcaagccttctaaagtaattctagtgccgaaaaacactaattgatcgctagtttcgcttttttgttgttgtggcagcattggagggatatttcatggaaatgtaaggtcaattggagttgttatttctgtataaaggtaaggaacctcttactctatatgtatttaagattatccaagttgcagctaagccattgaagctagaacttgtgaaatatatatcaaaaggcttggtagtaatgttattgttttgtggactgttttgcgttgctgttgggctgcgtattttactactattttgtggagttttggaggaggaagggtgtggagaaacacaatatatatgtagggttgtgggatgatatttatttgtaacatttttgggtcgtttgacacgactacggtggtcgtcgtatgtatggagtgattaggctgtgcgtggacaattttgggaggctcaatatgtttattattgatgttgtttgggctgtttggtgactgttttgaatggtgtgaagtcatatatataggggaggtgttgtccatttcatcgtaaaattggttgtggtcgatacataatagttatgacgcttaaatgataacgatagtatcgtttctcttattgtagactaaggagttttgacaattgcatagcttgagattggggaagtatatacaaggtatgtgaggctatacctttccttcttttgcacgactccgattgtacataatgtaatgaacgagcttccaagatactctactcttagaagctagcaatacttacattgttttccctcttatggaacgattgatgttaatgttgcttctcttattcttatcttatcaatgttgttggtacttcctgattcttatacggttcatagtgaagagttagtcctaataacgtgtacagaggataccgaccttacgtcactcctaaaggtttagaatgtgattccatgagtcgagcatgcattatatatatgtatctattttaatttaccgagccacgctatagttggccgggtatggcacctattgtgaaactactgatcagttgggttttaccgagcctattatgaccgggtacgatatgatgatgatgatgcccacggaggcgaatgttttaaaggtttatgtatttatacatatgtatcatgcatttcatgttagtagccctcagaggtactaagatgttacaggttgtatattctctatccttgcttacactactgatcgtatttatggttccctgccttacatactcagtactttattcgtactgacgtccttttatttgtgaacgctgcatgttgtgctgcaggtcctgatagacaggcaggtgcagctcccccaccacagtaggctgtccagttcagcggtgattggcgagatcccttctccggacttgccttggtcttggtatgcatttttgttatagacattatgggtatgtcggggccctgttccggctatgttgcagcacttatgttcatttagaggctcatagacaagtgtcgactcatgtatagtttggtatgccttgtcggctggtttttgttatatagtcattcatggtagcgtggtagctcataccttatatgtagtttcttgattgtctggtcatcccctgctatgtatgttcatgccgtcatattttatttctggttgtccatgatccaggtctaccatttatattgatctcgtcagccctaaaagataataatgaaggttagatgaaatgtacgttggtgctcggcaagtatggtcgggtgctagtcatggccctccagtttgggtcgtgacaccaaatctcgaaccttgcggtcggcataactcttttgcctggactgagttgtacgaagcctatcctgaataatcctgaccttgtccaaggcatcttatactagatccgtacccaagaaccgagcctcccccggctcaaaccatccaaccggcgaccgacatcgcctgccatacaaagcctcttaaggagccatctggatactcgactggtagctgttgttgtaggcaaactctactaaaggcaaaaactgatcccacaagcctccaaagtcaatgacacaagctcagagcatatcctccaaaatctgaataggccgctcggactgcccatctgtctgaggatgaaatattgtgctcaactcaacctgtgtgcccaactctcgctgaactgcctccagaaacgtgaggtaaactacgtacgtcggtccgaaatgatagacacgggcacaccatgaagatgaacaatctcccagatatggatcttagctaacctctcgggtgaatagaagactgccacaggaatgaaatgtgctgacttggtcagcctatcaacaataacccacactgcgtcaaacttcctccgagtctgtgggagtccaacaacgaaatccatagtgatccgctcccacttacactcgggaagctcaattctctgaaacaaaccaccaggtatttgatgctcgtacttaacctgctgaaaattcaaacacaaagccacatatgcaatgatatccttcttcattctcctccaccaataatgttgcagcaaatcctgatacatcttagcggtgtctggatgaatagagtacagagaactatgggcctcctctaaaatcaactctcggagtccatccatattaggcacacaaactcgaccctgcaatctcaaaactccatcatcacctaaggtaacctgcttggcatctctgagctgcaccgtgtctctaaggacacacgaatgagaatcatcatactaccgatctcgaatatgctccaataaagaagaacaagcttctatgcaagctaacacacggttgcgcttagaaaaatccaacctcacaaactgattggccaaagcctgaacatccaaagcaagcgatctctcaccgatcggaatataagcaaaactgcccatactggctgacttcccactcaaagtatcagccaccacattggcctttttcggatgatataagatggtgatatcatagtcctttaatagctccaaccaccttgtctgcctcaaatttagctcctactgcttgaacaaatactgcagactcttgtgatccgtgaacacctcacatgccatgccaaatagataatgcctccaaatcttcaacgcgtgaacaatggctgccaactccaaatcatgaaccagataattcttctcatgaatcttcaactgtcgtgaagcatatgcaatgaccttgatatcctgcatcaacaccgcaccaagtccaatacgagatgcatcacaataaactatataatgccctgaacctgtgggcaaaaccaacaccgatgtcatagtcaaagctgtcttgaggttctgaaagctcgcctcacactcgtctgaccacctgaactgggcacccttctgggtcaacctggtcatcggggctgcgatagatgaaaacccctccacaaaccaacgatagtaaccttccaatcccaagaaacttcggatctatgtacttgatattggtctaggctagttcttaactgcctcaatcttcttcgtatcaacctgaataccatctgctgatacaatatgacccaagaatgcaactgaactcaaccagaactcacatttcgaaaacttggcatacaactgactatgcctcaaagtctgaagaaccactctaagatacttcttgtgctcctcccggctataggaatagatcaaaatatcatcaatgaagactatcatgaacgaatccaaataaggcctgaacactcggttcataaaatccataaaagttgctagggcatttgtcaacccaaatcacatcaccaagaattcataattcccgtaccgagtgtagaaagctatcttagggacattggatgctctaatcctcaactgatggtagccagatctcaagtcaatcttcgaaaataccttggcaccctgaagctgatcaaacaaatcatcaatcctctgcaacagatacttatacttgattgcaaccttattcaactaccgataatcaatacacattctcatcgatctgtccttcttcttaacaaactacaccggcgcaccctaaggcgaaacactaggtctaatgaaacctttttcatgcaagtcttacaactgctccttcaaatctttcaactcaggcggggccatacgatacggaggaatagaaatgggttgagtgcccggagccaaatcaatacaaaagtcaatatccctgtcgggtggcatacccggcaggtttgaatacccgacaggtctgaaggaaatacctcgggaaactcacgaacaacaggcacaaaatcaatagaaggaacttcagcactagaatcacaaacataggccaaataggctaaacacctcttctcgatcatacaccgagccttcatatatgagataacactatgggtagaatgactaggagtccttctccacactaaatgaggtaaacccggtaaggctaaggtcacagtcttggcatgatagtccaagatagcgtggtaaggtgataaccagtccattcccaatatgacatcaaaatcaaccgtccaacacaatcaaatctacacgagtattaagactcctaatcacaactatacatgaacaatagactcaatctaccgcaataaaatcatccactggtgtagacctagaaacaggagcactcaaaaaatcactagacatgaccagatacggtgcaaaataagatgacacatagaagtacgtagatcctggatcaaataaaacgaagcatctctactacaaactagaatagtacctttgataactgcatcggaagcctcagcctcgggcctggctggaagatcataacatcgggactgggcccaccaccctgaactatatctctaggacggcctgttgctggctggtctccacctctagcggcccgagctccacctctaatacctctacctcaacctctagcacctctacccccacctctagttggctgggggctgtggaacattcggtgcctgaaccatggcacgggaaccctgctgctgagaactgctcggtgctcgagggcaatatctagcaataagcctcgtgttgccacaagtaaaacaagccctcggctgctggggatgatgaccctagaaactctaaagcggcggtgcactaatagaagctggtggtgcactataagtctgctgaccggaatactacaatgagaaccatggccacctgaagcgccgtgagaaacgtgaagtgctgactgaaaaggcctaggaggatggtctctaccatacaaatctctgcctccagacgaggtaccactgaatcggcctgaatgatgaggcctcttctcagaccactgaccacctccctacgataaaactatctcaactctcccagccaaattggtcgcctcctagaaagaaatcttactcctagtctccttggccatctgaagttgaattggctgaataagtcccttaatgaacctcattaccctctctctcggtgggaagtatgataagagcatgacgagccaagtcaatgaatctggtcccatactgagtaacagtcatagatccctgctggagatgctcaaattgcctctaataggcctctctctgagtgacagggagaaacttctcaagaaatagctaagtaaactgctcccaagtcaaaactagtgatacatctggtctagctaagcaataatctctcaccaagtcttggcggatccagacaagcgaaaagtagcaaaatcgaccccattggtctccactatccccatgttcctgagaacctcatggcagctgtctagataattctggggatcctcagaagatgcactgctgaaaatagtagtaaagagcttggtgaacctatccaacctccacaaagaatcgggagacatagatactccatcacctgtctgagctaccacactcggctgaactgctccaactagctgaactactggagtctggaactggggagctacctgctccggagtgcgagtaacaggagtctgagcgcctcctccaacctgagagatggcttgggctacaggaagcaaacctacccgggggacactctccataaggcacactagacagaccagagcatcctagagtatgagtgtagcaataaaccactctaggacctgagctgggcctaccagaactgtcggggcggaacctcatcatcaaagtcaacctaatgctccgctgctggtgctgctgctctgggctgagatctgcccctacctcggcctctagcacggtctcggcctcgctctctacccctcgtgggagctgctcttgggggcttgggctgctggtcagcggatgaggaagctcgtgttctcgccatctgcaaaagaatagagtagaacatcaattagcattgagaaaccaaaccgcacgacatgaaagaataaatgtgaagtttttccttaactctgtagcctttaggggataaatacaaacatcttcgtaccgatccctcagactctactaagattgtctatgaactgtgagacccatgtaacctagagctccgataccatcttgtcacgactcaaattttccacactcgagagtcgtgatggcgcctactagtgaaagctaggcaagccaagttattctaattacttaaccttttccagttttaaaccattattagtagtgagtagatatcatgcaattagcgaaaataatcaagtggaagacaaaagctgataattactcttaatacaaactgcggaagtgtaaatacagatctacccagaatttggtgtcatagcttaacagatggtctaagaatactacatacaaagtctgaaagataaaatatacattgtttctgaaatgactaaaggaaacaggataaagaaaagataggaggtgacgccaaggcccgcgggcacctgcaggactacctcaggtcacttgttggactgaaggcagcaacctcactgcgatccaaagtctagaacactgggatctacacaaaagagtgcagagtatagtatcagcacaaccgaccccatatgttggtaaatgtctagcctaacctcagaaagtagtgacgaggctaggaccagactactaaataaacttatgcagttatatcataaacatcgaaaatagaagcagataattataattaacattgggcaggggaaacatacttcggggaataacagataacaacaaaatatcaagagaatataaagaaaccaaaatccaattacaaacatggatagggaaaacaaatgcagagctcactttcatttcacatcttattgcaggcgtgcaacccgatcccatttcatgtatctcgttgcaggcgtgtaacctgatcccatttcatgtgtctcgttgcaggcgtggaacccgatctcatttcacatatctcgttgcaggcgtgcaacccgctcccatttcacatatctcgttgcaggcattcaacccgctcccatttcatatatcttgttgtaggcatgcaacccactcccatttcatatatttccttggcagcatgccacccgatcccatttacaaatcaacaacaatcacaaaagaatcccgacaagggaacaattatatttaaacaacatcccagtaagggaacaataatatcatgacaacatcccggcaagggaacaataatgataataatatcccagcaagggaacaataatggtaataacatcccggcaagggaacagtaatgataataacatttgaagcgtaataaaccacaacaaagtcataacatttacaatacaagactcacgggcatgcttgacaccgacgtatagatacttgtcaccatgcctatacgtcgtactccacaattaacacgtagcaaataagacacgactcctaatccctaaagctaaggttagaccaaacacttacctcgatgccacgaacacaattcaagcctctactatagctttaccttgtgattccaccaccaattcgcatgtatctagccacaagttacttaattacatcaataaatgctaaatgaatcaatcctaatgcatgaaaataagttttctaagttttacccaaaaatctaaaattgcccccgggcccacatggtcaaaacccgaggttcaaaccaaagccagattacccaaatcccccacgaacccaaatatataatatgtttagaaatcggacctcaaatcgaggtccaaattgccaatttttgaaaaacctaggttctacccaaaacacccaatttcccccatgaaaatcattgattttgagttgaaatcaagtgaaaagatgttaaagattgaaaaaattagttagaaatcacttacaatagatttggaagaggagttgcctttgaaaaattgccttagagagtttatgttttgagaagatgtgaaaatggttaaaaatgtgtctaagttatgaacttacaggttgcaggtatcgcaattgcgattagggttcgcaattgcgaacccaggctctgctaatctcgcatttgtgaagggactttcacatttgcgaagtcgcttttgcgataaatttgtcgcatttgcgatgactgggagttcagggcatcttcgcatttgcgaagggactttcacatttgcagaatcgcttttgtgataaagtcgtcgcatttgtgacccaaggcagccaggccaattctcgcatttgcaactcattgctcgcatttgcgagccaggcttcacaattgcgaagcctgcaggcctgaagcataccagataaaatctgcaacatcctaagtccaaattccaatccgtggcctatccaaaactcacccgagccctcggggctccaagccaaacatgcacaccaacctaaaaacatcatatggactcactcgtgcattcaaatcatcaaaataacatcatcaactatgaatttagcatcaaaatcatgaaatttcttaagaacttcaatttttccaattttctcaaatacgatccgattcatgtcatctcaagtctgtttattaccaaatttcacagacttatcttaaatcacatataagacctgtactgggcgccaaaaccaaaatacaggcccgataccatcaagttctaaacacgtatcatttccaaaaactcaataatattccagaaaacaattttctgtaaaaagtcatttctcgggccttgaatctcggaatttgattccgggcatacgcctaagtcccatattttattatggaccctccaggaccttcaaatcatgggtatgggtccgtttacccataatattgaccgaagtcaaattaatttattttaaagtcaaaatttatcatttttcacataatggctttccggctacgcgcccggactgcgcacgcaaattgaggtgatgttgaaagatgttttaaaggcatcggaatgcagaattcatttctaaaacaagtgatgaccttttgggtcatcatagtgcgagaccgtagaaacagtcgccctctcgcagatgcggccaaggaaggccaggccagaaaccgcaaaagcggctccgcaaaagcggcttcaagatcgcagaaccggtcccagcccacttggcccttctacaaatgtggcctcttcctctcagaagcgggaccgcagaagtagaaattgctgaagcagtgagcttcatttaatacaagtcctaagtcatttttgccccttttcactcctcctttgggcgattttggagctttggagagaaaacttccacctggcgccttgaggtaagtttaacccacctattcctagtttaatacttatgtattaggtagattaaacactaagattaaggtaaaatcatggggttagggcaaaacctagggttttgacaaaagttggatttgaccacgaaattttgctatgaaatgaattagaaatcatatattattgatccttagattatagagaataactttttcgaaaaatttcgaaatccgggcacgtgggctcggggtcgaattttaggaaactagtgttaagggttggtaaattgcttaaatagctagaatacgatcttgtgagcttatattgactagttcctacctcatttaactagctttggatcattcgtctccaaattgagagtttgggatcgttcttggcatttgaagtatactttggagcgaggtaagtatcctttataatcttgtaagagggaattgtccccataggtgtaataattgaataaattgctactatatgtgcgggctacgtacgcactaggtgacgagagtccatgcgtagctactattatgctaagtccgggtagtctaggacccaaaaacatgctctatgtgatattcttgtaacttcatgtttaattcgaatttgtataaatcatgttgattggggtaaatgagactagtaagaggaacattatctttcttggcctttaaagagaaattgattatttctatgtgtaattgtttcccagatatacactattgtctgtttgttgttgtgttatttatatttgaccgcgtcgcatgtttgattcgcgagcggggtaatagatgcatatatggttcgtgttgttcgaccctcggtagtgcacaatttaattttatgttggatcgagccgtacaaccctcggcattacttgcgcaagttttacttagtatttttctgtggactgaacttcgtttatgccttggaatgcagatggttaactatgatattatcaggaaaatggaaccattatttcttgcgatgaaatgctaattaattgtactatccatgcttagtataaattctttctcatattatttgaccctagtaagtataaagtcgacctctcgtctctacttcttcgagattagacgggatacttaccgggtacatattgtttatatactcatactacacttctgtacttaattatgcaagatctgaggtagttacctctggctatcagtctggtgcgtattcctaagcagatttcgagacttctacaatgagttactttccttccagtgccgttcagcagctagatggagtctctcttatttatttttgatgtctattctattttggacagtaggatagattgattcttttgtatattctactagtttcccacaacttgtgacaccaggtcttggcacccacaatagtagattattcttttggggattgtataattatttttggtacattactggttattactcgttcaaatcttaacttaagaaattattgcaagtatgttggtaaaagtaaaatgagagcttatttggtatttttccgcgttggcttgcccgacaatggtgttgggtgccatcatgacctattatggaaatgggtcgtgacacgaattgcttaaaagtcaaaaataagccaaaagacataagctggtcacctccagcttatgaatttttagcttataagaactttaagtttgaccaagatttttactattttatccttaaaatattcctttttagaacaaaattcctatcttgatactcactgcctcaagtattttatcaacttaaccccctccccccgcgcctctttaagtctgcaattctcattgactatttaagataagcaaattctctatttctttgcaaatttgtatctatgtgattgtgtattaacctttgaactgtatgtaataaatgaggatatatcatatttttggtgtattgttttctaagtgttgtggtgatgaaaatttctcttcaaatattgtgtcctatttatgtagaaacttttgtcaatttattaatcattataacttatgattatatgattatcgtaaaaaaattatattatcataaaaattattttatctaagcacagttgtatttaaaataaaatggcaaatagcatattttgtagttgaatcaatttgaaatctaaaattttgtagaaattacgtctttataagtataaaaagttctaaggttatttaagttattttaacataaaaagtacttatcaacatttttttatcaaatactgcagcaacttattatcaatttcagcacttgttcccaaacacataactggtaatttattaaatcagttttagcacttaaaaatgtttttcagcacctaatgcctatcatctacttcaaatcaactaatccaaacgggctctaatttagttcaatttactaagctaaatagcatgggctagccagttttcggattgatcattcaaaaatagccagtatttgtaaagtgattgtaaaatagccactattttgctgcaacagggaccagtccagcataatatattggagatttgtgcacctgtatatgaacttccagcatattatgctagaactccaacacgcggaaagttccaacataatatactggagataggagcacctgtgtatgaacttccagcatattatactggactggtatattatactggaactccagtatattatgctggagttccaatatacttatgctgaaactccattataatatgttggagttccaatgtacttatgttggaattccattataatatgctggagttccagtatacttatgctggagtatttttcggagtttgaacagtattttcgttcaaatttatctttacataaaaagtgggtaattttcgattacttttaaagctatagctgtttttggatgatcacttataaatttgattatttttaaatttctccctcgtaaatgagccaaatgatcatcaattcaaaatatcagcaccatcaattcttttaactattctagtaaataaataaaaaatcgtaacaaagtaatacgacattctagataggaaaatacaccccttcaattcaaacaaatatagtgtacgtaatttaatcatattcacaatcaaattgccacttattgatgattgacacataactataagcaaaacaggccaaagcaacttcaataagaaaataaatacaccgcttccatcaattattacaaataaaataatattcctagttcatgtattaaggagtacgatttattttaattatgtagcaggcactataaacatattgggtagagctgtcaaaacggaccagcccagcccagcccagccaagcttcgtgggcttttaaatttggtgagctaggccggcctggcccgccatatgaatgggccttgaaatggtcagtccaacccagctctaagagggccgcgggctagggcgggccggcgctccgatttttttttagaaaaaagaatttctttaaatcctcaaatattttttaaacaacttctgtttgcttagagcgtacaaaaagcttgatatttgacgagaatctcgtaattgaaatacaaattctatatatctctaactcttcttttctaaagttacatgaatattttcttaatacttttctttcatttttctcagattcacggattgcttcaatacatttatatcctgagtttttttaatttatgatttacataatttgctgatttcatcattataatccataaaaactttaaaattcctaagatttgatagtggtcaatttttatttgtgtatttaaaattgatctttttatatactgaagagcagtttaaatattttctatacttaaagtatattttcttttgaaaaaagattattattggtcacctaaaacttttcgagttcgttattaattaagtaaaaaaataataattttttcatattacatacatgtcaaaaatctaaattccagttaatatggaagggtaaatgagtaatctaaggttggggaataggataatagttaatagttttttagtttttacttttttaaatattaaatatttaataatgtcacgaccctaaacccggaccagtcataattgcgcctctcgtgaagacaaggccagccagttaaacccaattccatttttaaacagttaaacaataagaaacagtctaagcatgaataaatatatcaaagtagtggatgatattataaatatgcggaagaacaacccaacacagccgatatcggggtgtcactagtcatgagcatctataagtcataatacaagtctgctaagtctataagctagtacaaatgtctgaaagaagatagaaatgataaaggaggagaaacacaggactgcggacgtcaagcagctgcctcgtggacttcgatatctgccgggagatctcaactcgcactagcaggatccgcaacgcctgaatctgcacacaggggtgcagggagtaaagtgactactccaactcagtgagtaaaaattgtaaataaagactgaaagcaagaaatcacgtaaggcacaaagtattttataataaagcagtaaaacaattaaaacagtaaactagtgaaagataggtaaaattctttaactcaaacgtagttttatgaaaagcctttttcaataattaagcatgtaattgacagtcaattgtgaaaagtaaacacataaaggcctgtccctcgggcacagtatcaacaaatcctcccttcgagcaacatctcagaacagtaccagcccctcgggctcaatctcatatcacaatgggtatccgcgctcactgggggtgtacagactcctggaggagccccttacggcccaagtacaatatcaagccacctcgtggcatcatcactaggcccttggcctcatatcaatcaggccacctcgtggtgtacatatctcatgtcctcagcctcataatcagtaccaaatgtttcctcacaacataggcccttggctttactcagtcaaaaaacctcacaagccacccaggtagtagtaaaacatgtttttcagcccaaaatatcatttaaaagatcatgtaagtgttaaaacagagtaaacatggctgagtacgaaaaacagtaaaatataacatgactgagttcaagtataaagtcaaaacagtgaggaaataccagtaaaaatccccgaagggttcaaatagttggcacgaagcccaaatatggtattcaacgcaaataatgatgatagcaaatagatttcagtaaaatacgcagtaaaaccatcgatcgggacggaccaaatcacaatccccaatagtgcacgaccccacgctcgtcatcaagtgtgtgcctcacctcaatatagcactatgatgtgcaatccggggttttaaaccctcataacatcatttacaatcattactcaccttgaacctgtcaaagctctagttcgcgacgcctttgcccctcgaatcggcctccactcgcgttgaatctatccaaaatcagaacgaggaagtcaaaatatgctaggggaacgaagcccaagcgaaaataatcaaaatacgacacaaatcccgaaattactaaaacccgacccccgagcccatgtctcggaattcagtaatttttacattaatagattcattatctccccacgagttcatacatatcaaaagttctgaaatccgacatcaaatggtccttcaaatcctcaatcaaaggtctacatttccaagccctagtttccccaattttcacccttaatttccatgatttctagctctaatccgtgaaataatagcataggaatgagttttaggtccaaattacttacctcaatgaagttcccttgaaatcaatctttcaaatcgtccaaagctccaaagccgagataaaaatggtgaaattagctcaaattcgggaaggccacaatttatactttctgcctagccatttttgcatctgcggctatatttccgcttctgcagtaccgcatttgtggttcttcctcctcttctgtggaaatcacttattccccttagtccgcatctgcagcatcgcagatgcagtcctcttagccgcttctgcggtcccctacctgcatctgcggcatcacagatgcagacctcttagccgcttctgcggttcctgcacctcaagccattttcgcttttgggaacaattcctccccttatgcggcgccgcacctgcggtcccctatccgcaggtgcgaaaataccagaagcagcaaattcagcagctgcaacaaagtccaaacttctccgtcaaccatccgaaatcaccccgaggacctcaggacctcaaccaaaagcatcaacatattccaaaaccttattcaaacttgtaccaatcttcaaaacacctcaaacaatatcaaatcaaccaaaacacatcggattcaagcctaattttccaaaatcttccgaattccgcttttgatcaaaaacccaatcaaaccacgtccgaataacctgaaatattgcacacacatcccaaatgacatgacgaaactactgcaactcttggaattccattccgacccctatatcaaaatctcgcctacccactgaaaaattgccaaaatatcaacttcgccaattcaagcctaaatctactccgaacctccaaaactcattccgatcacgctcctaagtcccaaatcacctcccgaagctatccgaaccatcagaactcacattagagccctctaacacataagtcaacatctgggacttttccaacttaagcttcctcaaaagagactaggtgtctcaaaccttaccaaaatcattctggattcgattcgaccaacccgataccacataacacggataaaaaaagcataaagaagaagaaatgggggaaacggagcggtaactcatgagacgactggccaggtcgtcatatcctccccaacttaaacaaacgtttgtcctcgaccgaatcaagaaatatacatgaagcctcaaacaggtgaggatacctactctgcatatcgcgctcggtctcccaggtagcctcctccacgggccgacctctccactgcactttcactaaagctaatcctttgacctcaactttctaacctgacgacccaaaatagctactggctccacttcataagtcaaatcatcatccaactgaactgtgctgaaatccaaaacatgagactgattcccaatatacttccggagcatagaaacatgaaataccggatgcacactcgataagctggatggcaaagcaagctcataagccacctccccaatcttccgaagcacctcaaaaggcccaatgaaccgcggactcaatttccctttcttcccaaatctcataacacccttcatgggtgaaacctttaatagaaccttctcgccaaccatgtaggacacatcccaaaccttcctatcagcatagctcttctgtttcgactgcactgtacgaagcctctcctgaatcaccttcaccttttctaaggcatcctgcatcaagtctgtccccaatagcctagcctcaccaggattgaaccaaccaactggagatctacaccgcctcccatacaaagcctcatatggagccatctgaatactcgatcggaaaccgttgttataagcaaactctgcaagcggtagaaactgatctcatgaccctccgaaatcaatgacataaacacgcaacatgtcctccaatatctgaatagtgcgctcggactgtccgtccgtctgagggtgaaaaattatgctcaactcaacctgagtacccaactctcgctgcatatacctccaaaactgcgaagtaaagtgagtgcccctatctgaaatgatggaaactaggacaccatgcaactgaacaatatctcggatatagatctctaccaaccactctgaagaataagtggtacgcataggaatgaagtgcatgtacttggtcagccaatccacaatcagtcaaataacatcgaacttcctcaaagtccgtggaagtccaactacaaagtccatagtgatcctctcccacttccactctggaatatctatccgttgaagcaagtcgcccggtctctgatgctcatatttcacctgctgacaattgagacaccgagctacaaatcccacaatgtctttcttcattcttctccaccaataatgttgtctcagatcctaatacatcttcacggcacccagatgaatggaatactgcgagctatgggcctcctccataatcaactcccaaagcccatccacattaggcacacaaatctggccctgcatactcaataccccatcatcacctatagtcacatctctggtatcatcgtgctgaactctatccttaaggacaagaaaatgcggatcatcatactggcactctctgatgcgatcatataaagaagacggataaaccacacaagccaatacctgactgggctccgaaatatctaacctcacgaaccgattggccaaggcctgaacatcaactataagaggtctctccccaactggaatatatgccaaactccccatactcactacctttcggctcaaagcatcgtccaccacattggcctttcccagatggtacaataaagtgatatcataatccttaagcaactccaaccatctccgcctaaaattaagatccttctatttgaacaagttatggaggctacgacgatcagtaaacacctcacaagacacaccatacaagtaatgcttccaaatcttcaatatgtgaactatggcagccaactccaaatcatgaacgaggtagttcttctcatggggcttcaactgacgagaagcataagcaataactctaccctcctacatcaacacacaaccaatgccaactcccgaagcatcacaatacacggtatataaacctaaagctgatggcaaaactaatactggagttgtggtcaaagctgtcttgagcttctgaaagctctcctcacactcctccgaccatacaaatgaatcacccttctaagtcaacctggtcaagggcgatgcgatagatgagaatccctgaacaaaacggcaataataacctgccaaaccaagaaagctgcgaatctctgtggctgaggatggtctgggccaactctgaaccgcctctatcttcttcggatcaacctgaataccctcgctggacaccatatgccctaagaaagccactgaactgagccaaaactcacacttggacaattttgcataaagcttctcctctctcaatctctgcaacacaactctcaaatgctccgcgtgctcctcctgactacgtgaatacaccagaatatcatcaatgaagactatgacaaactagtcaagataaggccggaacacgctattcatcaaatgcatgaatgctgttggggcattggtcagcccaaaagacatcaccaagaactcataatgaccatattgggccctgaaagctatcttaaaaatatttgaatccctgatcttcaactggtgataacctgaacagagatcaatcttggagaacaatctcgctccctgaagttggtcgaataagtcatcaatgcgaggcaaaagatacttgttcttaattgttactttgttcaattgcctgtaatcaatacacattctcatagtgccatccttcttcttcacaaatagaaccgacacaccccaaggtgacacactaggcctaatgaaccctttatcaaggagtttctgaagctgctcctttaattccttcaactccgctggtgtcatacgatactacggaaaagaaatgtgttgagtgcctggcaccaggtcaataccaagttcaatatccatgtccggtggcatgcccgacaggtctgcaggatacacatcgataaaatccctcacaattggaataaaatcaatattgtgagtctcagcactgacatacctcacaaaggctagaaacgaaagacaacccttcccaatcatatgttgggctttcaagaatgagatcactctactgggaacataatagtcacaccttgccactcgatccgtggcacactcggtatagccaatgtgactgtcttagtgtgacaatccagaatagtacgacacggagatagccaatccatgcccaaaatgacatcgaaatccatcatacacaataacaaaagatccacacgggtctccagacccctaatagtcaccacacatgactggtacacacggtctacaacaacagtatcacccaccagggtagatacatgaacaggtgaagcaacaaactcacggggcgtacccaaataatgagcaaagtatgatgaaacataagaaaaggtggaaccgagatcaaataatacagaggcatatctgtggcagactgaaacaatacctgtaataacagtatttgaagcaatagcattgggtcttctcgaaagtgcataaaacgggtctgaccaccacctgatcggcctcccctctctagggtgacccctagctgattgggcgggtggtggtgaagtaacttgcgctgaagccgatgactgattcacccgcacgccttaaactggaaccaacatagcacataaccgtgcaatcgaccaattaatagtggaccccccacttggctcaaagccatagatcaaaacataaacaataactcataacacatatgctttattgtttccataataccctagtgagattaaactcaacccttcataagctcgtggaacacagaccatctggtactttatatcttctacaaatcttgcattcactctcatagtagtcaagccttctctcttgagcaactcaaattcaagttgtaaagcatatacttccctagtaacagagatcttccaataaatgacacaagggattacgcaaacttcaaaataatccgcaagagataaccccacctgctttgcctcaaactaacatttctgtataccttccaccgtcataaacattacgcaatcacttaaacttcctgagtctgaactcataccgcaatatgaaatttactccactcctaactaggaaacatggaaagattcttcacacacacataactcggggctatacctcaaatcaagatgaaaatcgagcacctaatagtccttctatcatctagcagacccttctcgttgcttccaaatcacatgaatacatctcgcagtcacatcacactcatcacaactatctagtcatcacctcccttaatagggacacaatagacatatggatccagaaacacgcacttacgaaatcaacagctcaaggctcaagctataggcaaaaatttgtccttgagtcctctagactagcccaacatcaatgcagagagatcacatctctcccaatcataatccatcgatgcatatccgataccgagcgcacatgcgcatatactaacgcgtggaaagaattcaaagagttacttttcaagctgaatcaaggacacacgagaagaattcaagaatgtgaagtttttcttaaaggttatccagcttctcgaggataaatacagacgtctctgtaccgatccgcaagactctactaaacctgctcatgactcgtgagacctatgtaatctaggctctgataccaacttgtcacgaccctaaacctggatccgatcgtgatgtcgcctctcgtgaagacaaggctagatagttaaacccatttccatttttacacagttaaacaataagaaacagtctaagcatgaataaataaaccaaagtagcagatgatattataaatatgtggaagaataacccaacacaactcaatatcggggtgtcactagtcatacgcatttataagtcataatacaagtctgctaagtctataagctagtacaaatgtctgaaaagagatagaaatgataaaggaggagaaacacaagactgcggacgtcaagaagctacctcgtggactacgatatctgtcgggagctctcaactcgtactagcaggatccgcaatgcctgaatctacatataggggtgcagggagtaaagtgagtactccaactcagcgagtaacaaatgtaaataaagactgaaagcaagaaatcacgtaaggcacaaagcattctataatgaagcagtaaaacaattaaaacagtaaaccggtaaaagataggtaaaaatctttaacccaaaagtagtttcatgaaaagcctttttcaataattaagtaggtaattgacagtcaattgtgaaaagtaaacacataaagtcccgcccatcgggcacagtatcaacaaatccgcccctcgggcaatatcacagaacagtaccagcccctcgggcttaatctcacatcacaaagggtacctgcgctcactaggggtgtacagactcctagaggggcccgttacggcccaagcgaaatatcaagccacctcgtggcatcatcactaggaccccgacctcatatcaatcaagacaccttgtggcgtacatatctcaggccctcggccttactcagtcaaaaatcctcacaagccactcgggcagtagtaaaacatgtttttcagcccaaaataacatttaaaagatcatgtaattgttaaaatagagtaaacatgactcagtacgaaaaatagataaatataacatgactgagttcaagtataaagtcaaaacagtgaggaaataccagtaaaaatcccgaagggttcaaatagttggcactaagcccaaatatggcacttagcataaataatgatgatagcaaataaatttcagtcaaatacgcggtaaaaccatcaatcgggatggaccaagtcacaatccccaatagtgcacgaccccacgctcgtcatcaagcttgagcctcacctcaatatagcactacaatgagcaatccggggtttcaaaccctcaaaacatcatttacaatcattactcacctcgaaccggtcaaagctctagctcgcaactcctttccccccgaatcggtctccactcacgtcgaatctatccaaaatcagaacgacgatgtcaaaatatgataagggaacgaagcccaagcgaaaataatcaaaatacgacagaaatcccaaaataaccaaaacctgacctccgggcccacatctcggaattcagtaatttttacattaatagattccttatctccccacgagttcatacatatcaaaagttctgaaatctgacctcaaatagtgcttcaaattctcaatcaaaagtctaaatttccaagccctagtttccccaatttttacccttaatttccatgatttctagctctaatccgtgaaatagtagcataggaacgaattttaggtccaaattccttacctcaatgatgttcccttgaatccctttttcaaatcgtccaaaaaactccaaagccgagataaaaatggtgaaattagctaaaattcgcgaaggccacaatttatactttttgcccagacattttcgcatctgcgactatatttccgcttctacgatactacatttgcggttcttcctccacttctgcagaaatcacttattccccttagtccgcgtctgcggtcccctacccgcatctgcgacatcgcagatgcagtcctcttagccgcttctgcggttcctgctcctcaagccattttcgcttttgcgatcaattcctccgcttatgcggcacggcacctgcggtcccctatccgcaagtgcaaaaataccagaagcagcaaattcagcagctgtaacgaagtccaaacttctccgtcaaccatccgaaatcaccccgaggcccctaggacctcaaccaaaagcaccaacatatcccaaaaccttattcaaacttgtaccaaccatcaaaatacctcaaacaacatcaaatcaaccaaaacgcatcgaattcaagcctaattttccaaaatcttccgaattttgcttttgatcaaaaacctaaccaaaccatgtccgaatgacctaaaattttgcaaacacatcccaaatgacacgacggaactgttacaactctcagaattccattccaacccctatatcaaaatctcgcctatccaccgaaaattgccaaaatatcaacttcgccaattcaagcctaaatctattccaaacctctagaactcattccgatcatgcttctaagtcccaatttacctatcgaagctatccgaaccatcggaactcacatccaagccctcttgcacatagatcaacttccggttgactggaaatggacttttgagtaaacgtccccaaaatgggttttatgtgatctcaacagcttcatattgtgattttggacttaagcgtccgtctgaattcaaatttggaggtccttagggtaatgaggggtttcagcaaaagttggaaaaattgaagtttggaaagtggagacgtttgacccatagtggacttctatgatatcggggtcgtaatgtgaatccaaagttggaacagctccgttatgtaattttggactagtctgcaaaatttggcgccattccgggttgatttgatagatttcggcacaagttttcgaagttggaagatttggaagttcatagtttgattcatggtatgattcatcatttcggcattgtttgatatgatttgagacctcgagcgagtctgtgttaggttatatgacttgtttgtgtgtttagacggggtcccgggggctcaggtgtgttttgggtgtgttttggatcattttgggctactttggatgctgattatctgatatctggtattgttcttcgcgttcgcaaggagcctctcatattcgcgaagaagaatttggcttctggaagtttgttcttcgcattcgtgaagatactctcgcgttcgcgaagaagaaaatcttgattgcacaagtctgaattcagaggctcatatctcacaatttataaagaatttggagatgatccaaaaatgaaagttttagcctttgtgtctagttttcggaaatgtaaattaattggcatttagatttgtgtacaaaaattgatggtagttacactacaggctgcccgggagagtttgaaattctctactgcataggtttgaatttggaagcttatatctcaaaatatataatgactccggaaatgataaacctatgaaactatagcccttggtgtctagttttcagaacatcaaaccacttgtcatttggagatgtgtgaaaaacgttatggccattatactaaagcttgtctggaatgagtttggaaatcgctgatgaggaatttactcattgtgaatgcgagagaagggtcgcgaacatgaagaacaaaccctgggcaggcagaatatattcccaaatcaagggttagaccattttattcatatcttgacttgtgaagctcggttttgagtgattctttgagggtttttcacacaaatagattggctaatttggttagatttgagccgttcggaggttttttcacccgagaagtgcattttagagtatcggtttgtcatctttgaggtaagtatcttgcctaaccttgtgtggggaacttcctcttaggatatgagtctgttatgttgattgtagttagtgtacgcgaggtgacgagtgcgtgctcggacttatttgtggaaaaattggccttttagggttcttaggtccttatattcattgtgtatgaatgtgtacttgatatacttgagttttacacttattagtttcacctctacatgctctaattggaattaattgcatatgatttattcttattgcctatttgactcttattttgcttaactaaagatttttacctcttctattgttatgttatctttcataactgctcgtctttattggaaatcattattatctcccccataattgtttagtcttaattgaggttatgattatctttccgttgctcatccttaattgaaaatattgtatattcttcgtaaattgcccaaccttagaagaagtttagatatcctatatttagttgacatttccttatttggatttatttgattcgtgttagcttccttgttgttgaattacatattgtcggatcgttgcttcatattattttctcccttgttgggctattcttattacgcttagtattctctattgtggttattccttgtgagctagttttaccgtcaccttgtgatcgaaagttcttgtgttgatttacttatcgtgttcttgtatatattgtcattgttgttgttgtatttattgtggtggtgcatgaggtttctgcagtgcaattgttgatattgtgatgcgcgaggtttctgtcgtgcagttgttattatgaggttgcacgaggtttctgtcgtgcagttgttgttatggggttgcacgagttttctgtcgtgctattgctactattgatttattggacatgcagtgtgacaaggcggggtatgtatatatatacttgtatgtgggttgcgcatgtggcgagacaaggtgggaacattatgatgcatgtgtggagaaacaaggcggacacttattgtgttattattttcacacatggtgagacaaggtggtctatgtcagggattgattgtgatgatttgtgatggcctgggggcattcttgttgtttgatattgtgttgtggtatgcttacctgtatgatctttatctcgtgaaagttgtgaggaaacatcttgcgtgatgtccgttcttttccttatgcttattagctggtaagaactatgttaaagcacttgcacaagcatacacgtagttgaacactcctgttggatgtgaagtcctcctgattttgctgagtatagatgcacacccttgtttacttgttatatatgtgagagtggctctagttagcaagtgagttgtcagcatgactatgaggtgtgatgggggcacaggatgccaagtgttagatttcaggtactgggactcgtgagctgtaatttgtccgagattcggtatttcgtggaaattgttggataagacctgatgtgaacactgtcgtaggatctaagttattgcttacctttactgtattgtgaatttaggatttgggtttgtgtttgcgctcgctcttctatgtcattattttggtatttccactattacttgctattttcttcccttattatgattgtagtattgttagccatttcgtgtagtctttatatatatatcatgtttcgttgttcctatatttgtacagtttattggactggtaggtgtcttaactgttcctcgtcactactccaccgaggttagtcttgatacttactgggcaccgctgtggtgtgatcatgctactcttctgcacatttttgttgtgtagatccaggtatcgatcattagtagttgtgcggatcattgctgaggaaactcaaggtaaacttgttgcttcgttcgtaggttttggaggcaccgtcttacttgtattaaactgttttcactcttttccaaactgttatatttagaagtggtagataactctgtagagcttatgacttgtactaccgggttttgggaattataaatttttttgagatttctacttcaagactgttaaatgtcatttattattgtggtatttcagtatgagttaggcttccctagtccctaagactaggtgccatcacgatacccaaacggagggaaagttgggtcgtgacatattcaccattgatcattgtgtacctgtgaaaatgagccttgagtctactatggtttaaaggcctgggttgcccgggtgtatttgggcctgttgcaggctctctatagttttacttaccttttgtaatttgtttattaactctggtttgtaataattattgtaataacaattctggggtatttagtaaattgggaagggtttcttattttcatttgcaaagtcaggtagaaatcctgcctatagggtctctatttgtgctgttaattctgcttataagttccctattagaaatcctgcctataggttctatgttgtgtttacatgtaagaaatcctgcctataggactgacgttatgatttgatgaaaatcatgtctttaggtgtatcaatctgtccaataaacgtgtgttagaaatcatgcccataggatcaatgtttgtcccaattgttttctggctcaatgtgtataaattcttgctcatatactgctcaattcaagaaaccatgcctataggatttaacaataattttggacttgtgatttactgttgagacgcccagatattatactgaattaaaatcggtaggcaaatatatgtaggccctagcacttgcatgaagaaatgtctctgcatgctactactcgcctgttcatcacatagatatcctgcctatagggctctaagattaataaagcctgctaaatcagttatgtgcatttgttgttaacatgtagaggttaacatgagcccatacctgtctttatttgaaaagtcctaattgttttgcttgtcgattagtattttacaattttgagaaccttagtcctagtctataactttactaaatagaggtcccatgcctccaggatcttaggtaagggacggctagtgcacgtataggacacgggttagaattaactagagcactttaggtaaaaactcaaagatagtaatcaagtagcagaagatgatagcttgtgcccgctggataatatgagtaacacccccgtcttgggagagttacgaagtattatttatgttgcatggggtgatcctataggctaaataatttaggaccatcatccttattgatatattatttgcttctttagactaattcgcataatttaagttcgatcgagacctaccgttatgaacctcgaggggtgcctaacaccttcccttcaaggtaatttgagcccttacccgatttctgatgatgcaaactagtataatctaagttatttgttatagtttccctaacgcgccttaatccgttaggtggcgactctaacaaccaattcctttccctactctctcaaaaggagttgtcaaaatgtcgaaacccgtttttgcgagaaaaagggggtgcaacagaatggcgactctggtggggatatctttaagctcttaccacaacgacttgttttgtgaattagtctttctcaataaggatgtctttgttattctgtttatacttgcgcacacctttccctttccactctatatgaacttatttgccttccctcattcaattgtgctcactaaatttcttctttttgttttattgcttttttactatggaaactaactcttctccttgttttctttcttaaacacctttgcaattattaaatactgaattttatcattctcatcgtgtaaatacttgataacgtgttatttttctttttgcttaaacacatgttcaacattatattcccctcgtgcataattaataccatagcaacacttgatgagtgtctgcgctcttcctgtatcaccctgttgaatttggaaaggcttatttgcagtaaaactagtcgatcagcgatgcaatcgatggttccgtgcctttcccccccttcctccccccccccccaagttgtccgcttgggggtactaatctagacttctatagaaaccttactatgataataactacacatgcatcatgatcaaacctatcttgggttaataaattgtccgcataataaccctctaagaaaaaccttatccaaagtccaccagaatttccataatcccaatgggctcaaccacgatatgtgcattatttggagagataaatgctgacatgctaatcattaatgtataagtagtcgaatctggagcgggaaagggtctaactctgtttattttgcagaaaatgagtcacgaagtccccaggttcggcatggttcgaaatataccattgttattgctggattggtgggaaaaccttttgccaagcgacaaaaatcacgtgaaaagggttcttggaaacttaccctccttattggacatccagccaaacaacatgctaatcgaaactgctactatgttctgggatggagaaaggactgtattccgttttggtaatatagaaatgaatcctcttttagaggaaataagaggatttgttggattaccctgggatagtcctggtttgtttgtgctagaaaatcgcacttccagggggtttctgaaaatcatgggtctgagagagagtgacgacttgtcatgcctgaaaaagtcctacatacccttcaacttcctctatgaatgatatggacacagcaaatcttactgtatttttcatgacgaattctccatcacttccctgggttggactcatcatagggttttcgtattcatcgtctgttttctgggtatgatagtgtttccaagccaaggggacatgattcacaccaggttggtcatggtaaccaaaactttaatggagggaattgagggacaaacatatactactgttccgatgattgtagcagaattataccaggctctagatcgttgcaagaaggggttcaaacattttgatggttgtaacttgttgctgcagatttggttgttagaacatcttcaaagagtccaataccaccaagagtttcaacggagaccatggaatggtcaaatagctttccaccatctaaaaagaatgacctttatcccagacatatttgcacaaccaaagaatgctacagaatgggtacagtttttcaacaatttgaccgaggccaaggttcattggatgttcgagtggttccctactagcgaattcatcatcagatccagggatgttccgcatctggtgttgattgggttaaggggaatatatccctatgttcctatcagggtcatgagataggctggtagaaaacaactcataccgtgagtctccaaaatgagtcattatgaagcaaattttcaagatgacgcgattccatacaaatgtgaggcccagcacatatggcatttgaagattatcgtggaaaaggataccatcgagccagatcgatatcacgcaggtcatatgtacttttacccatcatgattggaagatagcatagcaggaatagttgatccaggggttggtcaaggaaacagggtcatagatgaagttgctgaagcacaggtgaagtatgagaggctacgcaaaagagttcttgagtctgagtccaggcatttggaaaaacacaagatagacatggattcaattaacgagtggagggaaatgtctacaaggtcgacaaaaaggttggaatatttggagcagggtctaatggaactggaagggaaaatgaggaaaaaggtcgtagattgtcagaatgcaaagggaaacgaaggaggacacctagcaagggcatatctgttgcgggacatgcatgacctggggaatttgatcgacggagccaagagggtcaagtatggagaaggtccctcctggaccaagtagattaggattatctatttttttgaatcgttttggaattcgaatgtgataaggcagatgtcattagtaactcatttatttattaccatttttaggttcgtcttatttagtacattaatgaaatgagacatttatcggcattaaatttcttcaaatctacttgtcgctaggcctacctcgtgcacaacaaggttcccaaattaggacgtgaacttacattcctgcaatatgtgtttaaatactacaaatacttttcagaacccttactgacttgtttatatttttattttttctttattttgattatttttattccctaaggttggttcgcacatactggcatcgccagcatatcacaccagatctacaggcccctccacctcctcctcctctaagtaatccgaaaagcaagggaaagcctaagatggatgatatgagttgtatccggaaataaaatgttgtgcacgtagagaatgttgaaacttcagacggtcggagtactccggcacagaatgatttggtcctacagttggaacagaagatactagaattgcaaagggagcttgagcaggtccgcaacctggcaaacctttccctcaccctaaatgtcccagacattaaccaacaaaatgttcaaaacctagtaccttatcaaaaaacacaaaaccaacgtccgcaaaatcctcccgcaccccactaatatgcaacaccaccccaaaatcctaatcctccaccagtaacaactccccctcaacaccagtatctcccgactcaatacccacaaaccacttatcatacttctcataataccccacaacctatccctgatccgcaaaattcaactaatgatcaccactacactcaaaccctcggcacccaccaaaacaatcccatatatgtggaaaacttaccctactccactcaaccaatctcatacacaccagaatccaccgagaagtactttctcattaagaatatggcggaggagctcaagaagctcacaagcagagtccagggtgttgaaggaggcaaaggaaatgaaggtctggattatgatgatctatgcattcagccagacgtaaaactgtcggagggttacaaatctcctaagttcgagatgtttgatggaacgggtgacccgaaggtacatttgagaacatattgtaataagctcatgggagttaggaaatatgaaaggattcgcatgaagctgttcatgaggagtctcactggagatgccctatcttggtacataagtcaaaatcccatgaaattggttaattgggtaagcatggaattagaattcatggaccgattcaggtttaacacagagaatgcaccggatgtttacatacagaacctcaagaagaaaccgatggagaccttctgcgagtattttactcgatggaggtcagaggctgcaaatgtctgaccggcactagaagaagagcagatgaataaattcttcgttttggcccaggatccacaatactatgaaaggttaatggtcaacgaaaatcacaaattctccggcattatctgtttttgaatcgttttggaattcgaatgtaataaggtagatgtcattagtaactcatttatttattattgtttttaggttcgtcttatttagtacattaatgaaattagacgtttatcgacattaaatttctcctaatctacttgtcgctaggcctacctcgggcacaacgaggtttccaaattaggacgcaaatttacattcatgcaatacgtgtctaaatactgcaaatacttttcagaatccttactgacttgcttacctttttgttttttctttattttgattattcttattccctatggttggttcgcacatactggcatcatcagcatatcacaccagatccagaggcccctccacctccacctcatcctccaagtaacccgaaaagcaagggaaaggctaagatggattatatgagtggtatccggaaataaaatgttgcgcatgtagagaatgttcaaacttcaaactgtcggagtactccggcacaaaatgatttggtcctacagttggaacaaaagatactagaattgcaatgggagcttgagcagtttccctcaccctaaacatctcagatattaaccaacaaaatgttcaaaacctagtacctcctcaaaatacacaaaaccaacatccacaaaatcctcccgcaccccaccaatacgcaacaccgccccaaaatcctaatcccccaccagtaacaactccccctcaacaccagcatctcccgactcaatacccacaaaccacttatcatactcctcataataccccacaacctatccctgatctgaaaaattcaactaatgatcaccactacactcaaaccctcggcacccaccaaaacaatcccatatatgtggaaaacttaccctactccactcaactaatctcatacataccagaatccaccaaaaagtacctgcttattaagaatatggcagaggatctcaagaagctcacaagccgtgtctagggtattgaaggaagcaaaggaattgaaggtctgtgttatgaggatctatgcattcagcaagacgtggatttgccagagggttacaaatctcctaagtttgagatgtttgacggaacgggtgacccgaaggtacatttgagaatatactgtgataagctcgttggagttaggaaagatgaaaggattcgcatgaagctgttcatgaggagtctcactggagatgccctatcttcgtacataagtcaaaatcccaagaaatgggttaattgggtaagcatggaatcagacttcatggaccgattcaggtttaatacagagaatgcaccggatgtcttctacataaagaacctcaagaagaaatcaacgtagactttccgcgagtatgctactcgatggaggtcagaggttgcaatggtctggccggcactagaagaagagcagatgaacaaattcttcgtcagggcccaggatccacaatactatgaaaggttaatggtcatcaaaaatcacaaattctccgacatcatcaaactcggggaaaggattgaagaagggatcaagagcgggatggtaaccaatttttaggcattgcaagctacgaacaaaacattacagtcagggggtatatcaaagaagaaataaataggggtagtaatggtagcctaaggtctataatctccattcatataccaaacacttccacccacataccaaccttcacccccagatatcctcaacccgctaccgcctactacacttataacacccagctagcctattatcattcacctccaacctgccaaaactataaaaaaaaactcagacccaatttcgatcacagaccacccagataatacacccctatttctgaacttatcgaccaactatataaaagaatgaaggctgccggatatgttacccctattcctgctgttccatagaaaactcctcctagtgggtcaacccaaacgaaatatgtgcataccattccgacatgaatggacataccattgatgaatgtcgcaccctaaaagacaagattcagaccctgattgataccaaagtcatacaagcaaaggaagttgcacccaatgtccgcaacaattccctcccagatcataggggtgaaggagtagatgtgatagaaactaatgaagaatgggatcctgaagggttaattgggcttattcaggaaggtaatgaccctaagaaacatgcagtcacactcactcctattgtgttacagatacagtcaccagtcaaagttgaggtagccgcatcaactccgtttgaaatagaagtgacagcacctacaactacacctactccatttgaagcaaaagtatacacacctttcattgtgacggtggcatccacaccacctttcaattccaatgtcgtaccttaggattatgttgccgaagctaagaaaaaagggaaagcaaaaatggaagagtctggtgctgcacaagggatgaccagaactggaaaaatctatacacctgaaaatttgggaggaacaagtaaggaggctactgccaaacaacctatcattgaaactagtccagatgacctctagaggaaagtacaggcaagagaatactatgttattgatcatctgaacaaaactcccgcccagatattcatcctgtcgctgctacaaaattttgaggcgcataagaatgctctgatgaaagtgttgaatgaagcatatgtgcccaacaatatcacctgtagagaaatggccaacatggtggggcaagtgttggaaagccacaagatcacttttcacgaagatgagttgccgcctgagggattgagccacaatagggcactgcacataacagtgcaatgcaaggataagttcattgccagggttttgatagacggagggtctagcctcaacatctattcactgacaactctgaaaaggttgggcaaggatttgcataaaatacgagcaggaactatgaatatgaaggcgttcgatgggtcgcaaaaagccaagattggggaaaccaatttatatttgcagatgggtcctagttggtttgatttcgaatttcaggtgctagacatatccgcctcctataatctgttgttgggacgaccttggatacatgctgttggggatatcgcatccactttacaccaggctgtgaaatttgaatggaatcatgaggaagtaatcatgaaggagatggaagcaatcccatttgtaccaaccaaactgttccgattgtggaaaatagaaggaagttaggcggagagacttatcaccatatcgagcgtgtcaatgcaattgagaaagataaatggtggagcagtaaaatagaaagcatactggcatggttagggtatgaactcggcaaagggcttgggaagaaactccagggcattaccaaaccaatacagctaaaacgtcatggtacaacttttgggcttggacatccgtatacatggaaataatataatgattggtcaccaccatggcgcagtccctattaccctcttgagcagccagtgtcgcatctgagtcagaccttccgtcatgccgatccaaagaagaagaagctttggttgggctaaggaatctgttcttagaagacgaagatatggattgtaatgtgattgttgaggaggaggaggaggaagaaggccttatcattcagatagtggagagcggagcatttcttaggaaccggatcgccacaccgtccaggaccagaagagtcccgaggtagcacggctactaatgttacttgaaaaacaagtcttttgagcatttcattttaaaaacatctttctttcagtatttttttatggaaaacattgttttgaagtcatctagatgatattttgcttaacgtttcagcatttgtcaaataatttgatgttttattatcgttatctttcatattttcttcaatagcattactatttcttaccttgatgaaccaacgactgtgatatgtaatgagagaacgcaacataaggatagtgattcggaagaagaagatgagatacctgaggaagttatcagataagttgagaaatttgagaataagcctaagtccaacctggatgaaactgaaatagtcaatttgggagattctgaaaccatcaaagaaactcgcataagtattcacctgtcgccatcagagaaggaagaacacttatttcctaaaagaataggaggataatttttcgtggtcatatgatgacatgaccggtctgaacacatccatagtggctcatagattgcctaccaatccaatgtgtccgccagtgaagcagaaacttagaaagttcaaaccagacatgagcctaaaaatcaaggaggaagtcactaagcagatcaaagccaaggtcctcagggtagttgagtacccaacctggttatccaacattgaacctgctccaaagaaatatgggaaaggtagggtgtgtattgactatcgggatataaacagagcaagtctcaaggatgatatcctactactaaatatatacattccgattgataattgcgccaagtatgaaatccaatcctttgtagattgcttcgcgggttatcatcagatttggatggataaaaaaaacgcagagaaaacagctttcattacaccatggggagtgtattgctacaaaatgatgactttcggtctgaagaatgctgaggccacctatatgagggccatggcgaccatcttccatgatatgatacacaaggaaatagaggtatatgtcgatgtcatcatcaaatccaagaaagccacagatcatatagtagacttgaggaagttttttgaccggctacggaagtacaatttaaaattgaaccccacaaaatgtgcattcggggatcccgccggaaaattgttgggatttatcgtcagccgctgaggaattgagttggacccgtcaaaggttaaagctatccaagaattaccaccaccgaagaacaaaaaggtcgtgatgagtttcctgggatacctcaattacatcagccgcttcatagcacagtctacagtaatatgtgaaccaattttcaaaatgctgaagaaggatgttgcaaccagttggaccaaggattgtcagaaggcttttgacaaaatcaaggaatacatgtccacacagccagtcctagtcccgccagaacctggtagaccactactactctacctctctgtattagatggggctttcgattgtattttgggacaatatgacgagacgggaagaaaggagaaagccatatattacttgagtaagaagttcacacattatgaagcacgacactttttactggaaagcacctgttgtgctctgacatggacaactcagaaattgaggcactacttctgtgcttataccacatacctcatatcaaggatggatctctgaagtacatctttcagaagcctatgcctaccaggaagctgtccaagtggcaaatattgtggagtgagtttgatatcatcgatgtaactcagaaggcagtcaaaagacaagcattggcagatcatcttgccaagaatcctgtaggaggagattatgaaccactaaaaatgtattttcctgacgaataagtgtcattcgtaggagaggacatagctgaagcctactacggttggagaatgtttttcgacggagctgcaaatttcaaaggagtcagtatctgagccatatttgtatcagaaatcgatcaaaactacccggtgtccgcaaaactcaggtttccttggaccaataatatggctaagtatgaagcctgcatattagggctcaatttggccgtccacatgaatgttcaggaattgttggtaattggtgactcggactagttggtgcaccaggtacaaggagaatgggctacgaaaaacaccaagatactgccatatctacatcacgtacaagagatgatgaagaggttcacaaagatagagttctggcatgtccccagaatccagaatgaatttgcagacgcattggccaccctatccttaatgatacaacatccaggaaagaatttcatcgatcccatttcggtgagggtccacaatcagccggcatactgtccccaggtagacgaagacagatgggaatccatggttccatgacattaaagaatatttggcaaaaggagagtacccagaacaggcaaaccatactcaaaaatgcacattgtagaaactgtccaatcatttcttccaaagcggaggaattttgtatagaagaacactaatctaggactattaagatgtgttgacgccaaagaagctcccaaattgctcgaggaaatacatgtcggaaccttcggcccacatatgaacaattttgttctagccaagaagatactcaaggccggataattttggataactatggaaacagattgcatccggtatgtccaaaaatgccaccaatgcgggatacatgcaaatatgatatgggtgccgccaaacaaacacaatgcaacaagtgcaccttggccttttgctgcctggggaatggatttcattggtctaatcgaacccactacttcgaatgggcacaggttcatttagtagccatcgattacttcactaagtgggttgaagtttcatcctacaaagcggtaatcaagaaattcgtcgtaaattttatcaaggatcgtattgtttgtcaattaggggttcccgagtccatcatcactgacaattccgctaatctcaacagtgatatgatgaaaatcgtgtgtgaaactttcaaaatcaagcacaaaaacttcaccgcatacaaacctcaattgaacggagccgtggaagctgccaacaacaacatcaagaagatactaaggaaaatggtagataatcacaagaaatgcacgagaacttaccatttgccttattgggataccgtaccacagtccacatatcaaccggggccactccctgtttgctggtttatggtactgaagctgtcattcccgccgaggtagaatgaatttttcctatgagcaattagccctcatagatggaaaaaaggatgaatgcaccgtgtcatggtcagctttatcataacagaatgtccagagctttcaacaaaagggtcaaaccaagacagtttacaccggggcagctggtgttgaagcggatctttccacatcaagatgaagccaaaagaaaaaattcacttaactggcaaggtccttacatggttcataaagtattgataggaggagcactcatactcgcagaaatggatggagaattccggccaaagcctatcaatttagatgcagtcaaaagatactaggtgtaaactatttatgtttcttcatatgatgtaattgaactatacttgacctgattcccatttaagagggtatatgtaggcagccccgtgggttcggtcacaattcaataaaattttcattttccctacaatcaaaactggggcagaattttgaggaggaccctcaaaattctatggcaaagaaggtcgcaatgtctctaataacgtcacagttactagttcatctaactgatttctaatttgcatatttctatgtctttgaaaaccatacacacatactttttgtaaagaaacttttctagccaagtgctacccatggtgacttgaacaggatcctcgggcagaacggagcaaagcaagcagacaaaggcacgaaccaacctccgccacaaaactcacaaactttctttggatgcaggaataggtcatcaccataagcatcgtcacgacaacagaattgctatgcataaacatattaccacctaagaatacttcactattactcttacatttacatgaggctaagctatgcctccctatttgcataaggctaagcattgccttctcttttcatgagactaagctttgtctcaactcttgcatgaggctaagccctacctccgtgtttgcataaggctaagcattgccttctctttgcataagtctaagctctatctcaactcttgcatgaggctaaccctgcctccctatttgtataaggctaagtattgccttctccttgcatgagactaagccatatgtcgattcttgtatgacactaagctctaccttcctatttgcataaggctaagaattgccttctccttgcatgagactaagacctatctaaattcttgcataacgctaagcccttcctccctatttgcataagtctaagcattgctttctcgttgcatgagactaaaccatatctcaattcttgcatgaggctaagacctgcctccctattagcataaggctaagcattgccttctctttacatgagactaagctctgtctcaaatcttgcatgaggctaagccttgcctcctcatttgcataaggctaagcattgccttctctttgcatgtgatgggtttcaatatctttgccttatattttgataatataacaaacttactgtccagaatcagatagggaacctaacacagttgggctataatgcaagttaacggatttcaattaaatgtgagctgctatagcttcaggagatagagaaccaaacaaggacatgatacccttgtggttcccttatagcagtacgaagtcaattggacacagctggaagcgacatgactacctgcactatttctacctgcattgcactgtttccagtggccacttatcttttgaccaactaaagtgcttacatcattcaagtgatgtcatcaaggtgtatcaacaaggagtttatatcaaaacatcacttgaacacttgcttttctcattcaagccttctgcaaaactgtgaaattaattctcttgagcttgaagaacaaagttaaatgctactacggaccagttcctaaaattagtattttgttgtccttaattgagttgtaactttgtgattgttcttattgtatctcctaaattgcttagctagaagcgttgattaggaaccctcttgtaaaatccgtaaactctatgagtttatattgtgactaggtttagtcataagttaaagtctttataactagagagtgataaagtggcttgtggtaagagtatcacaagttagttgagttgaattctttgtaatggagtcattccaaagtggcttgtaataggtttttacaagttattgaagttgaaagcctacaggtgtaagtcgtggtttttgtccccttgagttgggatttttccacgtaaaaatccggtgtcttatttacttactgttttatcagcattctcagtacaacctcatagaggaccaggtactttactgtttggtggactcatacaaattaacaattggtattagagcgggttcctcctattaggctaacacctagaaaggatccttatggctgctccaccaaattttgaagaaagtcaatctacatacagaccacccaggttcaatggacaatactacgggtggtggaagacaagaatgcatgattattacatggttgaagattctgagttatgggatgtcatatgtgacggtccttttgttccaacaaaggtactggaagaacttccattctcaatgccaaaaaccagtaaagaatacaccgacgtagataggaaagtggtggagaagaattttcgtgccaagaagattctggtatgtggaataggacctgatgaatacaattgaatctccgcgtgtgacactgctaaagagatatgggaagctttgtaaatagctcatgagggaactacccaagtaaaacaatctaagatcgatatgctcactaccgagtatgaactcttcaggatgaaggacgatgaatctattcaagatatgcacacaagattcactttcatcataaataagttacactcacctggtgaaaccatccctaggaacaaggtagtgaggaaaatcctcagtattcttcctagcctgtgggaaagcaaggtaaatgctattgttgaatcaaaggacttgcaagaactgaccatagaagagctggttggaaatttgaagacctatgagatgaagaggaagatagacagtgaaagaagagaaccaaagaaagaaaagaacctggtactcaaagctgatagcaatgactcaagtgaggaagatagtgacatggcttatttaaccaaaagattttggaagatggccagaagaaatggagaaatgctaaaaaggggcagctctagcaaatcaaaaaactatgatctctatcataagtgtagaaagactggacacttcatcaaagactgtcctctcttgaagcaaaaattatccaagtataactctgagaaagcagctaagaggaacccggttcctctcaaggacttcaaaagaaagagatctgttgacaatatggtgaaacaagctcttgcagcatggggggatttctctagtaagtctgaagatgaaactgatgttggtgatagttccataatggaagttgaaagcgaggaaaaggaatatgacctaacttttgctttgatggcccaatcagatgatgatgaagacaatgacaacaaagaggtaactttcaggtatgttcagaaaaatctgaaatcctacactcctaagaaacttatgtctttagctaatgtattgattgatacctatcataaccttgtagaggataaggatgatttgatcttagaacaaagggaagttgataaaaccatagatgatctggtagcgtgtgtagtgatctgaaggaaaccatttgtgagttgaagagagaaaaagttgtcttgaccaaaacgattgccaacttagagcatgaaagaaatgacttagtggtagtagttcttgaccataaggaaactattgagaactttagtgaagaaaaggaggccctagcaagaagagtgactgaaattgaggaagaaagagatgatctctttgtagaaattgtagacctaatggaaataattaagggactaagaactaagtctaaacctggaaatactggaaaaggaaaagagatagccagtgaagaacacattaggcctaaaaatgagttgaaagctatgagaaccaggatgtgttttgaaactaataaaaacaaacacctccaaactgaactgaaaagagtaaaaaatgatcttgaaaagtccctaaagtggacctggtcctccaaagctatcactgccatgaatactaataatggtggaaacatgcagggaatagggtttcaaagggagaaaaccccttacaacctacttagcaaatgtgtgactgtactcgaaaattggctgagtacccactatgggaacaatggacatttcatggaaaattgtcaaaccagggtccagttcactcaaaaaaacagaatggttgctgaaaatataactactaaaaagggaccaggttccactcacaaaaaacgcatattatatgcatggactaagagagctcttattcatcctcttgcctactacaagggacacaaacttgattgggttcctaaaattaattcttgatcttcttgtgcagggaacagtgaaaggaagcggtccacaatggttcatggatagtgggtattcaaagcacatggctaggaacaccatggactttctttcactaaaatccctacaaggagggagtgtatcctttggcaatgggaaaaatgggtacattcttggagttggaaaattcgggaagtcactcacacattctattaaaaatgtgtactatagtaatggtcttaagtacagtctcttgagtgtctcttagatctgtaataaaggaaacaaggtggaattcttgtccaagatatgtacagttactgatctggtaactggtgaagtggtacttgtggccaagagatacaagaacatctatgttgctgattttgagtccttacaaagtggtgatctgagttgtctgaaagttgttgatgatgatgctaaactctggcacagaagattggggaacccaagcttctctcttctgaacaaactaatttagaaggacttggtccattgtctgcccatgtcaaagttccaggtacaaaaagtttgtgatgtttgtgctagatgaaaacatgtgaagtcttcttttaagtctaaaagggatgtgatcagctcaaagccactcgagcttctgcatatggacttttatggtcctatgagagagcaaagcaggggaggaaaaagatacatttttgtaatagtggatgactactccagattcacatggactctgtttcttagaactaaagatgaaacatttgaggtgtttgtggcctttatgaagaaaatctaggtgaagatggagtgtagagtcacatgcattagatcagatcatggaacagaatttgacaatgccaactttgatgagttctgcaatgaaaatggcatcactcacaacttctcagctcccagaactccccagcaaaatggagtagtggaaaggaagaatagaactctagaagagatggcaagaacaatgctaatcgacagtggaattgcaaagaacttctaggttgatgaggtcaacactgcctgctacttggtgaataggtgcatgatcagatcaatcctaaacaaaattccatatgagttgctgaattgaaggaaacccaagctgactcacctaagaatatttgggtgcaaatgctatgttctcaataatggaaaggatcagcttgaaaattttgatgccaagaatgatgaaggaatatttctgggctactcttctccaagcaaaacgtacaagatatacaataagcggacctaatatgttgaggaaagtgttcatgttattttttatgagtcttatctatcctgtgagaagagtgctgaagaagatcaagatggagaacccttactagtccctggtgaagtcattgacatgacaaatggaaaggcagatatgatgagccaagtgaaagagctgagtgaagacaatacttcctcatcttcaatagaaccaggtacttcaattacaaccactgaagctgaagaaagagtggttgacgcagttcagggtattccattagcacctgagagaagaacatcgaaaaaccaatcaaatgtacccacattctctacaaatgaacctcagacgtctaactggagacacaaaagctctcatcctcttgacaacataattacccctctagattccagagtacaaaccaggtcaaaagccagaaattcacttgccttattagcctttctctccaaaatagaaccccaagaatatcaagaaagccttgaaagatgcaaattggattacaaccatgcaagatgagttacattagtttgaaaggaacaatgtctggcacctagtacctagaccctcagatcgaaccattatagggaccaggtgggtattcaggaacaaacttgatgaacatggaaataccacaaggaacaaggctagactagtagttcaaggatacaatgaggaggaagggattgattatgatgaaacatttgctccggtcgcttgcatggaagctattagaattctaatcgcttttgcatctcatatggaattcaccttgttccaaatggatgtcaaaaatgcttttctaaatggatttcttaaagaaaaagtctacgtgaagcaacctccagggtttgaatgtcaagaacaccctgattatgtgtttaaactagacaaagcattgtctggattgaagcaggctcctcgagcttggtatgaaaggctatcaaagttcctcttgaaaattggttttaaaagagggaaaattgacaacaccttgttcctaaagaaacagggaaggaactttctcattgttcatgtctatgttgatgatatcatttttggggcaacaactgaggctctgtgtgaagaatttgcaaaactcatgggaagtgagtttgaaatgagcatgatgggggaactgaacttcttcttgggtcttcaagtaaaacagtcctcaaagggtacattcatttgttagcaaaaatacatcaaagagctcttgaagaggtttgacatggaagcatcaaaggtgatagatactcatattgcgacggccactctactagacatggacgaaactggatctcctgtgaatcaaaccatgtatagaggcatcattgggtatcttctttatctcactgccagcagacctgatattatcttcagtgtggggctatgtccaaggtttcaatcaaatcccaaggaatcttatttgaaggctgccaaaagaattctgagataccttaaaggaacacaggacctggttctttattatcccttaggtaaccgttttaatctcattgaatatgttgatgcagactatgcaagttatcttgtggacaggaaaagcacttttggaatggctcactttctaggatcatgtcccatctcctagggaacaaggaagcaaaattcagtggctctgttaacaactgaagcagaatatgtagctgtagcatcctgctgtgctcaacttctatggattaagcagcaattggaagattttggggtacttactgagagtgtgccccttctatatgacaacaccagtgcactcaacatggccaagaatccagttcaacacaaaaggaccaagtatattgatgtaaggcatcactttctgagggacaatgtggagaaagggttgatctatatgaagttctgtagcactgaagaccaaattgcagatatcttcaccaaacattaagtaggaaacattttgaaagaaacagagtgaagttggggatgctaaagcccaattgagaaccctattcctcatcatttggctatgaaaatcaccttcaggtaaaacaagctaaaagttttttctggccaagtctaactcacttcaataccattgtacgtaaacacgcatgatgagtatagaagctgtaaatgcagtacatggatgataaaataggattgatactttcaaataacaggtcaagaacctagttcttgtaccaaatgtgagtagttttgtgcattctttaatacacatcttaaaaaggtacaaaacataactaccatgtcatccaccttttcagatcctactgtcacgtctcttcacttcaaattattccatctccctctgaaacgttgcactttactacgcacaaccgctatttcagaaccgatccctatctcactcttttcataattatccatcattaataaaaccctcttcttttctccacaaaccataagtcttccattagaacttcctagagtaccttcactccatcttttcaatggctgatacaaaatccgacatccctgcctcagtcatccctagtactaaaaaacctatggagtctgtcattccctatgagtcttttataaccactcctactctccccgctgaagtcacacctcacctagattccccgtctctctctatttcagaaacccctaaaattgttgatacgtcctctctatcttctgaggttccccctaatcaaagaacaagtggagaacaaggtcaaagccatgaggtcgtagagggttccgccattgttactgtagattttgtggtggtagtagtgctgattgaggaagaaaatattgtaactatctttgtggtatctgctgacggcatccttcatgagataatttattagagaaagaggtacaaggtatgggggaagaaggagccatagtgactgttgaggatgttgcactagcagaaactactggtccctcacatgaggcacctgatccctttccgaaggacccaggtcagggttttcattcctaggatagttctgctcctgcatttgctattgcgcctctagacattcaagatcctgagatgaggtccagtgatgaggaggttttagataacctggctcttgatgcattcataattaagagaagggtggtatccactcctgagtcttccaccaatagacctactactaggttgcaagctaaggtggcatatgactctgcccttcaaaagagcagaaaaagtagtaacaagcaaaggaggagattggtgaaagataatgtgcccatatatgataaagcggtccctgtagtagaagtggaagaggaaacaccagaggaacctggttcattggtgagacggtcccagaagaagaagaagcctacttcagtaaagaaaggttcaacccccagttccaagttgaaggatgttgtgagtgagtcctcgatgtttgatgaggatgcgttaatcaagtttaagggaaaagagaaatcaagtggtgggaagtctgacaaatgcaagtctgaaactattcaggaacctagttctctgaagatactgaggagtgaaggcagttccgtttcagaacacctaaggcaccaaaaggttttgttgggtcgtacgtttgacccagcaatctttgagatggctggtatgcgataagttcttaaaatggttgagtttcaattatgggggcatctattccaaatagatgcacctaaactgtatgaggatgaggttcaaagcttcttttctagcctctttcccattgagaccgaccacatttgtgatttggtgaatggagtagatatcgtgttcgatgtaaagtttattggggaaattcttaaagtccctacagttggtgtgaccagtgtgaaggatgtgtgtcactataatttccgaaatgtcgtggtaaaagacaatgtgaaccaaaagggggaccagatccacaagaaggcattactctttgtttatcaactacttttcgaataggtaaacaaagttctattgcttcgtactgagaggaggtccatcacttctaagtctgacctatttttgatggagcaactggatagctttactctcgtaagcctgcctgttattatgattgaacacatgcaaaaagtagcaaccttcaaggatggtaatcatggccttccttacggtttctgcttacgcgagtgtttaagtttttcaaggtgtcgttaggccaaggcaacgtaggaactaagaaacatactttctcacagacaacgttggaagaatacgagtgcatagaaaagaatggggggtaggaagtacatcaaccgtctcacagctcattaatgctcaaaatagtgcaattgaggagattcgccagttgaaggctaggaatgctatcctggaaggtcagcaagcccaaggggttctggcgtcaaacgatgaagtagctcatttgacaaaaacgaatgctgatctcagggcgcaagtagagaacctgaaagcagaactgctcaatgagcaaaagtcggccaatactcgaatagacgtagttctccaaacacttgctgcagccttaagccctctactcctagtgccccctaagtacccctttagtgaccaatttctggaatgttcttttaagtttttttttagcatagttttgttttctttttttgatatggttgggattacacagcactgctctcgtctttaacagtccaattttacctttgctttttaagcaaaggcttatatttctattaatataaaatctatcctcttttgttatctcattgcttgaattttctaattctcttctctatcatgttgtgtgcacatatgtggcatgacttagcttggctagacttctttgtgatgtttgactgcatgtgtctttttaatgatgccaaaagggggaagtaatatttaatcaaggatctgattaagggggaagtataaagtcagagagaacttgtgaagttcatgttactttatctggttctctctactttaaatacgtgttatcattgtctcagtttgtcatcatcaaaaagggggaaattaatgggtttcaatatctttgccttatgttttgatgatctaacaaacttactgtccagaaccagatagggaacctgacacacttgggctacaatgcaagttaacggattccagttaaatatgaactactatagcttcaggagatagagaaccaaacaagtacctgatacccttgtggttccctcatagtattacgaagtcaattggacacagttggaagcgacgtgatagtctgcactatttctgcctgcactgcactgtttccagtggccacttatcttttgaccaactgaagtgcttacatcattcaagtgatatcattaaggtgtatcaacaaggcgtttatatcaaaacattacttgaacacttgcttttctcattcaagccttctgtaaaactatgaaattaattctcacgagcttgaaaaacaaagttaaatgctactacagaccagttcctaaatttagtattttgttgtccttaattgagttgtaactttgtaattattcttattgtatctcctaaatttcttagccagaagcgttgattaggaaccctcttgtaaaatccgtactctctgagtttatgttgtgactagctttagtcataagttaaagtctgtgtaactagagagtgacaaagtggcttgtggtaagagtatcacaagttagttgagttgaattctttgtaatggagtcattacaaagtggcttgtaataggtgtttacaagttagtgaagttgaaagcctacatgtgtaggtcatggtttttgtccttttgagttgggatttttccatgtaaaaatcccgtgtcttatttacttactgttttatcagcattctcagtacaacctcatagaggaccaggcactctactgtttggtggactcatacaaattaacggcatgagactaagctctgtctcaattcctcataaggctaagacctgcctttccatttgcataaggctaagcactaccttcttatgagactaagcattgtctccatctgcatatgtgtggctctattctaaaccttgcattgtcctcttctctcggggctaatatcttctcccaaaacaagactaagctctgtcttgttttatctcaagcaccatgtctctgcatctcatgggctgatatatagccaatttttccaaaggcgtcatagtccgaaggcgtcatcctcatagcctaaagacatcatgtcattgcctgaggatctctcgatattgcacatcattatttaaagtcgttatggttcagaggcaccattctcatgttctgagaacatcattccatggcctgcgaatcccttatctcatgattcatggcccgggatgtcatggtctaaggacatcatcctcaccgtccaaagataacattcaaggtccaaagggaatttgcatcatgtttaaattctcgcaataatccatatatattgcacgcatcgtgttttaagttttgcaggtaatccaggaagtaactgttcttcaaacatgagcaatcttcgctctagtttctattacaacgttcacatttcacaaatattttaaacataaccaaccaccatcaattcccgcttcttactctatggctattcatatacttgctctataacatatctgttacgtttcatattcacattcataactctgcataaatccatctaatactatccttcccaaaagaaccatttccgaaacacacgactattcatataataattccatcagtttcattcaccgttgggtccagaactatacacggcctgattcctgtaaaatcagggatatgtaagcagctcagaaatcatattgcggcctatattttttcaaatcactccattcggtcaaaattggtcatcatttctttactcgacaactctttcatccctcccgggtaaagaggggcagttgttgatacccactttttccctcctatatttcaaacatgcatatatactttcaaaatagtgcatgagcattatcaagtatttttcctaatttttaaagattttttaatcaatttattcccatattttattgtataaataatcattaattgcatcacaaatcatttttatgatgattttatcatctaacttcacttaagccttcaatagttttgatgtatttattataattatattttgcatctttaggttaaaattgtatattttgtaataatagcccttatatacttatgattacttcatttatgcaaaaatgactttttatgcttttgtagaaataaatagttgttattaatcatttttatgtacaaataatatttttgctattttatttatcattttttacaaattcttttattaattaaattgggtatttaactaatagcccctaaattcactaatttcggacctaaagtaccaaccccttagaccatttacctaaaatacctacccaaattcttggcccaacacttaagcctaatctataaccccctaacccagtccaaaaccgacccaaccctttttaaatcacagccgttgatttaaatctctgagatcaacggctcatatcactcccttccttttaattaacctacttatcccaaaccctaaccctcattatcctagccactccatctctatactctctcgaaccttcacctccttctgtcaaaccctagtgtcgccacccccaaatctcttatattccggctcaaacatggaatcaatccatgatttacttacctattttgtgttactctattattatacgctcgtctatggtattacttagattcttgccctgtttttggcaagaactacctcaataacgggtagattcaccctgattctgtgaagatctggacgatctttcgtccatatacatgttttattgaacgattcttgcatctctagtccgattcaaagcatcagtctcaactagggtttgagatctttccttgttctttactgatttttgattaatactctttcctttctcgtatttgactaatattttccttatttctgtttaatctaccgtgtttcctttatttttaccttattttgctctaaatttgattgttaatcgattcttatatgatattttccttattctctgttgtatccccttattttaagtgttactcgcatgattacatgccattattctctgttaatatactaaactctttgtttatgtattatttgccctaaaaaattagatcctaattaattttatatttaatatttaccgtgtttcatatttatactatactaatatataaacccctcccctttcccttttaagacagatgaaaatcaatatactctcactgataaacttaagatttggctatgtgctctctttgctatctcgttctatctctggtatggccagctgaaatccaaggccaaacattctgggttctcgactattgtggtgttattcttgcttttcttgtctaactggtgagtgactatcctttgtcatttcattcttgtgtatgcatgaactgtgtttatgatccagcatgtttaaagttaccttttgagcatgattctactaaattcatgtttatatgagtctccttactcctctaattgatactgttagttctgagattagttatctttgaataatatgaattctcttagaggttagcttaatgtcttttaacttgtttcatgtatgttgttttgctagttctgaaattgtcctgaacctagcatctttaggatcatactagtatgttcatcagttaatcaatactgagtctttacaaacttgtattaaacctttctctgtcattcatatgccctgataacttgccttctaatatggtatgcatctgtttggattcatgtgattatctgactatttaccttaatgcattgtctaaatgtttctgtgattgaacaaattgtcctaaatgctagtatgtacatttatgcctaattagaccttttaggctttaacttatcaagtattatgcatctgtgcataaacaactttgcaaatcttgccaatttgtcttcttaatacaattctgcctatatattctgtgttttaaactatgttatgatggctttttcctaaaatcaaatctgttttaaaatctgtcatttaccattgtctccttttatatgctgctacttgtaaactcctattcttaggtcctttaggttctatctctcacctcctcagtgtgagcactgcttggggtccatgtgagacccttgtgaactctaacacactagggtttggtttctaatctcctttgaactgtttttgagtatttgttctttagtgtgagcattgcactgggttcttgaaacccttggaaactttgacacactagagatttaagttctatgtgctatgggtgaatcattcaccactgatcattgtatacttgtgaaagtgagccttgggtctgctatggtttgaaggcctgaattgcccgggtgtattttggcatgctgtaggctctctatagttttacttaccttttgtaattcgtttattaactctggtttgtaataattattgtaataataattatggggtatttatttaattgggaagggtttcttatttttatttgcaaagtcgagtagaaatcctgcctatagggtctctatttgtgctgttaattctgcttataagtttcgtattatgttgttgtatgttagaaatcctgcctataggatctatgttgtgtttacatgttagaaatcctgcctaaaggactgacattatgatttgatgaaaatcatgtatttaggtgtatcaatctgtccaataaacgtgtgttagcaatcatgcccataggatcaatgtttgtcttaattgtcttctggctcagtgtgtataaattcatgctcatatactgctcaattctagaaaccatgtctataggattaaaattagtttaatgctataaatcatgtatataggattaaaaccaattcaaacccagaaatcatgcctataggataaccatcatcacactcgtataagtcatgcatataggattctattaactgattcggaattcgattatcactgttaaccacttagacaatatgcctataggatttaacaataattctggacttgtgatttactgttgagatgcccagatattgtactgaattaaaatcaataggcaaatatacgtaggccctaacactcgcatgaagaaatgtctctgcatactactgctcgcttgttcatcacatagatatcctgcctataggactctaagattaataaagcctgctaaatcagttgcgtgcatttgttgtttacatgcggaggttaacgtgagcccatacatgtctttatttgaaagtcctaattgttttgtttgtcgcttagtattttacaattttgagaaccttatgcctagtctagaactttcctaaatagaggtcccaatgcctccatgaccttaggtaagggacgggtagtgcacgcataggacatgagttagaatcaactcaagcgctttaggtaaaactcaaagatagtaatccggtagcaggagatgatagtttgtgaccgctggataatatgagtaacacccccgtcttgggggagttacgaagtattatttatgttgcgtgggatgatcctataggctaaaaactttaggacccccatccttattaatagtttattcgcttcttcagactaattcgcataatttaagttcggccgagacccaccgttgtggacctcgaggggtgcctaacaacttcctcttaaggtaatttgagcccttacccgatttctggtgatgcaagctggtataatctgagttatttgttataggtgccctaacgcaccttaattcgttaggtggcgactataacaaccaattcctttttgctactttctcaaaaggagttgtcaaaatgtctaaacccgatttcgcgagaaaagggggggcgcgacaatatacaaaaccattgaaaagaaaaaaaattcaagatctcttaattttagcatgtcagttacacgacacccacccacccgccatttccaataactccccctacatttaagattttgtttcttttttctctctttcgtaataatcacccaaaatgtctcttttatttttataacctccccccccccccccccaaattttcaattcttttccttttccacggtttttcaaacccaatttctctttttttttactaattactaagatctctatttcttattgagacaatgcagacgaaattcgaaatattgctctagaattaagttgtgggtaagttttaaatcttgttttctttctttctaaaatttttattatatgtgacttgtatatgatacatcaatacccaaaatagtactcgatataatactaatacaattatattaaatatttagggtagagttgtgattgaaacttgaaaaagatgaagatcaaaagtgtatcataatttttcagaatgtatcgtgattgtattataattgtatatgtatcataattgttgcaggaattgtactacaaatgtatgataattgtatatttattgtatattcttacgagagttgtgagttcgtgacgaatttcatagtttgtatcacaagtatgataattgtatattaatttattagtattgtatcatgtattattttgggtattaatgtaccagatacttagatacaattatgatacaagtataatacaattatgttttaggtattgatgtatctgatacaattcaaatacaattatgatacaattatcatacaattatgacacaatttgtaaatattttttaataatataaagttgttggcaatggtaggaagagagaagatgaagatcctcgacgtagattaaggtattttgatatataaaaaaaggagagagaagaggagaagggaaaaaaagaggaaatgatgtaactgaatcccttaattaaaggcactaataatggggtgggagccttttaaggagcaatgtatacaatttatacaaaaaatctagatacttattaaaaactacaaaatatagagaatataagtaaataagtttctaatatagtatagctaggtaaaaatcacaatggacaatatcgtccctgttattggtaaaaattacacggggcgccctatttggtcgcccccatttaatctatatccatatatttaaaattctttaacttataccataattttgacaacttcagatgccttctcttcttcctcgtgacctatgcactcttttcttcctcatcttcttttctctctcaaacacatttacatggaacataagcattctaaagatgatttctcttagtacagcaaaatgcatttctaatggcgcccatgaagctaaagcttgttcaagttcaattcgaatctatttttgcttttatatttccttgtctaaatgtctgcaaatcactgaggctattcgagcagagtggaagatggatcaaagcactgttagaagaagctgaaaatgagaggatgcatctcatgactttcatgtaagtagccaagcctaattggtacgtccctgctattgccattgaaaatctatactgagttcctcaaggaattggacaagggtaatattgagaacgtccctactcctgctattgccattgattacaaggcttaagttatattttaaagccatctaattttaaagaaagacagaacagaacttcaactctaagaatactgaagttcaacaaatataaacaaaaacttcagctactagaatgttgaagttcagcaaatataaacaaaaattccagctcatagaatactgaagttcaacaaatacaaaacaaaacttcagctcctagaatgctaaagttcaacaattacaaaacaaaaacttcagccaaaatatgttgtagttttattgaactgaagtttgtcattgcactatgaactgaagtttgtgtgattgcctttgcaagtcaggccaaacttcaggcaaaaatatctgaagttttgctttgatgaggctacacttcaggcaaaaaaattatgaagttcaaacttcagacataaatttttgctacttcaggcccgtatatttgaaattacccgaaaaagtacgtacccttgtaattttttatgcaaaacgggtataagttaaaaggtgacccaaaaactcgatatatatcccctgttattgggcgtttatctcttactcactagtggaatgggctaatgaattgagaattgagcctatggcaatttggtcactgggtttccattcttacaagagaaatactcttgggcttctaaaaggaaactcaggattaatgggttacttaaccgggccgagtttggagcaagactaagctgttcgggtatctggcatttgacaaagctgacgtggcactatctatcagtacatctcctaaaatctcaacgaggcaatttaatttagagaacataaggttaagcacactatattatgatttaatatcggatgcaataaattaaacactcataccccttatattatagaaatcctacacttaaacccctataaggtatatctatagctaaatatattaatttttttaattaaaattagttttaaacaaacgaaagtctattttttagtttgttaatctatccttcggcgtcaaaattgtcttaaaattacttaattcgatgaagtttatttgttgtaggatttcaattctataataagtttaaatattttaaaatagggataccattatatttaagtgttttgagagttctttgatttttttttttgccaaatagtaaaagttagggacagacacgtataaattctaatccatattcatccaacaccaagtattccaagattcattcaatgtaactataattatagtatgttgcaaacaggtcggcgaaacctaattcataagtttcaaatcttaactccaacgtaattctccacgcttatgattatgtggcttcgccgccaatggtctatataacattttattcactataaaaattaaatttttttcgaaaccgattattgtattatgttataatataatgtgtcaataacatcacttcaacgtaacagctaaaaaatatcaaaacaaacaagactgttatattcgtgactgtactctctacaagtaatattggtgcacatagtaggtgaatttcccccatttaaggtgatcttttttattcgataagaaacattcatgtatatgtgctagactagacataacaatatcgatatgacaagagcaacaacacacttgccaatatgtgacaaaagttatctcacgccagtttcttagtatcaatttatcttcttgtctccacgtgatcaagttgaactagaaacacaactcctgtgatatctagaaacgcaaggctatgctattatatattggtcaataaatttctcaccgccagataatccaataaacagcaccaccaccttacacttttgcttgcagctgttttgtaaatctgctggttttccagtttgtgaaaaagtatatcgaaagcaagcaacaaataacaatacactattctttctgacttacgtactaaaggatattgaaatttatgacatccaaaaccatggatgtatctagctattgatctgtagccagcattggcgatgactttcaaatctttcgtaagcataggatttacgcatataacgtaaaatcgtaaatcaaagcttactaactactaagtatctctttttccatttttgccggaacacatttctttttcaacttttcttattagagaacctgcaaaccttctttgttttgtttaatcatttagtattcaggattcattaggctggctaatttagattcgagccaaaacctttgaacctaaaaataagagaaatcaaaatggtaggttcttcctttatttttttttcaaaaatttaattaacttccgtacaccaaataacatgataaatcattgttacaatatctagtaatttagagataattacatgtaattattcataataattaagtagagctatatatatacctagaaaaagatgcagttacttgttacaccaagctaaattataatgatagtataaaaattatatatatatatatatatatatatatatatatatatatatatatatatatatatatatatatatatatattgattcttttcattttcctccgcgtgtgtgtgttttttgttttcttttttggtggggcacgggcgtgtggctggattactggggcatgttgttcgtttttaaaaatactgtgggcaaaggacaaaccaaagagctccatcagagtataatataaattgatcttgatatataagacagcttagaggcatttgctaataaggtggtggagaaaatggtgagaaaaatgaaaatgaaaatgaaaatatatagtccacaacatttagcaacatcatcgtatcgattactttggtaactctaatcaagaatgaatgcaagagatgcagtggctttacaacagttgtgtactccatattatgcatggtatgcttgcatggaattaacatgattttcgtaacttttttggattcattacattacaacttcccaacagtattcttttcttccttcttatctttgactctttccttttcctctgaggttgtagacttgtagtatatgtgaatgccttcgaattagatataaactagtacattcttatttcatgtttttataagccggtcatttttggagacattaatattatatcattggatctgacactacaaaaaattagaattagttacgaacttcgtcgctaaattattcgttcttaatagaatttcttgataatttatcaataattcattgttaaatcggattagcaacggatttttttgtctagctacagaatttatgatccgtcgctaatttttactttttttagtgtaaaatctgcagccaaagcttaagcagagcatgcataggcagttttgtatgttaaaacttggcatgaaaagctaatcttatactatagtttttgagttttcaagtataattttggaaccattctgtcatttaggttaatacaattatcatgtataaactcgtaagatatacaatattttcttggatgtaatttctttgtatagtttctatcaattttactattaagtttctttgagtacttttgctattctttttatgtatattcctttctttgtgatttatgattttcttgataatccataattaagcgcatgtttattcttttacattgataaatgcaattcttttccaaatacatagctttaatcatgactttctaatttctatttatgtgtttgagttgtttgttgttaggtcgaagcaattcttagaaagtgaattcaatatttaactttttccatcacatgaaattttgtaatgcctctcttggtttcttgatttaataattttgaaataaacagattcttaatactagatgatacttttttttagatggttgtcttgctttaggaagatactgatcttgctttaacaagaattttttttcttttatgcgggaaataagattgaactcatgagttattttacatctttaaaatttttagtaagtaaataaatcaaagagcgtataaaaccaaaaatacaaaatgtgaatatcttgggaaagtcaccgaccccctcgactagggggttggttagccaatgggagggtagaaaaagattttttcaattaaaaacatagaatactgctttctccaaaacaatttactttgtgcctcacacaacttgtactagttgtgtgagacctcttttttcgtctcataattttgtggacccaaaattataaaatataggttcacaaatttgtaagataaaaagagatttcacacaaatagtgtgagacctctttttttgtctcataattttgtggacccaaaattataaaatataggttcacaaatttgtaagataaaaagaggtttcacacaactaatatcagttgcgtaaggcaaaccataaaacttttctccataattggaagataattttgaaagcccttattttatacttagctatgcatataatttcaattttttcttttaaggttaataaacttataattgtaattttattattgggatattagcacttttagcccctgatgaattgataaattattattttagtcctcatgatatttggttaagcgcattagccttcaattacttaaaatgtacacttatattctgtatttgagaataataatagagatttataaataatctaaaatatgacgtacttcctttgtaaaggaaaccaagatacacttcttgatttattaaagattaagtatgcttattgaaatatcattgtataggcaaaaaaattatcctagttatatttgggccacatcagactaaaggagccttcgaaggctgcctatgtcatcagtatgatttcaacgaaagatagatttaaggtcgaaatgatctgacgaaagataagggctaggtcgaggagtcaacagaggtcgaggttgaggacgagtaccctccttaatggagcagtaacgactagttttggggatctgactttaaagagaatattcctaaaatctgtactattagagttttgtggcacatgtcctcttataaataggaagagacatagttatagagggcattggacactcatttgtaaaagaacaatactttgacattctctaaagattcttgttttattatatacatataaaagacaccttttcttgagattctgatataacttttctcccacgatccaagaaaaattcgaatattcaaaggcacatcaatcatttatcatcgtcatagggaataccacacgatttcatccctttcgggcatctctcttgcatttatttacaataattccattatataccattattgctatttaatgctattcactttgtatttgagccattaaatattgtttattgttacatattcactgctgttcctacttctatatgacattttgtcatggtactagttaaataatcttttggatattaatattggctaaaattaaccttatttcattaaaaaatcgtattgtttaaacctagatctaaattttgggtcaaacaatcataaaaatcaaaatcagaagttatcaataattgagagctcaagagtgcaatatccatttattctatatgatttatactgtacttggtaaagaaccaataaattgtatctttagagctaattcttttttaattagctaatgaaatgaatcataaatacaatttttggtgttttctactctgtcacaggagtcatttggttatgaattatgaaagcataagaagattttggatcaagtgccaaaatgtcgaccgtttccaacactctagaagaagagcttgtgcacaaatctatggagttcatatattgctataaaaaggatgcagaagctatgattttacgtttgtggataataactaataagagcaaaaatatcctcaaatttttgtgaaagatattttctaaatgttgaaacttgaaacgtattaacaagagatggttgctaagtatgataagcaccctttacctctaattttaaaagattgtgggttcagatcaccaaccgagtaaaattaaaagctcatgggaaagggtaaagaaaaacttgaaggaaagggatgcagtgggttttttctaatatggaacaaggaaaaataacattatacaaccgctctcaaaataatagtcgaaaaatatataatttttttgtatatacatacatttgtatgatatatataaaattttacaatttttatatactttttcagctatcgaatataaatagtttctacctcgagttaaaaattgaaaaaagccctgaaaaaaaaaagctagtataaaattgtgggccgcaagatagagacacgtgtcaaactactcgaccaaagtgaaaacttttactttagacccgcgtcgcatggaattaatccacctgttctcccattttacgaagccccttcggttgagaatcagaaaaaaaagatagtagaaagaaggcgccaatggagaagatcagagatgtaaaacgacagagagaagtaactcgctaatttattaaatcaatttttcactttgcttcgtaagtgttttttcccgcgcttttcccccttagaatcagttgaaattttctctattttttcctctaattaaatctacactaatgatacttagattactgtatatctggaattttaattgttgctattcatatagaatgagattacatggaaatcaaacaaaaaatcactgttcataattgaaatggagcaattcaactgcaaattcaagctcctagtggtttaattactaagttaataatatgatcggtgagcatacacttgtaaaattaggtttaacaatgttaacttgcatcataagctaagttctgaactatgggatcaatacctaagaaattagaaattaaatcaacgaggaagaagactacttaatttactcacttatgattaatacgcttctgaatatgtgatggtttagctttctagagttatcccgttattctctttgcaaaatcggtaacacgatagttgagattatactatgatgttcacaaaattatccaggggggcatctgattgtcccaaaatggagggaaatcagatttttctctgtacctttctgaatagataaacagaaaatatgccattttctaaaccaatttgtcagagagatagagggagatatatatatatacacacacacatatatatatatagagagagagatgaacttttcatctcgatgtatggccttactatcctggatttatggttcttttatctgatagattgaagaaaatattgttgtcaagtactatttagcacttttacttagtttctaaggagataacctttcactttatttagtacatgaagtatcagcttgaattaggactaatgatgactaaattgtttgaaggggagccttggagcaacagtaaagttgtctccatgtgacctataatataggtcactagttcgagccgtggatctactaatgcttgcattagattaggctgtctattggggatgcggcccttctccggaccctgcgtgaatgcgggatgccttgtgcaccaagctgccctttgcaccaagctgcccttctcttttttgatgattaaatcgtttatgccatttggtgttctaaggaattattcgtaagtaaaaccaaaagaattaagataaagaaattgcaggcatatagagtagcattaacgatggattctgatattttccttttatgatgtgaaaatatagcgactaatcaacttgattagcaaaggtgatatcatttattccgttaagtgcagtaaggaactatttatacgtaaaaagaagcgatttggtttaagaaactgtagatgtatttgtcataatgtcaattagttgaaaggagttttgaaatgataagtagattgtgatatacagcttggacctatgaaatttagtgagatcacgctgataaacagttttatatggttaaagactcgtcaattgacatgccagacttatggaacttgatcttgaagtcacacttccttcttagcttacaagggaataaaaagaaattaagaaagagataattttactaaagttgctattatgctggctaatttgtgggtttcatttgcagaacaactattgttgaaaggtgatggtagctgtatatggttgcgatggtaaatcacgctaatattctttgcaggtgtagttagtgtaagatcttaactaattctccttgtcaatttactctcaagatctaccttgtttgggagtttgtgctttcaacaagcacatgtaccagagatcaatgtggcttgattgctgaaatgttgttgctctacattagcctcaaactggataccaatacaactttaatgtcttaaatgtggtgaatgtatacaaaatttctgcaaattgaaatataatttttttgtttccagtttgtaacatctatctgctgaagtttgtggtgttagccaaccgaggtaaagcatatgcgcaatgaagatcctgatggtgcatttgtactttgttaacaaattatgggttctcaaatcatacatgacctctatgagaatcctacttaaaaataaatagactggtaaactttgtcccataatttatttgtcacagtgaggtctcttacatgaagattgaagagcccctcaccattgatattagattgactcataagaaaaataggtactgataatttgattgtgcatttaaacaagtacaaacacacaggttggcagcatggagtttgagtgtgaagaagagatttcacatatgctctctcagggaccataaccatcatgagtttatttttagtttgtctatgtactttccttcgatgatatttttttgagaaatgaagtcaaggaaatcactgaagcttccttctttgtaggacaagatatgttgttcgttgacaaggtctggtgcaggtctaactgttttacctaaagctagactatgaaggctggcaattgaaatgcgctttttttctgagttaactgctgctcggtggagaacacttttgtatctgccattgctcaatacttccatgtgatctcccagctgaacaacgagagctccttcaatgactggaactgcatgccacttttcatctcggtccatgatttgtaagccctggtaattttgaagaatgatggatagcataccataatctgtgtgtggtggcaatcctagtgtaagatctggctcaggacatgctggatagcaattaacggccatgacctgagagccttctgcaatgtcttcatgtaagtaactagggtttagtcctaagctctcaaatatcacttccatgagttcttcttgcaacttttgtgctgcctttgtgtaatttcccattttctccctgcatgataaactgctttaggcacttgaaaaaattatattgttcttgaacagtaagaatatgcatctataagacagcaaaagcatattgcaaggaaaatgagagacttacttgtaacatgtgggatttgatggccacaagtcaatccaagttgagattggattagcgtagtgcttgaggaagtctctccaaaagtgtactttgtctttgacatgatttagactagtaccatatcttatgggttcatgaacatttgaagacaagagatgctttttctcttcagttggtaaatcgaagaattcgcttgcagcatctatggcatctttcatgactgacagtgggattccatggttaactacctgcaaagtcatttatcacatgcatgttgttattttacgttcaggttgaaagtattttcttcctgttagacaacctaagtagctgaattcttggacatttgttttaacaaatttgaaaataaagggaagagagaagacagaggagatgaagcctagaaccctaccctgtgtgtgacatgaagttatttctgcttcttgatttccaaatgctttttctatatgcggatgatctgacatcattttacttggtgtgtgcataatattcaatggatcctatcttgaggaactttatgtatactgaagtaaataaataggcaagacaatcttattctagtgcgtgattgcaggtgacatggatgtaacacgacaagtagggtacctggaagaaacctagttccttgcaagccaggtgtacttcctggattatctgaggccgaagaagagggtgtcgcagaaaggagagatctacaacgggcaagcatgtgtcacacagggtacgctcggggcgtaaggatgggggaagaatgtaacgcttgggaacataggttagcccctcttcatttagtgtcatggcagtagtaaaggaaccatttggtgaagctgagctatctctcatttttcccaccatattgtgctctttctccctttatgttatggcttatctccctatttataagcaacaaatgtgaagataagattggagtttttgattatttttccagttatatatgtaatgaatatacgtataatgtgacggtaccatgagtataaccaatggagaaatagagaatactcatacatgaagagccacaaaatgaaacattataagcttgtagtaactccaatgtgaaggtaattgtcggttccaatagttgaatccgatagagtaacagtgttcagattcaagtgggagtgagcccacgcgccatgagggagaatggtgagctaattttacacatgcagtacgtaggcgctctgggattttcgaacgttatatttcctgttttcctcttagtatcctatcaggtgcatttttcctacccatgggggtgacgagaacagagtaatttactgaggcggcaagcctcatgtttcttatttcttttttttttcttcaatcgaaaactcaaatgaaataagaaattgacatgtgtctggtttggttgggtttgatttttatttttttaaaattttggacttgattttagtttgaataagaaaaatttcagtgtgctgtattttaaatatatcttttctcatagacaatccacaaatactatgtgattttttcgttaaaattttactccgtatatattcatgatccttacttgtaatgtaatctttaatatgattattctgatgaatgatccattttgcttatttaaatacttaatccaatgaatgacactttttttattgagagttatttaaatccttcgatctactttttctttcattttcacaattcaacatttattaagctcatatatattttttactttgatatattgtatgttgacggttcttaaaattaaacttagcatattattatttaggtttcatattgagtttcatgtcctatattgagaatttttaggctttggcaggaattgcagagaaaattcctcacataataataatttaataggtataagtttgtccatttgtttaattcttgccaagaatatattgactaatagagttgtttatccattatttctacttatattaatcgaagctcctcttcgtcgtcgtgtatgattgctgaaataagaaagtaacttgagggtagttttgttattcgttcagctaatttgacacttaattctgatatggacgcaacgtggccttcatgtactattgagcaatttcattggctaaagttaaagctttttagtaaaagctttatctgcttgacgattttaccctttactatttcagaagccacaacccaaggatatcttgcgttttgtaatgtgggaccaaggatattggttcaaaaagaagtttactgtttaaaagtttaaaacacaataattatattggcgtatacggttaaaatcgggtttgtcctttcttgtatgactaatggagactgcaacgtggcagaccaaggttcgaccccatgttatatcggaccgtgatgtaaagtagattgcagagcttgtgactcagagatcgatcgagatcgaaatcggccaagaccgagaccaagcaggatagagatcaagcaagatcgagggaagcttaccgagccaaataaccgaaagccaaaatatccgcaatcagatgaggatcaccgcggaaatctcggcatgtatcaagaagaggctaattaattagctaatcatgggatttcttattgtatttagaattgtattaaggtaggactcccctactatataaagaggacatgatcatttgtaaaaggcatcatatttacgcaatgcaaagcaatatactacctttctcttaaactctcaatactctgttactttgttcatatttccggtggaatattcgtttggttcgagggcaacctagctcgagggccaaagttatacattttctttggtttgcttttatttctatttatggtcaatttcaatagcaatttacgtattttctcaatttgtaccaagtaaaatcacgtgtccttaaaaccacatataagttcaactgttatccgttttctagggtaagcagtttggcgcccaccatggggctaagaataatagtgattgtctggtactaactttcgtgacacacactattttatacttattcttgtgagtatctttgattccaggatcagcatgtcaaactctcaagcaacacccacacacatagacaatggccttggtttccatgacggaaacaacaacatagccaccctagggaatgaagtacctccagctgacctcgatggagtcccgtccgtagacccaatcgacgtcagctctcatgttaccattaatgcaaatttggtcgtcgatcctgagagtagcgtccgcagagacgtacgatcatccggtcagaacgcacagggcggtgaagaaggcgggatcagccttcgagtgatattcaaaatatcgcaggcttaacaagttgcaatagcactactccaaaaccagaaccatgcatcgagcaggatcgagcccgagccattataggaagttgttcgtagggccgaatcagtgtcaaagagatcgaacggaaatgaatcagggaccgatcccacaatcatgaatatgctcgaggaactagcaaagccagttgaatcggggtagaagaaaattgaagcaaatgacaagaagatggaaacctataattccagggttgatcaaattccggggtcaccaccgattttgaagggtttggattcaaagaagttcgtacaaaaacctttcccccgagcgcggcccctaaactaattcccaagaagttccgcatgccagaaattcccaagtataatggaacgaccatccccaacgagcatgtcacttccacatgtacgattaaggggaataatctggaggacgatgatatcgagtctgtattgttgaagaaatttggggagaccttgtcgaagggagcgatgatatggtaccataactttccacctaactccattgattcatttgccatgcttgcagattcctttgttaaagcacacgccggagatataaaggtcgagacaaggaagtcggacctcttcaaggtaaagcagaaagataacgagatgctcagagagtttgtgtctcggttccaaatggaacgtatcgatctaccaccggtcgctgatgattgggccgttcaggccttcacccaaggactaaacgtatgaagctcggtggcttcacaacaactaaagcaaaacttgcgaatacccagttgttacctgggccaatatgcataatcgataccaatcaaagattagggtcgaagacaatcagctggcgactccttctaggtctgtttatcctattagaccagtcaataaagtcaaaagggacatcgaccgagagccacggtcgaacagggatcgctaccggccatacaatggagatcgaagaggcaacgggcctgggcgtaaccctattcgaggtgaaaggagaaatgatagaggtcagaactctcgggggatcatgagcaagaatggttttgatagggatgtcgggcccaaagaagcacgtgactatcagaatataacttcaatattgatgcatccaccatcatatcagccattggacatatcaaagatactatatggcctcgacctctacagactggtccagcccagagaaatcccaaccaaatgtgcaagtatcatggcacccatggccatagaacagaagattgcaaacagctaagagaggaagttgcccggttgttcaacgaggggaaccttcgggaattcttaagcgatcgggccaagaatcacttcaaaaataaagattcaaacaggcagaacgagagaagagccacaacacgtgattttatgaatgttggaggggtcgatattcctcaaggactagtattaaaatgcaccaaggtgtcgatcacaagggagaaacgaactcgggattacgtaccagaaggaaacttgtcttttaatgacaaggatgcagaagggattgtacaaccctataatgacgcactggtaatatctgtacttatgaataagactcaagttaaacatttcttaattgatccaggtagctcggccaacatcatttgatcgagggtcgtagaatagttcggcctataggatcaggttgtgcccgcggcccgagtgctaaatggcttcaatatggcatgtgaaaccaccaaaggcgagataactttgctagtagacgtggttgggaccgtccaagagatgaagttccatgtgatcaagggagatatgaggtataatgccctatttgggaggccgtggatccataatatgatggcagtgccctcgacccttcgccaggttctaaagtccccgacgctagagggagtcaaaatagtctatggggagaaacccacttccaaggaaatatttgccgtcaacgaagtgatatcgatattggcactctcatcaatgaagaggtcaaatttgaagggaaaacatgacgtcaaatagcaaccacaaacaccggcctcgacccaatcagagaagcagggggatgacgaggatgatgactatagggttcctcgatccttcatagtcctcaatgattccgatgccaccaagtcaatggtcgaagagctggaacaaatcatactaaccgaacatcagcccgaatgaaagatatacctgggcacggggctagcccccaagcttagggaaaacttattcaattccttaaaactaacatggattgctttgcttagtctcatctcgatatgacagggatcccaccgaaaatcaccacccataaactaagcctggacctgaagttccatccggtgaagcaaaaaagaaaaccccaatccgaggtcaaatacgctttcattaaagacaaggtaaccaaatttctcaaaatagggtctatccggaaagtaaaatatcccgaatggttagcgaatgtagtagtagtccctaagaagggaaacaagcttagaatgtgtgtagattataaagacctaaataaagcatgccccacggattcttttcctttgcctaatattgatcgcatgatcgatgccatggccagccatgagatcctcagttttctagacgcctattttgggtacaaccaaatacagatgaacccgaaagaccaggaaaagacctcgttcattactaagtatagtacctactactataatgtaacgccattcagattaaaaaaatgttggtacaacctatcaatgcctagtaaaccgaatgttcgaagaacaaatagggaaatctatggaagtttatattgatgatatgctagttaagtccctgcgagcagagaaccatttgaaacatttgcaggaactttcagtatattgaagaaatataacatgaagctcaacccagaaaaatgtgcgtttggggtcggctccggaaaatttctcatcgtcatggtatccaatcgagtaatcgagatcaaccccaacaaaatcaaatctatcgaggacatcacggtagtagacaacatgaaggtcgtgtagaggttaacagggtgcatagccgccttggggcgattcatctcgaggtcctccgataaaagctatcgattcttttctttgttgaagaagaagaataacttcacatagacttcggaatgccaacaggccttggaggagcttaaatggtacttatcgagcccaccgctgcttcacactccaagggcaggtgaacacctttacttgtatctggcagtatcggagatagcggtaagtggagtcttggtctgaaaagaacaaggtacacaattacctatctattatgttagttggaccttaggtgaggccgaaactatgtatccccatctagaaaaattagcgctctctttgagaagcgtctctaggaaactaaaaacatactttgaatgtcatcctatatgtgttgtaacaacttatcctcttcgaaatattttgcataagcccgagctttcgggacgattggacaaatgggtcgtagaaatcagcgggtacgatattgagtatcgatccctaacaaccatcaagtctcaaatcttggtaggcttcacgccggccctagtagttgaaagacaattattagtcaactcgggtacatcttcgggaatctggaccctctttacaaatggtgctttgaacacaaaggggaccagacttggcatcgtgctaaaaccacccacatgtaatgtggttacacaatctattaaaactgtaaaattgaataacaacgaggctgaatatgagaccataattgtaggtctcgaactagctaaaggcttgagagcgtaggtgatcgaagccaaatgtgactccctcctcgttgtgaatcaggttaacggaacctttgaagttcgggaggaacgaatgcaaagatacctggataagctacaagtaactctacaccgattcaaggaatggactttccaatatgtacctcaagatcagaatagcgaagccgatgccctcgaaaacctagggccatcggtcgaagacaacaaactcaatttgggggctgtcgtacaactcatgaggtcagtggaagaagaaggccacgtcgagataaactccacaagtttgacctgggattggagaaacaaatacatagagtatttgaagaacgaaaagcttccctcggactcaaaagaatcaagaactctacacgcaaaggcagcacgattcaccttgtccgaagatgggaccttgttcagaaggatgttcaatggtccgttatcattatgtttgggaccaagagataccgaatatgttctaagggaagtccacgagggcacttgcggaaatcattctggtgctgaaccattggtctacaaagtaattagagccggatactactggatcaacatggagaaagatgaaatagagtttgttcaaaaatgtggacatgcaccgatgattcatcaacccggggagctactccattcggtcttgtccccattgacgttcatgaattggggaatggacatcgttggacattttccatagggaccaagtaatgctcaatttattttatttatgtctgattatttctctaagtgggttgaagcacatgctttcgagaaagtcagggagaaggaattcatcgacttcagttgggatcacatcatatgtcgattcgggataccttccaaaattgtatgcgataatagaatgcaattcatcagcagcaaggtggctaaatttctcgaagattacaagatcaaaagaatcttatcaacaccttatcatcccagcgaaaatggataagccgaatcgaccaacaaaaccatcatccaaaaccttaagaagaggctaaccgacgcaaaaggaaagtggaaggaaattttgcccaaggtccttgggcataccatacaacatcaaagtctaatatcggggctaccccattctcattagtttaatgcgttgaagctctaatacctttcgaggtcgaaaaatcgagtatcaggttccgatatgcaacagaagagtcaaataacaaggctatgaatacgagcctagaattattagatgaaagatgtgaagtcgccatcattcgattggctaccctaaaaaacaaatcaggatatactacaatcaaagagccaatcttcggtatttcagcgtcggggaattggtactaaggaaaattaccatcaacatccaaaatccaaacgaaaggaattgggcccgaattgggaaagagcgtaccagattctcaaagtcacaggaaaaggatcctacaagctcggaatgatgaatggaaaacaactaccaagtaattggaacgtatcccacctgttattttgtatgagtccaccaaatagtagagtacctggtcctctacgagattctgctgagaatgctaataaactgtaagtaaatgaaaaacgggatttttatgtggaaaaatcccacacaaggggaccaaaaaccacgacctataccagtaggctttcaacttcactaacttgtaaaaatctattaaagctactttgtaatgactccattacaaagaatttaactcaactaacttgtgatactcttaccacaagccactttgtgacttcttagttacaaagacttttactaacttgtgatgctctaaccacaagcaactctgtcactctacagttacaaaggcttttgcttatgactaaacctagtcacaacataaactcaaggagtttacggattttacaagaggattcctaatcaacacttctagctaaaaaatttaggagatataataagtacaatcacaaagttacaactcaactaaggacaacacatgctaactttaggaactggtccgtagttgtattcaactttgttcttcatgctcgtgaggattgatttctttgtttttgcaaaatgcttaaataagaaactgaaacattcaagtgatgttttaatataaactcattgttggtacaccttgatcacatcacttgaaataatgcgagcactttagttggtcaagaaataagtgggcactggtgacaatgtagtgcgacagaaatagtgcaggcagtcacttcatttccagctgtgtccaattgactgtgtactgctacgagggaaccacaagggtatcaggtccttgtttagtttcctacctcctgaagctgtagcaattcacctttagctgaaatctgttaaatgcagtgtagtccaagtgagtcaggttccctatctggtccttgacattaagtttgttagatcatcaaaacacaaggaaaagatattgaaaacctatcaatttccccatttttgatgatgacaaacttagcattgataatggatttagagctaagagaaccagattaagtaacaggagaacacaagttgcccctgactttatgccctttttaccccctattttatttgttcccccatatgttccccatgactttatggtcatattatactattatttttccccttttggcatcattaaaaatacacaatcataagaaaaatacaaagaagtctagctaagctaactcatgccacatatgtgcacacaaacacgatagagaatagaaacacagaagtaaagcactgatataataaaagaggatagaatttatattgataaaactttaatatgcctttgcttaaaaacaagaggcaatatggactgttaaagagagagtagtagtgtttcatcccaaccacataaaaaaaacatctgccaaaaaaaaaaccaaaaaaactgaagaacatttccagaatttggtcactaaagggatacctagaggcactaggagtagaaggcttggaggctgcagcaagtgtttggagaacaaggtctattcgggcattgaccgacttttgctcgttgatcagttttgctttcaggttctctacttgcgccctgagacaacaaatttcctcaattgcactattttgagcattaatcagctgtgagacggttgatgtacttcctactcccccattcttttccagacactcacattcgcccaatgtagtctgtgagaaagtctgcttcttagtccccaccttaccttcccccaatggcaccgcaaagaagttaaacactctggtaagcaaaaaccgatagggaaggccatgattgccatccttgaaggtgggtaccttttgcatgtgcttaatcataatagtaggcatgcttacagggttaaaactgtccagttgctccatcaagaacatgtaaaacttagaggccacggacctcctctcagctcgaggtaataaaactttgttgaccaactcaaaaagtagctaatagatagggagtaacgccttcttatggatctggtcccccttctagtttgcgttgtactttaccacagcatttctgaaattgaactgacaaacatcatttacactggacacaccggctgtagtaactttaagaaattcaccaagcagctttacatcaaacactatatccattctattcaccaaagcacagatgtggtcggtgtcaacgggaaaaaggctagaaaagaacctttgtacctcatcctcataagccttagggccatctatttgaaataaatgcccctattgttgaaactcaaccatttcaagaatttgtcgcatgtcagccgtctcagagattgcggggtcaaatgtacgaccaacagaaccttttggtgccttaggccttctgagccaagactgactttactccttaacctcttcatagaactaggttcctgaacattttcaaacttgcgttttcgagacttctcaccacttaattttccttttcccttggatgtgactagcacatcctcatcagacatcgagaactcactcacaatctccttcaatttggagctagaaggtgaccctttttctattaaagcaggctttttctttttctgagaccgtctaactagagaaccaagttcatctagtgtttcttcttccacctctactatagggatcgcctcatcaattacgggtacactgtctttcaccaacttcctccttttcttcttactacttttcttgctcctttgaagggcagaatcgtaggccagcttgaaacctggtagtaggtcattggtttcagactcaggagtggacacaaccctccacttaactatgaacgcatcaagagacacgttatctaggtcctcctcatcattggacctcatttcaggtacttgcatttccaaaggcacggtagtgaatgcaggagcagaactgtcctgggaatgagagccctaacctgggtcctccggagaggtatcaggttcctcatgtgagggcccaatagtatctgctagtgcatacccttcaacagttacaatggtcccttcgtcccccacactttgtacctcatttttctgagagatgatctcatgcagtacaccatcagcagacaccacaaaaacggatacatcattctcttcctcaattggtacaactgccaccacgaaatcggtagcaacgatggcggaactctctatgacctcagggttttgaccttgttctccacttggtctttgactagtggtaacctcagaagatggagaggacggatcaacaattttaggggtatctgaaatagagagagacgaggaatctgggtgaggtgtgattttagcggaagggtaagagcgggtaaggaaggctcagtaggaacagaagtctccataggtttatcagtagtaggtacgactgaggtagagaggtcgaagtttgtctcggccattggaacaatgatgtgaagatgcttttgggaaattctaatggagaacttatggttagggagaatagcaaaggatttttatgaggaggggataattataaagagagaggaataggcaccggttctgaaatggcggttaggcatggagaagtgcaacgtttcagagagagatggaatgatttgaagtgaagagatgtgacagcatgatctaaaaagttgaatgacatggtagttgtattttgtatcctttttaagacgtgtattaaaggatgcacagaactactaacctttggtacaagaactagattcttgaccttttatttgaaggaataaatcctcttttatctttcatgcactgcatctacagcttatatactcatcatgcgtgtttacctgcaacggtattaaagtgagttagacatggccagagaacacttttagccagttatttcttgaaggtgattttcatagccagataaagaggaaccaggttctcaattgggctttaaaagccccaactcactctgtttctttcaaattgttccctacttaatgccttggtgaacatgtttgcaatttggtcttatgtgttgcagaacttcatacatatcagccctttatccacattgtccctcaaaaagtgatgcctcacatcaatatgctttgtccttttgtgttgaactggatttttggccatgttgagtgcactggtgttgtcacatagaaggggcacactcttagtgagtaccctaaagtcctctagctgcttcttgatccataaaagttgagcacaacaggatgttgtggctacatattctacttcagttattgaaagagccactgaattttgtttccttgtgccccaaaagataagacatgaacctaagaagtgagccattccaaaagtgttttttctgttgacaagataacctacatagtctgcatcagcataagcagtgagattaaagctgtcacctgagggataatacagaaccaggtcctgtgtttctttgagatatcttagtattcttttggcagccttcaaatgagattccttgggatttgattgaaactttgcacatagccccacactaaagacaatatcaggtctgctggctgtgagatggaggagcgacccaatgatgcctccatacatggtttgattcacaggagacccagtttcatccatgtccagatgagtagccgtagcaatgggagtgtctatcacttttgatgtttccatgtcaaacctcttcaagagctccttgatgtatttttgctgacagatggatataccttttggggactattttacttgaagacccaagaagaagttcagttctcccatcatgctcatttcaaattcacttcccatgagttttgcaaattcttcacatagagaatcagttgttggcccaaagatgatatcatcgacatagacctgaacaatgagcaggttcctcccccatttctttaagaacagagtgttgtcaattttccctctcttaaagccattttccaagagaaactttgacagcctttcataccaagcccgaggagcctgcttcagcccgtacaatgctttgtccagtttaaacacatattcagggtgttcatgacattcaaatcctggaagttgcttcacatagacttattccttaagatgtccattcaaaaacacttttgacatctatttggaacaaggtgaattccatatgagatgaaaaagtgattaaaattctaatagcttccatgtgagcgaccggagcaaacgttttatcatagtcaatcccttcctcctaattgtagccttgaaccactaacttggccttgttccttgtggtaatttcatgttcaccaagcttgtttctgaatgcccacctggttcttataatggttcgatttgagggtctgggtaccaggtgccaaacattattcctttcaaactaatgtaactcgtcttgcatggttgtaatccaatctacatctttcaaggtttccttgatattcttgggttctatctaggagagaaaagctgagaaggcaagtgaatttctggctcttgacctggtttgtactccggaatctaaaggagtaataatgttgtccatcagatgagagctttggtgtctccagttagaagtctgaggttcattttgagaggatgtgggtgcgtttgtctggttttcttgcgttcttctctcaggtgctaatagagttccctgaactgcatcaaccactctttctttagcttcagtggttgtaattgaagtacttggttccattggagatgagagagtattgtcttcactcagctattttacttgactcatcatatctgcctttccatttgtcgtgtcaatgacttcacatgaactagaaagggttcttcatcttgatcttcttgagcactcttctcacaggatggataaaactcatcaaaaataacatgaacactttcctcaacacattgagtctgcttattatatatcttgtaagccttgctttgagaagagtagcccaaaaatattctttcatcactcttggcattgaatttaccaagctggtcctttccattgtttagaacatagaatttgcacccaaatgttcttaggtgagtcagcttgggctttcttccattcaacaattcatagggggttttgttcagaagtgatctgatcatgcacctgttcaccaagtagcaggtagtgttgacagcttcagcctagaagttctttgcaattccactgtcgattagcattgttctttccatctcttccagagttctgttcttcctttctactactctattttgctgcggagttttgggagctgagaagttgtgagtgataccattttcattgtagaactcatcaaatttgacattgtcaaattctgtcccatgatctgatctaatgcatgtgactctcgactccatcttcacctagattttcttcgcaaaagccacaaacacttcaacggtttcatctttagttctaagaaacaaagtctatgtgaatttggagtagtcatccactatcacaaaaatgtatctttttcctcctctgctttgcactctcataggaccacatagatccatatgcagaagctctagtggctttgaggtgctcacatccctcataaacttaaaggatgacttcacatgttttcctctagcataggcatcacagaccttttgcaccttgaattttgagataggcagactatggaccaggtccttctgaattagtttgttcagaagagaacttgtgtggctcagtcttctgtgccatagttcagcatcatcatcaacaacttttagacaactcagatcaccactttgtaaggactcgaaatcaacaacatagatgttcttgtatcttttggccacaagtaccactttaccagttaccagatcagtgactgtacatattttggacaagaattccactttgtttcctttatcacagatttgggagacactcaggagactgtacttaaggccattaacatagtacacattttcaatagaatgagtaagtgacttcccgacttttccaactccaagaatgtacccctttttcccattgccaaaggatacactccctccttgaagggcttttagtgaaagaaagtccatggtgttcccagtcatgtgctttgaacacccactatccatgaaccattgttgaccacttcctttcactgttctctgcataaggagattaagagttagttttaggaacctaagtaagtttgggtccattgtagtaggcaagaggataaataagagctctcttagtccatgcaggtaatgtgcgttatttgtgagtggaacctggtccctccttagtagtcatcttttcagcaaacacattatttttctgaacagattgatccctggcccgtcaattttctttgaagtgcccattgttcccacattgggtacaaggccagttattagagatagtgacgtacttgctatgagggttgtaagggattttctccctttggaaccctattctctgcctgtttctaccattattagtgtgcatggcagtgttggcttctgaggaccaggtccactttaagaacttttcaagatcattttttactctttccagatcagtttggaggttcttgtttttttcaattttagcacatatcctagttctcgcaactttaaactcagtttcaagcctaatgtattccacactagctatctctattcgtttttcaaaattttcaggttttgatttagtccctggtctctctattgattcccttaggtatgcaattactgtcatgaaatcacttctttctttttttgagttcttcaatggtttccttatggtcaataattacagccactaagtcatttcgagtttgttcagcttctcctagttctacagtcaaggaatccctatcctctacaagactatgataggcatcaatcaatacactagctaaagacatgagtttcttaggagagtaggatttcagatttctctgaacatccctaaaatttacctccttgttatcatcgtcttcatcatcatctgattgggccagcaaagcaaaggttgtgtcatatccattttactcacctttagctgccatcatggaactatcaccagcatcagtttcatcttcagactcactagaggaatgtccccatgttgcaagatcatgtttcatcacattgtcagcagatctttttcttttgaagtccttaaaaggaaccgggttcctcttaactgcctttttagggttgttcttggagaattcttgcttcaagagaggacagtctctaatgaagtgtccatgctttccacacttatgacatagatcatagttttttagtttactagagctacccctttttagtatttctccatttcttctgaccatcttctgaaactttttggtcaagtaagctatgtcaatgtcttcatcacttgagtcattgctatcagctttgagtaccaagttcttttctttctttggttctcttctttcactgtctatcttcttcttcatctcgtaggtcttcagatttccaataagctcttctgtggtcagtttctgcaaatcctttgatttagtaatagcattcaccttgctttcccatgggctaggcagagtactaaggattttcctcactagcttgtttctaggaatggtttcgccaagtgagtataactcatttatgatggaagtgaatcttgtgtgcatatcttgaatagattcatcgtccttcatcctgaagagttcatactcggtagtgagcatatcgatattggactgttttacttaggtagttccctcatgagctatttgcaaagcttcccatatctccttggtagtgtcgcaggcagagattctattgtattcttcaggtcctattccacatattaaaatcttcttggcacgaaaattcttctctactgcctttttgtctgcatcaatgtattctttactggtttttgccattgaaaatggatgttcttctagttcctctgttggaacataagggccatcgcatatgatatcccataactcagaatcctcagtcatgataaaatcatacattcttgttttctaccacccgtagtattgtccattgaacttaggtggtcggtatgtagattgaccttcttcaaaatttggtggagcagccataaggatccttcctaggtgttagcctgatatgagaaatctactctgacaccaattgttagtttgtatgagtccaccaaacagtagagtacctggtcctctacgagattctgctgagaatgctgataaattgtaagtaaatgaaacacaggatttttaagtgaaaaaatcccacacaaggggaccaaaaaccacaaactacaccagtaggctttcaacttcactaacttgtaaaaacctattacaagccactttgtaatgactccattacaaagaatttaactcaactaacttgtggtactcttggcacaagccactttgtgactccctagttacaaagacttttactaacttgtgattctctcaccacaaaccactttgtcactctacagttacaaaggcttttgcttatgactaaacctagtcacaacataaactcaaggagtttacgaattttacaagaggattcctaatcaacgtttctagctaagcaatttaggagatacaataagtacaatcataaagttacaactcaactaaggataacaacatgctaactttaggaactggtccgtagttgcgttcaactttgttcttcaagctcgtgaggattgatttctctgtttttgcaaaatgcttgaataagaaactgaaacattcaagtaatattttaatataaactcattattggtacaccttgatcacatcacttgaaataatgtgagcactttagttggtcaaggaatgagtgggcactggtgacaatgcagtgcggcagaaatagtgcaggcagtcacttcatttccaattgtgtccaattgactttgtactgctacgagggaaccacaagggtatcaggtccttgtttagtttcctaactcctgaaactgtagcagttcaccgttagctggaatccgttaaatgcagtgtagtccaagtgagataggttccctatctggtccttgacattaagtttgttagatcatctaaatacaaggcaaagatattgaaaacctatcatcacctaaaacagtattattgctaagctacgacccttttctatttccttttgttttagactaacacttgcaggtgatcaactagaaatagcgatggatttatcagcatgaagtctttaggtctgaaagcacgcgttgtactcttttttccctggaccggttttcccccaaatgggttttccggtgaggtttttaatgaggtaacagtggatcgcgctaacttaaaatcaaaagccaatcacaaatcggtatcaaagactgtgtttacactattgataccaaatttttccctcatatatttttaatatgcacatatattttcaaaaatagtgcacatgtatttacaaacatgcacaagtatttttatcatttttttaataattttaaaggctttcgaccaatttatttatggatttttactataaaaatatccaataattatccctcatattattttttataatgatttaatcatctaaattcatcatttatgcccaaatagtacttaaatatttttattgcatcttttataattacatttgcatttttcaagctagaattgcatattttgcaataatagcccatgcatatgcataattatattatctatatagaaaatgacttttcatatttttataatgtcaagtaattactttaaattattttcatgcacaaatgacatttatttactaattattttactgatttaattgggtatttaaaatccagtccctttctaattaatttcggacctagtccaattgtatacacctgcccaaaacccaattacccctacccaattaaactacctgactaaaaccccttaaatcaggaccgtcgatctctaagatcaatggtccataccaccatagcctcttttaacttaaccaaacccaaccctaatccctcataaccctaaagccgccgcccctgaatgctctcaatctcccctatttcactctcaaaccataagcgtcgtcaccccaaatccccaccaaatcccctttgattccaaccagatatggaatcatctggtgatttcttaccttattcggctctctttctctattggctaaccgattatggtgttacataatttcttgcctaacatggaaagtggatctctcttgttttgaaccaagtctggttcgaatctttatcgcgttctatctatgttctttctccgtctccttatggtttgaatctctggattattagcttattccttattttacctaaaagctagggtttacatcctttgaaatcatctgagatttggtacttattttcgttaaaaatcatatctatgtttccacatgactatctgtgaatcttttcatgatttcgttaaaaggttttccgcctcattttacttaccctaaaattagggcccagatcttttcagatctgccaaggttccttaattttgagtatctttcctttaatgttttcatgtatctatgtttatctatgttattcatatagttgtttatttaaaataatttattcttcctaaaattagggtttcagatcttttctagttcgattccttgtgcttttcgaataaacctcttctctatgttcgttatacacagtgtgatttttctcccttgttactctgttgactttatgatttacccaaaattagggttttgaaaccctttacgaagattttaatctttccttttttgtgcgatattaatgctttcttattttgttcgatttacgtgttcttaccttatttggaccaatgtttgattaataatttatgctacttccttttgacttaaccttagtggcctgattttatgttttggttattaaaatcgacttctaattgattctggaattattccttaccttatttgactactcattgagtccgttaactgatgtcagcttgattttatgcatgttaattgatctatgccgaccttaactgattgttaattgatttttcataccttatttgtgtgtgattggttcattaccttatgtgttctactctattgtatgctataaaacccttcattgttctgatttcaaacacgctgagacacacaaactcacacctacacttacacacttacactcacacaacttgagttctttctatcactctgatttgctgcattgtctagccggctgaaagccaaggctagactcttggattcccattgccttcacctttctgtttactttcttcctaactggtacatttttaattcctattatcttgttctattctatatgcttatgtagtcagttttatcacagaccttaacatgcttctgtttgatacacgattcctgactatctctttctcaattgttatgccttagtttttgttgtcttgttctgttccatgtgattatatgattagtttacttcaaacttcaatatgcttctgtttgccatatgtttcctgtttgcattcttcctgactagtatgccttaattcctgttaacctactctattctatgttcttgtgtagttagtttaccttggcatgtctagcccatgatttctgtttacttctttctagactagtatgctttagttcctgctaccctgtgctatgtgtttgtttggttagttatttcaaactttagcatgcttctgttcaatatacgcctatatggtcctacctagtgataattaataaactaagtaatctttaataatgtgaaaccttgatagattcagttgtatgcttcctattcagaaaggtttaggtatttccaatatatgtggtcagttatgtctgtaattcaagtattttcgtccttgttgtgattgctttaattttggtatatcatccatgtctaaactactactaatctgctaaagatggactctgttctatttgtagtcttgtaatttgaacctatttgttcataaaaaataaaatgttttttaaaactgtcccctaacccttacatatactatttttcaaacttctactcttagctatctaggttcctaccacctctagtgtgagcactgcctagggtccctgagactcctttgaactctaacatatcggagctggtttccaatctcttatgaattctgtgttgaatgtgtggatctagtgtgagcattgcccagggtccttgaggctctttgggaactttgacacactggaagcgtggcttaaggtgttgtggatccctcctactgtttcaagactgttgtgctgaaggccttgctctcaggtttatattgggcctgctaaggcttcctataatgtaatggatactgttatatagtttattcattctaggctgtaataatttctatattaaactgatttggggtttgttagtaaaagctgggggggatttattctatatctttgcttgaaattcgggtagaaatccggcctataggtttattggtgattatgtgagcattactacttgtttagagatcatgtctataggactttctgattgctttgttctgtacttcactcgcatgctagaaatcatgttcatagattccttgctttagaaatcatgtacataggatccatgcacatttttacatgcattagtaaccatgtatataggatcttatctgtttgaataataattttcctagcaacgtgtctaaagaattctgcccacacgtgattaatagatatcatacctataggaactaaaaatcaattagatatcatgcctataggaaataatggaattaatttcaaacctagaaatcatgtttataggatttaatctaatagatatcaagcctgtagggttaaatcagtttgtaaattcagaaatcctgcctatagggggcttatgttaactagaaagcatgcctataggatctaaagagatagaatctgttaaaataagtaatttgtttagaaaccatgctataggtttataattaacaattgtagataccatgcctataggattcttttattcacttaggcaaacttataaggttactaatgattctaggcctaaaaatgctaatatttactgcttgaagatgcccagattcgaggcttaataaaatcagtaggcaaaactaataggtccagattcccgccttagtaaactttgttctatattctgttgctgctcatctagatatcctgtctataggatccttaattaaagaaacctgttgatttaactgcgtgcattcgttgtctacttgtggatattaatatgagcccttattttctccttacatgatagtcatatctgaattttgtttgtcgcgtagcttttctcattttaaataatataggtcagtctagaactagccaaaataaagatcctaaatacctctaggatcataagtaagggacgggtagtgcacgcataaagtacgcattagaagctattagaacgcttaggtaacaattgaaaaatagtaatggggtagtaaaggaaattgatgacccgtgtactaactctatgtgtagcacccttacttggggaaagttaccaagtattgcatgaaaatcatcttataggctaaaaactctagaacccatgtaattcatgtttaaagtaatgtctatttgtctaaattatttaattcgcttgtgtaagttcggccgggacccaccattgtggacctcgaggggtgcctagcaccttctcgtcatgataattccaagcccttacccgatctctggtgacgtaacaggttatatgagttaattgttttaggttccctaatgcaccttaatccgttaggtggcgactcttcaaatcccttacccaatcccaaaatgaaaggagttatccctaaatttcgaaacccgatttcacgagaaaaagggggcgcgaaagcatggtgactctgctggggatatttttaggctcttaccataacgaacttgtctgcaaattagtctctaagcatgtatttattattcctaattcttgcacaccctttccccttctatgtggatttatctgcctatccttattcgtttatgattttcctcccctgctttatcacttttactatggaaactgacttgtctccttgttttcttttcttaagtgtctttaccattattaaatgctgcattttatcattattcaacatgcaaataattgacaacgtgttattttctttttgcataactccatgctcaacatcatattccactcgtgcgtgctaataccatagcggtacttaatgagtatctgcgctcttcctaaaattatcctttaaattcggaaaggcttatttgcagtaaaactagtcgatcaacggtgcagtcgatggttttgtgcctttccccctcaagttatccaattgagggtaccagtctagacttctatagaaaccttgctctgataaataactgtacgtgcatcatggtcaatcctagccggagttaatatgttgtccacataataaccctctaagaaagccttgtccaaagttcaccaggatttccttaatcacaatggatgtaatcacgatattatttggagagataaatgccaacatgctaattgttaatgtgcaagtagtcgaatccggagggggaaaaggtctaactctgtttattttgcaaaaaatgaggcacgaagtccccaggttcagcatggtgtaaagtataccaccactgttgttggactggttggaaaatctttcgccaagcgataaaaaccatgtgaaaagagttcttggaaatttaccttccttattggacattcaaccaaacaacatgttgatcgaagctgctactatgttctgggatggagaaagagttgtattccattttggtgacatagaaatgactcctctcctatagaaaatcggagggttcgctggattaccatgggatagtcccgatttactagtaccagaaaaccacaatactagggggtttctaaaaatgatgagcctgagaaagaatgaggatttggagtgcttgaagaagtcttagataccatttgacttcctctatgaatgatatgaacacagcaaatcttactgtatctttcatgatgaattctccatcactttcctaggttggactcatcgcagggtttttgtgttcatcatctactttctgagtatgatagtgttcccaagccaaggggaaagaattcccaccaggttggccatggtaaccaaagctttaattgagggaattgacggacaaacctatactattgtaccgatgattgtagcagacatataccgggctctagaccgttgcaagaaagggttcaaacactttgagggttgtaacttgctactacagatttggttgttagaacatctttagagggtatcgccaaaagtttccatggagaccatggaacgattacatcgctttccaccatcctaaaagaattacctttatcccaaatagatttgcacagccagagaacgccagagtgggcacagtctttcatcaattgaccgaggaccaggttcactggatgttcgagtggttccctaccgatgaattcatcatcagatccagggatgttctgtatttggtgctgattgggttaatgggaatacatccctatgttcctatcagggttatgagacaagctggtagaaaacaagtcataccacgagtctccaaaatgagtcactacagagccaattttcaggatgatgccattccctacaaatgtgaagctcagcataacagcatttgaagattatcgttgaaaaggataccatcgagccagatcgatatcacgccggtcatgtgtacttgtacccatcatggttagaagataacatagcaagaatatttgagccaagggttggtcaaggaaacaaggtcataaatgaagtcgctgacacataagtgaaatatgaaaggctacacaagagggtccttgaatccgaagccaagcatgtggagcaacacaagttcgacatggaataaatcaacgagtggaaaaatggctacaaggtcggcagaaaggttggagtacttagagcagggtctaatggaactggaggggaatataaggaaaagggttgtagattgttaaatgcagaaggcaacgagggaggacatctaacaagggcatacctactactgaacatgcatggcatggggaacttgattgatggagccaaaaaggccaaatatggagaaggtccttctgggacaaagtagattaggtttatctattttgagtcattttagaattcaaatgtaataaggcagatgccattagtaactcatttatttaacatcattttagattcgtcctgtttattacattactaaaatgaggcattaatcaacattaaatctctccaaatctatttgcctctaggcctacctcgggcacaacgaggttccccaaattaggatgcgaatttatgtttccgcaatacatgtttaaatcctacaagtgcttttctgaatccttactgacttgtttaccttttgtttttctttatttttattatttccatctcctaaggttagttcgcacataccggcatcattagcataccacaccagatctagaggcctccacatcctctcctccgagtaatccgaaaagcaaaggaaaagctaagatggatgatttgagtggtatccgaaaagaaaatgctgagaacattgaaacttcagacggtcggagtactctagcccagaatgatttggtcctatgattggaacaaaaaatactggagttacagggagaacttgagcatgtccgcaacttggcaaacctctccctcaccctaaatgtccttgacatcaaccaacaaaatgctcaaaacccagcacctcctcaaaatacgccaaaccaacgtccacaaaatcatcccgcaccccatcaatatgtaactgctccccaaaatcctaatccttcacaagtacccactcctcctcaataccaacatcttcctactcagtaccgcaaaccaccgaccatactccccagaatatcccccaacctatccttaatctgtaaaactccactaacgatcaccactacactccaaaccccgacacccaccaaaacagtctcatatacgtggaaactgtaactcattctactcaaccaacatcatacactccagaatttgccaagaaggacctgctcattaagaacatggctaaagagcttaaaaagctcacgagccgagtccagggtgtcgaaggaggcaaaggaatcaaaggtttgaattatgaggatctgtgcattcagccagacgtggaactggcggagggttacaaacttcctaagttcgaaatgtttgacggaacaagtgacccaaaagtgcatttgagaacatactgtgataagctcgtggctgttggaaaagatgaaaatatgcacatgaaattgttcatgaggagtttcactggagatgccctatcttggtatatcagtcagaatcccaagaagtgggtcaattgggtaagcatagcattggacttcatagattgattctggtttaacacagagaatgcaccggatgtcttctacatacaaaatctaaagaagaaatcaacagagactttcagcaagtatgctactcgatggaggtcagaagctgcaaaagttaggccagcattagaagaagcgtagatgaacaaattcttcatcagggcccaggatccctaatactatgaaaggttaatggtcatcaaaaatcagaagttctccgacatcatcaaactcggagaaaggattgaagaagggatcaagagtgggatggtgaccaattttggggtattgcaagccacgaacaaagcattgcggtcagagggtatatcaaagaagaaagaagtaggggcagtaatggtagaccaaggcccaaaatctccacttacataccaaacacctccacccacataccaaccttcacctcctagatattctcaacctgccaccacctatcacacttacaatacccagccagcctattatcattcatctccaacccgtcaaaactatcaaaagtcgagacccaattttgatcgcaagccgcccagacaatatacccctgttgctaaacccattgaccaactatatgaaagattgaagtctgttggatatgttacccccattcctgctattgcaatggaaaattcttcccggtaggtcaacccaaacaaaacctgtgcatatcattctgtcatgaaagggcatactatcgatgaatgtctcaccttgaaagataagatccaaaccctgattgatacaaaagtcgtacaagcaaaagaagtcgcgctaaatatctacaataatcccctcccagatcataggggtgaaggggtaaatgtgatagagacttatgaagaataggattctgaggggtcaatcgggcttattggggaaggtgatgaccctaaatttatagtcacactcactcctatcgtggtacagatacacccgccagtcaaagttgaagtagtcgcatcagtcctattcgaaattgaagtaacatcacctgctactgcaccggatccatttgaagtagaagtatccacacccttcaccgtgacagtagtacccacacctcctttcaagtccaatgccataccttggaattacgttgccgaagctaggagaaaggaaaaagcaaagatggaagaatttggcgctgcacaggggatgaccagaactgaaaggatatatacacccgaaaatctgggaggaataagcaaggaagctgctaccaaataacccctcattgaaactggtccagatgatctttggaggaaagtacaggcaagagaatactctgtcgtcgatcatttgaacaagactcccacccagatatctatcctatctctactgcaaaattttgaggcacattagaatgctctgatgaaggtattaaatgaagcttacgtacccaacaacatcactagtggagagatggccaacagggtaggtcaagtactagagagtcacaagatcaccttccacgaggatgaactaccacctaaaggattaagttgcaacagggcattacatatcataatacagttcgaggacaaattcatcaccagggtcttaatagatggggattcaagccacaacatttgtccattgattactctaaaaaggttgggaaagatttccatgagatacgagaagggagcatgaacgagaaagcatttgatggatctcaaagggccacgattggggagattaacctttgtctgcagatgggaccaatttggttcgatgttgagttccaagtaccagacatatcagctacatacaatcttctattgggacgaccttggatacataccgctggggctatggcttccacgctacaccaggccatgaaattcgaatggaaccatcaggaggtaatcattaatggggatggaagtaaccacatttacaccagccaaactgttctggttgtcaagaatagaagaaggctgggtggagagacttatcactgcattgagcatgtcaacgcaattgagaaggacaagtggtagagtaacaaaatagaaagaatactggcatggtctaggtatgaacctgacaaagggcttgggaagaaactccaaggcattaccaaaccgatacagttgaaacatcacggttttgggatgggatatccatacacatgacaagaatataatgattggtcgccaccatagcgtggtccttattaccctctcgagcagtcagtgccacacctgagtcagacttttcacaaggctgatataatatggggctctgtagaggaagaagctttggctgggttgagaatttattcctagaagacgagaatatggattgcaatatttaaggaggaggaggaagaaggcctcaccattcagaccatagagaagggagttgttctcaagaattggactgtcataccatatcgggcccgccgagttcctaggtagcttggcaattagcctggcttgttttaatagccatgctaggcatttaagatattttcagtaattttgttttaaagacgcattttgtttcgaaataattgctcgatttatcgagccgcatgttttggaatttaattaatacattgctatttagtattcattattatctttcacatttttcttttacaatattataattactttttctgatgaaccgatgactatgacatgtaatgagacaacgcaatataaggatagtgacttagaagaagaggaggaaataccggaggaagttgtcagagaagttgagaattttgagaacaaacctaagtccaatctagacaaaaccgaagcaatcaatttgggagattccgaaaccatcaaagaaactcgcataagcattcacctatcacccttagagaatgaagaatacacttgtttcctaaaagaatatgaggacatttttgcatggttatatgatacatgactggtctgaggatatccatagtggctcataagttgcctaccaatccaatatgtccaccggtgaagcagaaactcagaaagctcaaaccagatatgagcctaaaaatcaaagaggaagtcactaaacagatcaaaggcaaagtcctcagggtagttgagtacccaacctgcttagccaacattataccggtttcgaagaaagatggaaaagtcaaggtatgtgttgactatcgagatttaaataaagcaagtcccaaggacaatttcccaccgccaaatatacacatcctgatcaacaattgcaccaagcatgaactccaatcctttgtagattgcttcgtgggttatcaccagatctggatggatgaagaagacgcagagaaaacaaccttcattatactgtggggagtgtactgatacaaaatgatgtcattcggtctaaacaatgctggggctacctacatgagagccatgacaaccatattccatgatatgatacataaggaaatagaggtgtatgttaacgatgtcatcatcaaatccaagagggccgcagatcacatagtagacttgagaatgttctttgacaggataaggaggtataatataaaactgaaccccgcaaaatgtgcattcggggttcccgcaggaaagctgttgggattcattgtcaaccgtcgaagaatcgagttggacctgtccaaagttaaggctatccaagagttaccaccaccaaagagcaaaaaggatataatgaacttcctgggatgcctcaactacataagtcgcttcatagcatagtctacagtaatatgtgaacccatcttcaaatgttgaggaaagatgctgaaaccagttggaccgaggattgtcagaaggctttcgacaaaatcaacgaatacctgtatacaccaccagtccaagtcccgctagaacctgggagacctttgctactctatctatccatattagatggggctttcggatatgttttgggaaaacatgacgagacgagaagaaaggagcaagccatatattacttgagtaagaagttcacagcttacgaagcacggtattctctgctagaacgcacttgttgtgctttgacatgggcaactcataaattgaggcattacttatgtgcctataccacatacctcatatccaggatagaccctctgaagtacatctttcataagttcatgccaaccgggaagttatctaagtggcagatattgttaagtgagttcgatatcatctatgtaacttagaaggcggtcaaaggacaagcattggcagaccatcttgctgaaaatcctgtgggaggagaatgcaaaccactaaaaatgtattttcttgatgaagaagtatcattcgtaggagaggacattgttgaagcctatgacggatggagaatgttcttcgacggagctacaaacttcaaaggagtgggcattagagcagttttggtatcaaaaataggtcaacattacccattatccacaaagcttaggtttacgtgcaccaacaatatggcagaatatgaggcttgcatcataaggctcaattggccatcgatatgaatatacaagagttgttggtaattggtgttcagatcttcttgtaccttaggtttaaggagaatgggctacgaaaaataccaagatactaccatacttgtatcatgtgcaggaattgatgaagaggttcacaaagatagaattcaatcatgtgcctagaatacaaaatgaatttgtagacgcactagccactttgtcatcaatgatacaacatctagataagaatttcatcgatcccatcctggtgaggatccataatcaaccagcttactatgctcatgttgaagaagaaacggatggaaaaccttggttccatgacatcaaagaatatttggcaaaaggagaatactcggaacaggaaaaccattctcagaaatgcacattgcggaggctgtccaatcacttcttccaaagcgtagggaccatgtatagaagaacttctgatctggggttgttaaggcgtgttgacgcaaatgaggcttctagattacttgaggagatacatgtcggaacttgtagaccacatatgaacggttttgttctagacaaaaagatactcagagctggatatttttggatgaccatggaaacagattgcatcaggtatgtccaaaaatgccaccaatgccaggtacatgcaaaaatgataaaggtaccaccaaatgagcttaatacaacaagtgcaccttggccttttgctgcctggggaatggatgtcatcggtccaatagagcccaccgcttctaacgggcaccggttcattttaatggctattgactatttcacaaaatgggtaaaggctgcatcttacaaagttgtaaccaagaaagtcgtcgtagattttgtcaaggatggtaatatttatcgattcgaggttcccgagtccattatcattgataatgctgccaatctcaacagtgatatgatgaaagccatctgtgaaaccttcaaaatcaagtacaagaactctacaacatacatgtctaaaatgaatggagttgtggaagctgccaataagaatatcaagaagatactgaggaagatggtagaaaatcacaaacaatggaacgagaagttgccatttgccctattagggtaccgcactacggtccgcacatcaactagggcaactccctatttactggtttatggtactgaagctgtcatttcagccgaggtagaaattccttctttaaagatcatacaagaagccgaactcagtgatgtagaatggataagaagccgctatgagcaactagccctcatagacggaaaaagaatgaatgcagtatgtcacggttaactttatcagaatagaatgtcctgagctttcaacaaaagggtcagaccaagacaattcgcaccggggcaactggtgctgaagcgaatcttccctcatcaggatgaagccaaagggaagttttcacccaactgttagggtccctacatggttcaccgggtgctaataggtggagcactcatacttgcagaaatggacggagaattttggccaaaacctatcaattcagacgcagtcaagagatactatataagactgtttacattccttcatttgatgtaactgaactacgcttgaccttgtcacacctcctttttaccacccccggaaggggtataggggagtttttccaatttaagtgacaatcaaaatgtgattatttaattaaaagagtcgccacttgggataatttatggtgtccaaattcaccggttgagaatcccgaatcgaggaaaattagactctattttatagtctgcgaacatagaaatctgggttaggaattctgttaacccgggagaaggtgttaggcattcccgggttttgtggttctagcacggtcgctcaactattattattggcctatttatctgattttaaaacacttttaaacctatgtgcattttaaactttatcaccgcttttaattatttaaagagttaattcaaggttatttaaaacacatcgcaagtcatgctacatgaaatgcacccgtgattcacaacatgttctatttaaccttgttggagattagagtcgggtcacatgaaatgtacacccgggttttaatagaagccacgataattatataattaacgcgcctaaagtaaactacgaagttcattattaatatctaagttataaaattagtatgaggaccataggtgatttaattagtatggcacacctcactctaagaataactggttcaactaggagattgtaaggctcttgactaatctaactcaagatttatctaactcaaaatttagtctaaagccttaattactgacatgtaacgaggtaattaaatgacctctgattacttaaaggaaatggaaccaactgcaggccatctgataaatcaacgaaaccccttgggctgaatctacagttgagcctagtattcagagcaaagggccaaagtccctcaacgatgaaattgggccaataacaggccccaaaagtaccttgaacgccacatttacaagtcttctctttaaacataaaacgcaaagggagaagggtggagctgaagactcttgggcctaaaattgtgcccaaatcaaaagaaaactttatctcgacggtttgggctccaaaattgagcccaccatgcagacgactgtcaaggatcacacttagagtgatcttgaccaaaaccattcattttggcctattcctgacccaattagttaatgacacacactgatattctgtatatacgtacagcaaaatacatacgtttgaaagctacaattaactatcaatgattgaacatccctaaccaattacacagaacaaataaacaaaagaaaataaatttatacaatctttaatcgtaataactaagtaatttgactacatcattgaaagaaagctccataaatcgttccatcctttgctaaggcaacatacttcctccttgtgattcaaaacattgttgagatttgcaaaactagctataaagctagcctgcaaatctgcatctgatcccttaatgcaacaggccaacgaaaacaaagttagtaccattatcacccttcattggtgtcaacacacaaggacatgcttaaccaaaatatccagattccctttatactacttcccaggttccgttagttgatttgccaaagaaaaacaaacataaaatgagaaaacaagtttcagctttcacatggatccttgtagactattttaagcatgatgactaccacattatcatacaaagcttgaaggcaaattttagattcaaacatatagtaagaagagaggtcatagttgattatcaacacatataacaagaatcacaccgagtttcagacaaagatgtgaatcagattcatactagtttaccattattcacataaaatacaatcgttgcataatcattccatttaataaaagagaaaaattgtgacgacccggccggtcgttttaagaatttgtgccccgatcccccattaactgttttccccaagtttatttctgctactttgatttgcagggatgttcggttttaagttttggagagttttgggacacttaattcctaaatgagaccttaagtgttggaaagttgaccatagtcggaacagtgtaaagacaacctcagaatggaaattcgatggttttgttagctccgttgggtaatttcgggcttaggggcatgttcggattgtgttttggaggtctgtagctaatttaggcttgaaatgccgaaaggtcgaattttgaagtttccggttcgatagtgagattttgatccgagggtcagaatagaattccggaagttggagtagcttcgcagtgttgaatgtggcgtgtgtgcaaagttttatgtcattcggacgaggtttgatagactttttgatcgaaagcgtatttttagagtttttggaattctaaggcttgaatctaataaaaaaaaataggtgtttcgatgttgttttgagcattctaaaggttggaaaaagtttgaatgaagttatgggatatgttggtaggtttggtcgaggtcccgagggcctcggaatgatttcggatggttgacggaaggattttgggactttggagttgcagcttcagttgttcttctgtcataaccgcacctgtgagtgagggaccgcatgtgcggatctgcagaagcagcggatctaccgtagaagtggaaatagaggaaaggcagcagggacagcagaagcggggtcttcaccgcagaagcggccccgcatctgcgaaaggatagccgcatatgctgaaagctgggccttaagtgaaaagtagcaaatgcgaccattattccgcaaatgtgggaccgcagatatgaaaacacctgggcaaaaatatgaaatttcgagggtttagtttcaaaagttggaaattcgatttggagctcgggagagggcgattttgagaggaaattgaagaggagatcattgggtaatgattctttaaccctttctagttatactacatcaatctatagttagtttcatcatttaatttcgtattggagatgaaaattggggaaaagttggaagaaagttcttaaacctagaattcgacttttgattgggaatttgaccttagatttggataattttggtatgcatgaactcgggagagtgtgaggattctaaaaatataaatgttacccgattccgagatgtgggcccaaggggtattttggtcattttacctaatttcgcgtagtagcttagaatttctttgtagaattagttacttgaagtcttatttatgttatgaaattgaattgaatagatttggaccatttggagtcgagtactcgtgataagagcatggtttcggattgattattgagccggtttgaggtaaatggcttgtctaaccttgtttggggaaccttccccttaggatttggtatatttggtaattgaaatgccttgtatgtgaggtgacgagtgcgtacttgtgctaattgttggaaatccggttttcattaagtaattactagtatgtttcctttcctattttaattacttgcactattaagcctgttgttagcttaggaaagcatgtctaagtgacttaattgctttacttgctcaaaccgccttacctaaattctgtgtagcatgctaggctagaattacttatttgtcttaatatgaaatttgccatttctaaatattttcctgtagctgctgtgtatttacattaggactacggatgtgggattctggtagatcccccttgtctgtttattttgggactacagatgtgggattccgataaatccccctgcatagttatatggaactacgggaatgcacctggtagattcccccagtactgggtatttacatttgggactacggaacgggattccagtagatccttgtgcactatgagttggactatgggacgggatcccgggagatccattggatatgtatatttgggactacatgacggtatcctgggagatccccgattgttattttggtactggaccgtatttctttctgtgtttaccttgtctctgtaatagttgttgttgccctttatatcttgtgttacttttattgctgtacttatttatattgttctgttctacactgtttaactttatattatttaacctcagtagggccctgaccttcctcgtcacttcccgaccgaggttaggcttagcacttactgagtaccgttatggtgtactcatgccctttctgtgcatgtttttcatgtgcagatccaggtaccttgactcggtcttattacccttgaggcgaggcgactgttccagagacttcgaagtatatctgccgcatccgcagaccgaggagtctctttctactctccttattgtattagcccttctgtatttcctttttcttgttagatattctgaagttagacactagtagacgttccaaggcttttggattcatgggtttttgggttttgggaaaatgtattagttttgaggatttatattgtgtatgccgagcgacacgtttaaacgctgttatatcactctatttctgttttaaattattttcttccgcaaattggtttatcttcagcattttaagcttacctagtcgtagagactaggtgtcgtcacgatggttcacggagggcgaaccggggtcatgacaagttggtatcagagctctagattcataggagtcatggatcacaagccagtttattagagtctcgctgatagatacggagatgtctgtacttatctacgagacactatgtaactattaggaaaattccacttcatttgatttccttgtcatgcgatattttgacatcacaattctaaacttttgtcttctattatcttacaaatggtgaggacacgtgctacttgagatgcttaggcacatgcgcccctactgcagtcgtcaaaggacggggcctggatagaggccaaggacgtgcacgtggtgcagccagagcacctacgtgagctgccgccgaggtaccacaagcagttctagctgaagtccaggcacttaacatgcctactgctactactactccagctcttcaagagactctggcacagttcatgagcatgtacaccactctggctcaggcaggattgcttccccttgctgcagctacatctcaggccgggggaggagcacaaactcccgccgctcgcactcctgagtagcgagtgcatgttgagcaagtccttgagattattcatgtactgcctgcagtgccagttcatcctgagggcaaagcagcaacttccgaggaggaacaattgaggcttgagaggttcaagaggtacaagcctcctatattcagcggtctagcatcggaggatgctctaggatttctagatgagagttatcgcattctgcgtaccatgggtatatcggtatcgagcggggtttccttcactaccatctagcttcgaggagccgcctatgagtggtggcaaacctatgagttagacagtccaaatgaggctgcttcgctgacttggacttagttctcagatatgttcctgaaagagtatgttcctcagagcctcaggaacacatggcgcgcagagtttgagcatttgcactagagtactataactgtctcagagtatgttgtctgtttcaccagtttggctaggcatgcaccggccttggtttctactgttcgtgagagggttcgccagtttattgagggccttattcccagcatcaggtctagcatggctcgtgagttggagatggatatttcttataagcaggtggtgagcattactaggaggattgagagtatgcatgctagggaggtagaggagagggaggccaagaggtctcgagagttgggccatttctctagtgttcgtgccccaacagccagttgttatggtaggggttatatgagtcgccctattcattcagctcttctatcagccagtggcatttcagctccttcaagacctcaggagccttattatgcaccaccggtatctagcgcgccttctatgcgaggtgctttcagaggtcagtcgagcagacctggcccgagccagtcatagccaccacgtcctcctagagattattttgagtgttgtgacacatgccatatggtgagggatttacctagacttgggaggggtgcacctccatagacttctcagccacagcgtgccccgcagagttctcaggccatggttacagctatagttgctaccccacctgctcagccaactagaggtagaggtcggagaggtagaggtcgccctaaaggaggaggccaggccagatacaatgcccttcctgcccgtaccgaggttgttgcctccgattctgtcatcacatgtattatactgctttgtcacagagatgcatcggttctattcgatccaggctccacttattcttatatgtcttcttatttttctctacatttgggtgtatcttgggattctttaagttcccctatttatgtttctactcttgtgggcgattctcttgttgtggaccgcatttatcggttgtgtttggttgctcttagtggttttgataccagagccgatttattgctgctcagcatggtggattttgacattatcttaggcatggactggttgtcgccccattatgctatccttgattgtcacgccaaaaccatgatgctggctatgtcaggtgtaccgtgttgagtggaggggtactttagatcacactcccagtagagttgtttcttttcttaaagctcagcggatgattgagaaggggtgtgatgcatatttagcttatgtgagagatgtcagtattgataccccttcagttgattcagttccagaagtataggattttcccgatgtgtttctagctgaccttttgggcatgctgcctgatagagatattgattttggcattgatctattgtcgggcactcagcccatatctattcctccgtatcggatggctcctcctgagttgaaggagttgaaggatcagttacaggaatttcttaacaatggttttattcagcccaatgtatcaccttgggtgctcctgtcttgtttgtgaagaaaaaaatggttctatgtgtattgattatcgccagttgaacaaggttacagtgaagaaccgttattctttgcctcgtattgataatctgtttgaccagcttcagggcacacgggtgttttctaagattgatttgcgctcgggttaccatcagttgaagattcgggagctagacatctcgaaggctactttcaggactcggtatggtcattacgagttcctagttatgtcatttgggttgatcaatgccccagcagcctttatgcatttgatgcacagtgtgttctggccgtatcttgactctttcgtcattatctttattgatgatattctggtgtattcctggagtcgggaagatcatgagcagcacctcaggactatgcttcagactttgagagagaagaagttatatgctaagttctcgaaatatgagttttggttggatttagtagcattcttaggccacgtggtaacgagtgagggtattcaggtggatctgaagaaaatagaggccgtgcagagttggcccagaccatcctcagctacagagattagcagtttccttggcatgacgggttactacggtcgttttgttgagggattttcatcgattgcagcccctatgactagactaacccagaagggtgctctgttccagtggacgaaggagtgtgaggcgagctttcagaagctcaagagagctttgaccacagccccaattttgataatgcctacaggtttggggtcttatacggtctattgtgatgcctcgaggattggcctcgaagcggtgttgatgtaggacggtagggtgattgcctatgcgtccagacagttgaagatacaggagaagaattaccctatccacgaccttgagttagctgccattgttcaagccctgaagatcttgaaccattatttatacggggttccctgtgagatttatactgaccatcggagcttgcagcacctgttcaagcaaaaggatctaaatttgcgctggaggagatggttagagttgctgaaggattatgatatcaccattttatatcacccgagcaaggccaatgtggtggccgatgccttgagtcgtcgggcagcgagtttggggagtttggcttatttaccagcatcagagagacctatggcaatggatgttcaggccctagccaaccagtttatgagattggatcttttggagcctagtcaagttctagcttgcgtggtttctcggtcttccttatttgatcgtatcaaaaagctgcagtatgatgaccctcatttgcttgtccttaaggacaaggttcagcatggtgatgccaaagatgtgactattgttgacgatggggtataaaggatgcagggtcggatttgtgtacccaatgtttatgggcttcgggagttgattctggaggaggctcatagctcgcggtattccattcatccgggtgccgagaagatgtatcaggatttgaggcagcactactagtggaggcggatgaagaaagatatagttggatttgtagcttggtgccttaactattagcaggtgaagtatgagcaccagagaccgggtgggttgcttcagtagatagagattccggagtggaagtgggagcggatcaccatggactttgtagttgggctcccatggactttgagaaagttcgatgctatttgggtgattgtggatcgactgaacaagtccgctcacttcatccctgtgtgtactacttattcttcagatcagttggtggagatctatatccggaagattgttcatctgcatggtattccagtttccatcatttcagatagagatactcagttcacatcacgattctagagagtcattcagcatgagttgggtactagagtggagttgagtacatcatttcaccctcagacggacggacagtccaagcgcattattcagattcttgaggaaatgctccgtgcgtgtgtgattgagttcggagtgtcttgggatcagtttttgccattggcggagttttcttacaataatagctatcaatccagcattcaaatagcaccgtatgaggctttatatggtaggcggtgtagataccggtgggttggtttgagctgggtgaggctagactattgggcacagacttggtttaggatgctttggagaaggtcaaggtgaatcaggatagacttcgtacagcctagtccagacagaagagttacgcggatcggaaggtttgtgacatttcctacatggttggataacgggttctgcttcgggtttcgcctatgaagggcgttatgagatttgtgaagaaagggaagttgagtctgaggtttattggccctttgagatattgaggcgtgttggagaggttgcttatgagcttgccttacctcccagcttggcaggagttcatccggtatttcatgtttcgatactccggaggtatcacggtgacccgtcacacgtgttggatttcagtttagtccagttggacaaggatctatcttatgttgaggagctagtgtcaatattggacaggcaggttagaaagctgaggtcaaagaatattgcatcgataaaggtgcaatggcggggttaatcggtcgagaaggcgacctgggagaccgagcaggatatgtgcagccattaccctcatcttttcactacttcacgtatgtctctatgctttgaggacaaacgaatgtttaagtgtaggaggatatgacgacccggccgatcgttttaagaatttacgccctgatcccctattaactgctttccccaagtttatttctgctattttgatttgtcgagatattagattttgagttttggagagttttgggacacttagtccctaaatgatagcttaagtattggaaagttgaccgtagtcggaacagtgaagacggccaaggaatggaaatctgatggttccgttaacttcgttgggtgatttcaggcttaggggcgtgttcgggttgtgttttggaggtccatagctaatttaggcttgaaatgcttaaaggtcgaattttgaagtttctggttcgatagtgagattttgatctgagggtcaaaatggaatcccggaagttggagtagcagtgttgcatatggagtgtgtgcaaaatttcaggtcattcggacaaagtttgatagactttttgatcgaaagcgtatttttagagtttttggaattcttaggcttgaatccgataaaaaataggtgtttcgatgttgttctgagcattatgaaggttgaaacaagtttgaatgaagttatgggatatgttggtaggtttggtcccgggggcctcagaattattttggatgattggcggaaggattttgggactttggagttgtagcttcagtttttcttctatcataaccgcacctatgagtgtgggaccacaagtgcggagccacagaagcggaaaaggaggaaaggcagcagggaccgtagaagcggggtcttcaccgcagaagtggccccgtatctgcgaaaggatagctgcagatgcggaaagctgggccttaagtgaaaaatcacaaatgcgaacattgttctacaaatgcgtgaccgcagaagcggtcccaggaccgcagatgcagaaacagctaggcggaaatataaaatttcaagggtttagtttcaaaagttgaaaattcgatttggagttcgggagagggcgattttgagaggaaattgaagaggagatcattaggtaacgattctttaaccctttctagttatacaccatcaatctatagttagtttcatcatttaatatcggattggagatgaaaattggggaaaagttggaagaaagttcttagacctagaattcgacttctgattgggaatttgaccttatatttggataattttggtatgcatgaacttgggacaatgtgaggattctgaaaatataaattttacccgatttcgcgatgtgggcccgaggggtgttttggtcattttacctaatttcgcgtagtagcttagaatttctttgtagaatcagttacttgaagtgttatttatgttatgaaattgaattgaatagatttgggtcatttggagtcgagtactcatggcaatagcgtggtttcagattgattattgagccggttcgaggtaagtgacttgtttaaccttgtgtgggggaccttcccttaggatttggtatatttggtaattgaaatgccttatacgtgaggtaacgagtgcgtacttgtgctaattgttggaaatcatattttcattaagtaattactagtatgtttcctttcctgtttttattacttgtactattaagcctgttgttagcttacgaaagcatgtctaagtgacttaattgctttacttgctcaaactgccttacctgaattctatacagcatgctaggctagaattacttgtttgccttaatatgaaatttgccatttttgaatattttcctattgttgttgtgtatttacattgggactacggatgtgggattctggtagctcccccttgtctgtttcttttgggactactgatgtgagattctggtagatccccctgcacagttatatggaactacgggaatgcacctggtagattccctagtactaggtatttacatttgggactacggaacggtccgatagatccccatgcactatgagttggactacgggacgggatcccgagagatccattggatatgtatatttgggactacaggatggtatcctgggagatccccgattgttattttggtgttgaaccgtatttctttttgtgtttaccttgtctttgtaatagttgttgttgccctttatatcttgtgttacttttattgttgtacttatttatattgttctgttctacactattgaactttatattttatttaacctcagtagggccatgaccttcctcgtcactatccgaccgaggttaggcttcgcacttactaagtatagttgtggtgcactcatgccctttatgcgcatgtttttcatgtgcagatccaggtaccttgactcagtcctatcacccttgaggcgaggtgactgttccagagacttcgaggtatatatgccgcgtccgcagaccaaggaatccctttctactctccctattgtattagcccttctgtatttccttttccttgttagatattctggagttagacactggtagacattccaaggtttgtggattcataggttttcgggttttggaaaaatgtaatagttttgaggatttatattgtgtatgccgagcggcacttttaaatgttgttatattactctatttctgttttaaattattttcttccgcaaattggtttatcttcctcattttagtcttacctagtcgtagagactaggtgctgtcacgatggttcacggagggcgaattagggtcgtgaaaagtactattgtacaagaaaggaactggaaagagtaacttgaaggagtaaaaacagaaaaagagtaatagccaagcaataggaagaaaaacccagcaacactaactcagcagcaacaaggatcagtgatgaaataaccccagcaaaccagaaatcctttgaattttttttttgttcttccaagagtaatcccaaccaattttgagccaaatgatgcagaaacttgtcagtattttttagggtatgaatgtttgatttttgagtgaaagaagggtctatatatagccctttttgggagccatgtgctgcaaaaatagaatggaaattattccctcacacaagcattttttttaacagaatgggacaactgtcaacctctaattggtttcagcaatttgtgttggccaaatagggccagctgcccctattttagaacactctaacatgaattttatccaatttcagaattatttgccctcttttatgaccttcttaactttctttttgttcaattaggtccctataagttgctactgatttgcaaatcagggtaaacaacaaatgggcatactaatgtaaatcaaataaccaaatttaacaatgatagaacttttaaatttctggacacctaaacaaacctagaatgagctaatttcaataatgaacaagtagcaacctaattctaatccaaccacaacaaaatgtgataccaaacaaatcgaatttaagaggtgaacagtgaagcatgactgatattgagcattcaacaatctgactcctaaaaccctacatctaaaaccatacaattaaaatgaagaggaaattgacagaaaggcatgacaaactagaaaaacagaattcatgatgacctaacctgaacaaactaagaaattatcataaacatgaataacgcctaatttaattcaaacaatctgaataataccaactaattggagaaaataaatagcctaaacaaatttagatgaacagatgttttaaaaattgaaaaagaaaatcagaaaacagaccaaaaataaaaactaaagagaagaaatgaggtactggctaagcactagaatattctatcagtccagagattatggctaccctaattccttcattatttttttcggccaggagaaaaggaacataaagaaacagattagagaaaagtggaagcaaaataggagtagaaatcacagaaatagatagaggaaaaaacaaaagaaatacctagcaattgacttaaagaattctggctgctccgattttaagcccaaaattaatgttaatcgcatgttctttgttaagaaaaacaaccaacatcaatttcacgctaaatcatccttggaacttgaaggcttggggcttaaccttgcatgccacaaatgcgaagtcgggtagatttggtcgagcttttgaggaaactattgaggggtttgggtttatgggtgtgtgaagactatatggtgcgattttgggtggatttggagactttagggttttgggtgttgattttagatctaaaatccgagccgtttgggagggattcgagggacatagattagggatttgggaagaggaagcaatgggggttctggagtgttagtttggagcggattggagacgtttatggcgtcttcgctggcggagacggtgggggattttggggtttttagggcggcggctagggttccaagtctctgaacttgagagacggggaatgagggggagtggaatgggggggggtgcttgggttcggacagttaaatacacaaggtgaccctagttccggtccgttggatcattgaaatccaacgctgagatgatgaagctcgaaacggggtcgtttggttgagacaagggagctggaccgggtttaggggaattgggcttggatttggaacggatggaggggagatttgggctccaccaaagcttagcccaattgaatcagcctttgcaattaacccatttgttttctattcttttaattcctttctttttatttgtcttttcttttcttttctttttttaaaaaactaccaaaattaaattcctaaattaatctaaaatacaaaattaagctaattatctgttataaaaattataaaaatcacttaattctaaattaaagagaaaaatcaataacctaaagatttaaaggtaaaaatgagctatttttgtgattttcaatttttataaaactagtctctatgcacatgcatcgcaagtgtactccatatcattttcttttacaagatgcatatcaaagaatagttagaaattgttaatatgcatatatataggaaaaatgcataaataccccctaacctatatcctgattctcaactacacgctttatctttgcgagaatcttattattcctctaaattattttaaagtagaattatttgcatccttaaagctggcgtggaagagtgtgtgtatgggagagtgagaagcaagaaaaaacgagtttcagatttttctttttgcttttttaccactttttttccttttccttttccttttccttttccttttcatttttcttttactttttttcctttcttctctaattccggcggatattcatttaccgacgactttatcttactgcttttcttctatttattctgtttttatttttttctctttctatacttttcacacacaaattaaactctcaaaaagatctatccataatcaaagcaaattaaaatatagattgggataaaaatatgtcgccgggaaaaaaaattcaccttaaaaaatggtgttcttgaaattccgacgaccaccattttatgccgccggtagccaaaacaaaaaaaagagaatgaaataaccaaaaagatgagaataataagaaataagaaaaaaaggataagaaaaagaagaaagaataaaaaatactaaaaatacatgtggcagcacgtgtatttcaccacttgccaagagtttggttgtctagttttaggatggtatttattccatttaaaaataatttaggggtaataggatttctataaagataaagtgtgtaattgggaatccgagtataggtgtgtgtgtgtatatatatatatatatatatatatatatatatatatatatatatatatatatatatatatatatatatatatatatatatatatatatcacggaaaaatatttgattgggtaataaattagaaatttaaatataccaaaacctagcgtgtccttgagaactttttacgaataaagccgaaaggcatattctctatccaaatcaatctttgttgttttattatgacactattaattaaaattcgttatatactaaatccggatttgcgacggaaaattctacattgggggtaaagcgctccctaataaaggcgactttatattcagggactcaaacccgagacttctggttaaggatgaaggagtacttaccactccaccacaacccttgttggtccctttttcctatttcaatatacatgtcatgcacaatgtttttttgtttcctcgtatacagctgtttatttaaacactgataataagtgttagagttcaaatctcattattggatatgaatgattaaattgcatattaagtcccttttttaatctactgaaaattaggtaatcgggtataataaaattaaagaaaatatccaaatatgccatgtaatattagaaattgctcatttttatatttttaataaattccttgagttagatatatcatcgtggaatatgaagggtttaaatgcataatgtgtcctcttttatacttactgaaattactgaaaactaggtaatcaagtgagattaaattacaggagaaagtccaaaaatggccttgttaatcataattgaaccaaataatgacactccaaaaagtagtagcaaaaagtgataataaaacaaaagaaatgaaatacagaaaaaagtaaaatataattataaaggggcacctctattacatgagctcactatacacccaaaatacctggactaaatactctaacattgctttaagaaaaatggccatacaaatgaagtccaatcttcataaaatctatgctatgatttttcaaacaagactacaatatttattcacctctgcagagtgcagaaagttaattccttggcccaatctcccaacaggctttagaaagcatacacatatgcatttattactttttatttgtaaaagaaaggaaggatatttcgattagataatctattgatgtatggatcagaaagcaggggtagggcaggggtaactggaaatattacaaactattacgatacaataagtcctccgttttgtggctttaatagaatccgtttgccaagagattggaacttaagaaatcatttacagttggagataacctttctttcttcctctcacttatttataagcgtgtaacagctatttcacgtgtaacacttatttcatgaaaatcttcaagtgtgttcgagcaacagttagggctcgtttggtacgagggataaagaataattaatctcggaactaaatttaaaaagagtttatctcatatttggttagtagaaaatttctgtataattaatcccgtaattaattattctgggattgtagtatttttttatcctcataaaaaagtgaaataactaattacgggataactaatcccgtaataattaatactgggacaacttctttctaaccaaaagaacccttattctattaacatgccataatacccttctcctggatatagtaatagtaaaagagtgcagattgcaacagatcgtttcacgtgtatgagttagttattattcaatagtaaagataacttttaaaacacaatagcacttgtttagctatcaaatttcagagtaaaaggtaaacaaactaatcaaaatttcttttttgacactctgaatagttaattttaaaaaaataacgaaaaagagacatccaactcgaaacagaacggagaaagtaacttaaactttctttcaaatagaagggggaaaaatgcaagcaatagaaaatagaggatgtaaaatttacctgtttgcaacgccacaaacgacagtgacgccggcagcctaattgaaccgaacactgacacttcaaaaagtagcaaaaactggaaattcactgccaatatatttgttgctggaatgaaaattctctttttgaaatatttttaagggtaattaaaagccttaaataacaataactgttaataaagatcaaagaaagtcgaaaaggggatcatagccgttgtgaaacactaactctgatgcaaattgcagatatttattccaaatagaatatttcgtcctttttttatattttattttggggaggggattaattttctcctaatgattttgtaaataagtgaaaatttgcttttagatcaatctgtagatgttacatcctttcatgagatgatccttataagtaactttccggaaggaacacaccccttcatatggatgagtacagaagcgtggtaatcagattcttagtgacggttcaaataaggggtattataggggttttcttattaaaaaataaatttattaagaaaagggtaattttataatttaactttctactgaagagcttcctctttttaatagattatagaaaagtaattactgattaatcctaaaaatgtaaaaataaaacctaaatgcaatgcatggtatttttggtatttttcatgatttaaataaaacttaaacatgcatagaaatgcaaacaattagcacaaatttccacaaaatcctataaaattgcaaaaatggaaaaaatgcttttcttatattttctgggagaattcctatagggcaaaaatcacgtgctcacagacctaattctcgtttaagaggggatacataggcagccttgtgggttcggttacatcttaataaaatcttcatttccccagaaccagaaactgagccagaattttaaggagggccctcaacattccggaataagtccagcccgatgccatcatatgcaagacagttagaaatcggttaagtaactggggaagaattttgaaaaggattctcaaaattctggagcagatccaacaaacttcgttgcacgcagaacggttgaaggatcaaactggggcagaattttgaggaggaccctcaaaattctagtgcaaggaagccgcaatgtctctaaaagtgttacagtcattagttcatctaattcacttgatattatataccattatgtttctaaataactctatttcatcaataagtgcatattttcgaaaactttatttctatggccgccaggtgttactcagggtaactcgaacaaggcctccagaacagagcaaaacaaagcaagcagacaaaggcacgaaccaatctttcccccaaaactcgcgatttttctttgggtgcaggcacagtgaacataacaggagtactcgcaaatatacacatatcaaaatcactatcctcataaatcggaccgacgagcgcaaatatatctccagctaagaaatattttgttcttatttgctatttgtctattgcataaggctaagcattgtcttctctttgcatgagactaagccctgtctcaaatcttgcatgaggctaagccatgcctccatatttacataaggctaagcactgccttctctttgcatgagactaagccctgtctcgaatcttgcatgaggctaagccctgcctccatatttgcataaggctaaacattgccttatctttgcatgcgattaagccatgtctcaaatcttgcatgaggctaagccctgcctccatatttgcataaggctaagcattgccttctcttttcatgagactaagccctgcctcaaatcttgcatgaggctaagctctgcctttatatttgcataaggctaagcattgccttctctttgcatgagactaagccctatctcaaatcttgcatgaggataagacttgcctccatatttgcataaggctaagtattgccttctctttgcatgagactaagcatcgtctccctttcttgcatgaggctaaatcctgcctccccaattgcacaaggctaagctccgtttttccctgtctaatgttgaatgttacactatctgaaacctagcgctactttgccttttccgggactaagctctgtcccgattctacacaagactaatctctgtcttgtttacttatatgatccatcatcatggctttatccgaaggcgtcagtccgaaggcatcatccttatagcctgaagacaccatgtcatggcctaaagatctctcaatactgcacatcattattcaaaggcgtcatggttcagaggcaccattttcatggcccgagaacatcatttcttggcatgtgaatcccttatctcatgattcatggcccatgaagtcatggtctaaggacgccatcttcaatatccaaagacaacctttcatggtccaaagggaatttatatcatgtttaaattctcgcagtaatctatatacttgcatgcattgtgttttaagttttacagaaaatccaggaggtaaccgttcttcaaacaggagcaaccttctctctggtttccgctcataccatttacactttgccattatttcaaatataaccgattcccatcaattgctcgccttcactccatgaccattcagatacctgccttatgatagatcagttacgattcagatttgccttcataactccgcacaaacctatccgatactacccttctcaaaagaacctttttcgaaacatacttccattcctatagaaattccatcggtttcattcaccattgggtctagaactacacattgtaaaaccaggaatatgtaggcagataagagactagggttcggcctatgtttttcaaaacacccccattcagtcaaactcggtcatcatttctttgtccgataactctttcatccttccgagataaagaggggcagttgttgatacccaattttttctcatatatttttaatatgcatatatattttcaaaaatagtgcacatgcatttacaaacatgcacaagtgtttctataattttttctataattttaaatgctttcaaccactttatttctgcagttttactatacaaatttccaataattatccctcatattattttttatgatgatttaatcatctaccttcatcatttatgtccaaatagtgcttaaatattttaatggcattttttataattacatttgcatttttcaagctagaattgcatattttgcaataatagcccatgcatatgcataattatattatctatacagaaaatgactttttgtattttataatgtcaagtaattattttaaatcattttcatgtacaaataatatttttactatttactaaattatttactgatttaattgggtatttaagatctatcccttttttaattaatttcggacctagcccaattgtatataccagcccaaaacccaattacccctacccaattaaaccacccgacctggaaaccccttaaatcaggaccgttgatctttaagatcaacggtccacaccaccctagcctcttttagcttaacaaacccaaccctaatccctcataaccccaaacccgcagcccttgaatgctctcaatctcccctctttcactctcaaaccctaagcggcgtcaccccaaatctccaccaaatcccctttgattccaaccatatatggaatcatctggtgatttcttaccttattcggttctctttctctactagctaatcgattatggtgttacataatctcttgcctaacatggcaagtggatctctcttgttttgaaccaagtttggttcgaatatttatctctttccatctatgttctttctccgcctccttatggtttgaatctctaagattttttgcttattccttattttaccctaaaagctagggtttatctcctttgaaatctgctaagatttggtacttattttcattaaaaatcatatctatgtttccacatgactatctgtgaatcttttcatgatttcgttaaaaggttttctgcctcattttatttaccctaaaattagggcccagatcttttcagatctgtcaaggttccttaattttgagtatctttcctttaatatttttgtgtatctatgtgtatccatgttattcctatagttgtttctttaaaataatttattcttcctaaaattagggtttcagatcttctctagttcgattccttgtgcttttcgaataaacctcttctctatgttcattatacatagtgtgattatttttcccttgtttctctgctgactttatggtttacccaaaattagggttttgaaaccctttattgagatattaatctttccttttctgtgcgatactactactttcttattttgttcgatttacatgttcttaccttatttggaccaatgtctgattaataatttatgctacttcactttgacttgccttactggcctgattttatgttctggttattaaaattgacttctaattaattttggaattattccttaccttatttgactactgattaagtcagttaactgatgtcagcctgattttatgtctattaattgatttatgccgaccttaactgattgttaattgatttttcataccttatttgcgtgtgattggttcattaccttatgtgttctactctattgtatgatataaaacccttcattattctgattttcaaacacgctcagacatacaagctcacacctacacttatacacttacactcacacaacttgagttctttctatcactctgatttgctgcattgtctagtcggctgaaagacaaggctagactcttggattcctattgccttcaccttcctatttactttctccctaactggtacgtcttaattcctgttatcttgttctattctataggcttatgtagtcagttttatcacagccctcaacatgcttctgtttgatacacgattcctgactacctctttctcaactgttatgccttagttcttgttgtcttgttctgttccatgtgattatatgattagtttacttcaaacttcaatatgcttatgtttgtcatatgtttcctgtttgcattcttcctgactagtatgccttaattcctgttaacctactctgttctatgtgattgtgtggttagtttaccttagcatgtctggccattgatttctatttacatctttttagactagtatgctttagttcctgctatcatgtgctatgtgtttgcttggttagttatttcaaacttcagcatacttttgttcaatatacgcctatatggtcccacctagtaataattaataaactaagtaatctttagtaatgtgaaaccttgatggattcagttgtatgctccttattcagaacaggtttaggtattgccaatatgtgtggtcagactgtctgtaattcaagtatttttgtccttgttgtgattgctttaattctagtatatcatccatgtctgaactaataccaatctactaaagatggactatgttctgttagtagtcttgtaatttgaacctatttgttcataaaaaacaaattgttttctaaaactgtcccctaccccttacatatactatttttcaaacttctactcttagctatctaggttcctaccacctccagtgtaagcactgccttgggtccttgagactcctttgaactctgacacattggagctggtttccaatctcttatgaattctgagttgaatgtgtggatccagtgtgagcattgcccggggtccttgaggctctttgggaattttgacacactggaagcctggcttaaggtgttgtggatccctgctactgtttcaagactgttgtgctgaaggcctggttctctggtttatattgggcctgctaaggcttcctatagtgtaatagatactgttatatagtttattcattttgggctgtaataatttctataataaacagatttggggtttgttagtaaaagctggggggtttattttatatctttgcttgaaattcgggtagaaatcctgcctataggtttattggtgattatgtgagcattactacttgcttagagatcatgtctataggactttctcattgctttgttctgtacttcactcgcatgctagaaatcatgttcatagattctttgcattagaaatcctatacataggatccatgcacatttttagatgcattagtagccatgtctataggatcctatctgttttattaataattttcctggcaatgtatttaaagaattctgcccacacgtgattaatagatatcatgcctataggaactaaaaatcaattagacaccatgcctataggaaataatggaatcaatttcaaacctagaaatcatggctataggatttaatctaatagatatcatgcctgtagggtgaaatcaatttgtaaacttagaaatcctgcctatagggggcttaaattaactagaaagcatgcctataggatctaaagagatagaatctgttaaaatcagtaatttgtttagaataaggttgtattgtggtccgggcccgggccaaacgggcctgggctttggcggtcccgggccaaatggtcccgggcctaacgggccaaatgagtagaaccgcccaccgcggtcctaagcccacatggtctcgggctaaatggggcgggcccgtggacctaaacgggcctaaatgagcttttttgttccgggctattttttaaatttttttatctaaggcaatttcttgtaaactatatatgtatatactaatataaattgcttatatatagctatataaatatatatagtatatatagtatgtatatataattatatattgccttatataatatatagcttatatatattatatatactatatctataatatatatatctacatatatatatatatatatatatatatatatatatatatatatagtttatatctaatacatataagctatatataaggcactatatatatatccaatacatataaactacatatatatatatatatatatatatatatatatatatatatatatatatatatatatatatatgtgtgtgtgtgtgtgtgtgtgtgtctatatatatatataaatatatagtttatatgtattggaaatatatatattgccttatatatagcttatatatatatatatatatatatatatatatatatatatatatatatatatatatatatatatatatatatagtgcaatatgtagatatagtatataaaatatatataagctatagatatagttcaaattaaagtttacatttaatactcggtatcaaagctgcaaattaaagtttacatttaatacttcaaattaaagttcaataccttcaacataatacttcaaattaatctaacaaactagaacattaagcataatacgtctaataattttaaaataacacaaattatctcaaatcaacttaaaatcttaaatacgaatgtcttgagaacgcgcaagacaactctttatatgcctccttaaagagcctgtgccctcctttcgacgacgagtgtagactcgaccacagttcttgcactttattatgtaaacttcttcattttcttctaccacattaaagtgttccaaaataaatgggtgcaatctagaatcaccgggcatgatttaacttgaattaagaattggagtttgagaaatgagagatgagtgaagacttgaatactttaatttgagtttgagaaatgagagagattgatgaatttgtgagtaaaaataaaagaatgagagggtatttatagttgagaatagggaaaaagtgtaattataaaaaggttggggttaaaacaaagtttgggagccaaatggctatttctgaaagtgccaaacggctaaaaatgcagtccagcggctacattttaaatatctgaccattgtccctttttaaaaaaaattaaaaaaattagtcgttgggcccatttggcctggttgaatcggcccaggcccgcctgctggtcccggggtaaacggtcccaggctcacgggatttttggtaagtaccagcccgctatgggcttttgcaccactagagaccggcccatttgagaccggcccatttggcacgccgtcccgggctgtgcccgacccacaatacacccttagtttagaaaccatgctatatgtttataattaacaattgtagataccatgcctataggattctgttaatcacttaggcaaacctgtaaggttactaatgattctgggcctaaaaatgctaatatttactgcctgaagatgcccagattcgaggcttaataaaatcagtaggcaaaactgatagggcgggataggtccagatgcccgccttagtaaactgttgttctgtattctatttttgctcatctagatatcctgtctataggatccttaattaaagaaacctgttgatttaattgcgtgcattcgttgtctacatgtggaggttaatatgagcccttatttgctccttacatgatagtcctatctgaattttgtttgtcgcctagcttttctcattttaaacaatataggtcagtctagaactatccaaaatagagttcctaaatacctccaggatcataagtaagggacgggtagtgcacgcataaggtacgcattagaagctactagaacgcttaggtaacaactgaaagatagtaatgtggtagtaaagaaaatgatgacccgtacgctaatgctatgtatagcaccttcacctgggaaacttaccaagtattgcatgaaaatgatcatataggctaaaaaacctaggacccctctaactcatgtttaaagtaatgtctatttatctaaattgtttaattcgcttgtttaagttcggtcaggacccatcattgtgggccttgaggggtgcctaacaccttcacctcaaggtaatttcgagcccttactcgatctctggcgacgtaactggttatatgagttaattgttctaggtgccctaacgcaccttaatccgttaggtggcgactcttcaaatcccttacccattcccaaaaggaaaagagttatcccaaaatatcgaagcccgatttcgcgagaaaaagggggagcgacatacagtatctgagatttctctacaatcaacctcgaatactggctgggattatcctcgaatatcgacttgttctaacaaggaaattattttgaaatggaagggtcttgataggtgagatttattgtaagggccaaacggtcaaaacgaactgtgcccacgtagattctcgagcactaacataaaacatgtacatgtatgactacttttgacaagaataaagagaagtactttccttgcagctatcttatgtcttagaaaaatttccactttacaatcacgtactttcgatctcttaagaaaatgggctcaagggccaattataaccaaagttcgtatagtcaccccctcaatcaaggactgccgttcggaaaccaacttcgaaatagatcgagctattaaaatatcagggatgcaagacctatcaagcagcccccaaattttaaaggcaatagcgatacccactcggagactgttattttaggcaagactggataactcggggaagcaagcccattgagctacacccaaaattaaaaggccacgaccatattagcatgactcggagacgtccgaaaaccgtaataatataggcctttgaaattttcataaccagttctaaaggctaatccttgaaactatattttgagttacttatttcgggagaaagttcccgatgaaaccaaatccaaagcgcctcaaaactaaataatgtgaaggcagggtttgttcaacttgagttgttttgtgctaaggcactctgacctttgtaaatacaagcaataaaacaaaggaatagtttgagagccgaaaatggtagaaagctttatatatatatatatatatatatatatatatatatatatacattctttttataaaggccagataggccaaatataaaatttacaatggccaaaatggcataaaaaaagatacaaaagaaagcaaaaatacaaaggcctaagtagcctggttttcgtcggaggcagcatctccatcctcgagatcttccccatcttcggatcctcttaggctcttggagtcttcctctggaaaggccagtttttaggctttgatctcctctgcttttgcagtcttgagttcagccacaatatcgaaaccttgagcctgaacctcttcaagggcttcccttcgagcttgccattttgcatgatccaccatgctcttggccttcgcctagatgacctcgacgtcaactttatattgtgccactttagcatcagctttggtgttggccatggccacctcaagttcgtttgccaagttcgccttatcggagatggccgacaacaactgacaggcatttaatgcctcagtactcgaaccgacgggacatttcagtatccacttatcgctgacatcatggtcgggttcgtcgcttacatcatgacccattgagataggatttgaaaagttcatatcgtttctcgtcgtcttctttccgagaaatgaggggactatctctatacggtcaaagtcgggcttgccctttcttgtatgactaatcgagactagaacgtggcaggccaaggttcgaccccatgttatattagaccgtgatgtaaagttagattgccgagctcgtgacccagagatcgatcgagatcgagatcggccaagaccgagaccaagaaggatagagatcgagcaagatcgagggaagcttcccgagccaaataatagaaagccaaaatatccgcaatcagacgaggatcactgcggaaatctcggcatgtatcaagaagacaccgattaattagataatcatgagatttcttactgtatttagaattgtattaagggtaggactcccctactatataaagtggatctgaatttgtaaaagacattacatttacgcaatacaaagcaatatactacctttctcttaagctctcagtactctgttactttgttcatattttccggtggaatattcgtttggttcgagggcgacctagcttgagggccaaagctatacatttcctttgattttcttttatttctatttatagtcaatttcaatatcaatttacgtattttctcagtttgtaccaagtaaaatcacgtgtccttaaaaccacatataaattccattgttatccgcttttaaggtgacaattggttcaaaaagaagtttactgtagctaccttagaagtctttggctctcacccaacaaaagcaatacaatgcaccccataggcctgcttctacactgctccttaaaatcttctgtgcttcctcattattttatattttgtaatgccatttttttataagtttcgttactatgctcaattaatatatcttggtttcttaggtgattagtttgtacattaaagggattggtaggattattaggaaaaataatatatgtattagctttcgtaaggcatttgcagctaaaagaaattatttttcaagaataacttagagaggtaaatagtagtggaagagtttaactaactgtatataacatatgtttaatctgatttaatatagtaaaaagtgtaataaaaatttagagaaggaagttggttacacttgattattagaaaatcatgtattctttagttgcaattcattaataagatgatgtcgataactccatagctctactctagaatttaaaaagaaaaacaagcaaattcttaaaaaaaccaccaaagatgccacaatttgtttaactaacattgacagtagggttgagatgatttttttgcactggatacaataaattatatacaacaatttaatctataaaaaaaaaagtggacaaatataagagtagacaatatttaatatagtgcttagtacaagtaaattatattcaatatagattttaaattaacaatgttatcacaacttccataccttgtgatcatacacaatttgagaaagattaagtcactgctaaatataatccaagatatatatatatatatatatatatatataatatcatagacacaccctaagttaaaagagaggctcaaaagctgcccgatagttgttgcccacataactgttgggacctcgcttagcgtaaaaattgcacgggacgttctatttggtcgccctcatttaacctatacccattttttaaaaaaagttttaacttgtaccgactttttaaacaacttcagaccctttttcctcctccttctcctccttcattttcttcttcttcttcttcttcttcttcttcttcttcttcttcttcttcttcttcttcttcttcttcttcttcttcttcttcttctttcttctactgttgttggtgttgctatgaaacttcagttcatgggatgattgtcataagtatgtttatcagattatttaaaaataaattataaataattacgtaagttagtagacaataatttgtgaatatttccacgtacatgaagtttaagatcatacttagtgattcttttcatgataattctattcttttcacgtttattgtttccaaaatttatgatttagatactgttgataaactgattattatatagtagtaatacactatgaaagaataaggtgattatttatcgagtatgttagaaagctttttcaaaaacttcagcttatatagtgctgaagttttacaaatgaactaaataacttcagcatcttctactgaagtttttgaaaaagctttatgacaaaactaatgaatccatgacaaaacacttcagcacttatttagtgctgaagtttttacaaatgaactaaatagcttcagcatcttctgttgaagtttttgaaaatgcttaatgacaaaactaatgaatccaggacaaaaaagcttcaacttatttagtgctgaaatttttacaaatgaactaagtaacttcagtatcacaaaacttcagctactagaatgcttaagttcagcaattacaaataaaaatttcagcaaatagagaacaaaacttcagtactagaatgcttaagttcagcaattataaacaaaaacttcaacacacttggttcagcaatttttgctacttcacgcccgtctactagaatgctgaagtttgcgtgattgtctttgctacttcaggcccgtatgataaagttacgcaaaaaagtgggtacgtttgcaattttttttacaaagcaggtataaattaaaacgtgacccaaaaagcgagtatagatgcaaatgcccctcgcttagcccgggaataacctgactagttctaatagattgaatgatgcgctcatatttacgttaaatgaaaaaactaacaaaatcgaaatgaaaaaaactgcttcagtgggtttggttttccttttattgggccaaaccagtccaaatacactcttaatatggtgtgatattatccgcttttggtcaagctcacataatttttttcaaaaggcctcgcaccattaagagacctctacaccttatatacagactctcaatcgttttagctaccaatgtgggattttgttcgtacacccaacaatctccccctcgaactaagttccacgtgaccattgctacatccacatgtcaattttcgagattcactgtatgccacccatattgttagagtattgtggcaacagaagcccgcaactaacttcttattgtgtgtgcaaatcctcgcaccatcactccgccatctccatactcgtcccgctgaacctgaactctaataccaattgttgggctaaactagtccaaatacagtcttaacatagtgtgatattgttcgctttgggccaagctcgcatgtttttttcaaaaggcctcacaccattaagagatccctacactctatatatagactcccaatcttttcagccactaatatgagactttgttcgcacacccaatacctttttttgtcttttcacgatgacaaaaatctaactatgaatttaaagtagacttttatttacacagtatagttgtacctcaatataattgccgataaatatatctttttgtatattaatactagactatataataaatatatcaatgcatattttcatatatttaggtagagactataactatttttagccgatcgccaaatgtgttaaaaggatatcacgatatcactgaactataagctttggccttcgatgattagtccgcattggtttatttctttttgagttttttttataaattttttatttattagtaatacttgatttcaatgtgaaaattgagaaatttatattgaacaatataagtattccgttggaaagaatacttttgccgtagaaaccacaaatgaaaatacaattcttcaatttacaaacaaaaaatgtataaagaaactaaaattttcaagtaaagaaaatagaagccttaaactaatgtcaagattaactaattaatagtattaatttcatctttggataacttagtgagttcatatcttgtgaatctaaagactttcgactcctgagttcttcgttcaaggttgactcaatctttcaaaaaaaaataaaaaaatttataaaatacgttttgtattttaaccaaaagtacattgaaatgtgttgaaattagaagttgtaaatagttgtacatttctgtatttatgtagtattattctagaaggtgattagttaagggagttagtaggtgattagttatgttagttagtataataagaggtgtacagttcatttataactaagcaattaacagaagaaacagtttcttcattttctagtttctttccttctctctaaatctctctatgttccttctcttgcttaagctcatcaatggccgaacctaggactagatttcaatatggtatcagagccatggttcttcgtgactgagcaacgagcatttcactagatcaacttcctacgtttctctcctacttcacctgctctttgatctcttcttcttttcgttttaattttttcctcagatctgtttctttctgccaatttttcgttaaaatatgcatgattcacctcaaatcacagctggatcttcaaatgcaaacaatcaacagattgattgtaatgatccgctatatgttcatcctttagatacaccgggtatgtcacttgttcctcaattgttaattggagctgaaaattactcagaatggaggcaatctatggagatgtcactccttgtgaaaaataaacttggatttgttgatggaacttttactagagagcggtacgagaaaaatgtcttttaattaaggcagcgggatcattgcaatgccatagtgcagtcatggattcaaagttatgtggctaaggaactcagaaacggaattgcgtactcttcaaatgcacagaaggtttggaaaacactaaggattgttttgacaagattaatgctactaaggtatatcatatgaattgggaaatcatctgcctaacacaaggaatttctagtgtatctgtctatttatctaacctcaacgatctctgggatgaatttgagtcaataatacttgaaccatgtgattgtgagaaatttaaaacattgttgagtttcttcgccaacagaagcttatgaagttcttaatgggattaaatgatacttatgcaccttagaggagtcaaatactaatgatacaacgaacaccttcactcgatcaagcatattcaatgattgttcaggaagaaagtcaaaggctgagtagtggatatggtgtacaaagtggaattctaggaagtgaacctatgaatactgaaaacatctcttatgtatcgcaaacaactcaaatgtgaagtttaaaaggaacacaaatctgttttgtgattactgtaaaatgaaagacacactagagaaacttgctataagttggcagggtatccacagggttttaagttcaataacaaaagaataggacctaatgacaactacacacctgcagtacataatgtgagtgtaatggaggagaataaacaaataggaagtgatggaattagtatgataaatggaatgatcaatgcagtagatccaatcttcacacttgagcagtaccaacagatactcagaatgttgagcaaggaaaaaggaccagcagaagaacaaacaccagtagatgtggccaatatggcaggtaattcaatcactgaccaaattaagtggatcattgacactggtgcttcaaatcacatagtttcttccttagatctgttgtcatgtcctaagcttgtttctcattccaagtctacttcaatccatttacctaatggacaaagtactcagatcactcatacagggtcatatgctttgtctaacaatcaaactctacatgatgtgctttatattcctaagttcaagtacaatttactatctgtgtccagatataccaaggagctaaattgtatagtctctttttatcctgatttttgtctctcttaggacctcttcagtggcaaggcgagggggattggtagcttaaaggatggactctacatcctcaatccttcaaagcatgctgctcctctcatttccacatgtatgaccattggccagtctgcttcctcaactatgttgtggcatcaaaggcttggccatgctcctcattcagttcttaagaagatacctacaataaagacattgttgtctaattctagttcttgtaactgtcatatttgttcattagctaaacaaactagattgccatttcctactagtatttcaagattaaaatattcctttgaacttgttcatatggatatgtggggtccttatagagtaaacatttacaatgattatagatatttcctatctcttgttgatgatttttcaagaatgacttggacctttctcttaagactgaaaagtgatgtctatgtgattctatcaaaccaaaggaattgtgcattaaagtagttgtgtctatactccccaacaaaatagagttgtagaaagaaagcacatacacttacttgaagtaagcagagccttgagatttcaagttgcattgcctttaaaactatggggtgaatgtattctagtagccacttatctcagtaataggttgcctagtattgttttgcatggaaagactccttatgagctctttcatggttgctcccctaaactggatcacctaagaacaataagatgcctttgttttgctaccaggcttgactctcatgataaattccaaccaaaatccattcctgctattcttctaggatatgcttctacacagaaaggctataaactgtataaccttaactcttgaaggacctttgtcagtcgagatgttgtctttaaagaaaatttctttcctttcaaatgtccaaaagagaaatttctgtcatctcatcatgattcctcaatagtcatacctgaaactagttctgtgatctttctccttttccatcactagaccatgaaccagattcatctactcatccatcatccacttcactgccttcatctctaattaccaacttgccagtttcactttcagaacctcacagtcctatattgacaaaaacttcattccttaatgtagagtcaatcccatcagacaccttactttattcctctctcaccgatcttgctacctctgctgaacctagcacttcttccttacatgacttacctcctcctaggaagtctaggagaactagcaagcctccaatttggtagactgattatgttcatccacccttaccatctactttttctacttctcatcatgttcaacattttgtttcatatactcacctttctccttctattaaagccttccttacttctttttctattgatgttgaacccttatcttttcatcaagttagtaaagatgatagatggattgaagttatgaaacttgaaattgaagcactagagcagaataacacttggtttgtagttgacttacctgttggtaaaacacctattggatgcaaatgagtgtataaaataaagtataatgcagatggtactatagaaagattcaaggctaaattagtttctaaagactttacacaacaggaggggttagatttccatgatactttctctccagttgctaagacgactactgtgagggctgtcattgccactactactctcaagcactggcctgtctttcaaatagatgttcagaatgcctttttgaatggagatcttgaagaggaagtctacatgactttgccccaaggatttagtagccagggggagcataaggtttgtaggctacttaaatccctatatgggcttaagtaagcttctaaacagtggaatgtgaagctgtctcaagccctgtcttcatatggttttaaacaaatcaagcatgactattctttgtttactagaaatgtggataataagtttgttttgattctaatctatgtagatgatctacttgttacagggaatgatctacaggaaattaaaatgcacaggactctctacatcaacacttcaagacgaaagaacttggagaaatcagatacttcttaggcatagaatttgctaaagcaaaggagggcattcttatgactcaaagaagatatgccttagagatgatttctgatgcaggcttggcaggttctaagcctaaagagacaccaatggagcagaacttgaagctgacaagcactgagtttgatacttgcacagacacaagtaaaggacatgaactgctggaagacaaggggagctatcaaaggctcatagggaagcttttgtatcttacaataacaaggccagatatctcatatgcagtgcagtcactaagccagtttatgcatgcacctaagaagtctcactatgaagcaacacttcatgtagtaaagtgcattaagaagcaaccagggttggggctgttaatgtcaagtgacagtaatgaagaaatagaagtattctgtgattcagattgggcatcatgtcctttgtcaagaaagtctgttaccggataatgtgttaaacttgggatttcaaccatatcatggaaagctaagaagaagcatactgtgtctagaagctcgggtaaagctgaatataagagcatggcacacactgtggctgaacttgtgtggttaaaaggtctattggaagagctgagtgtgaacctaaagctacctatgaagttgttctgtgataataaggtagcattacaaattgctgcaaatcctatgtatcttgaaagaacaaaacacatagaaatatactgccattttatctgagagaaaattccagaagggctaaccaagacttcttacattcccaatcgggagaaaccagctgatgtgctgaccaaagcactaggacatcagcaatatgcaacattaatctccaagttgggaatgaaatacattttttcattctcaacttcgaggggaagtgttgaaattagaagttgtaaatagttgtacatttctgtatttacgtagtactattctagaaagtaattagttaaggaagttagtaggtagttagtataataaggggtgtacagttcatttatagctaagcaattaacagaagaaacggtttcgtcattttccagtttctttccttctctctaactcttgctctctctctctctctctctctctctctctgttccttctcttgctcaagctcataaatggcggaacctaggactagatttcaacaaaatgcaactatctactttacacatcagacacacacacacacactccttcaacagtgatggtcattagaatagttcatttttatcccgcgccagaaaatatttacattcgatagccaaaaaagtgtataaaatttgtataatttttgtatatatatatatatatatatatatactccgtacattttttcggctattattttgagagcggctatagtgccattttccctatattcatggtagcttgaacgactgaatgttcaaagaatacattacatctctgagttattatatatgatttcttccctattatattgctctgaactcttaacaacagaaaagttatgcactatacgtaaaggcggagacataattcgaagtttattagttctgaatctgccatcgaactcataactcgtttagttactggatttgcagttaaatatttatacatatttagtgaattttctaatataaaatagggtctatgcaaaagcaattgggttcgtctgaacccataagccatacactacctccgcccctgtttgtacgtgtacttatactccttcatctacattctcaagtctcagccatttcatatatccgactgatcaggtcgcactgccccagttgattaaaatcatctgtacaccatatgtctcaataatgataccttttacaccctttacataaaaataagataaagacaccatactctgatctatagactcccacatcgggttcctaagggatgtgagctaggtgtgatgaccctctatgtcatcatgccacataggcgccatctgacatatgttaatgctatgtggaagcttacataagaagaaggctagcatttgtgaggagattctagagaggtatggacatttcattaggaagaacctagatccttatggatttactaagaaagtccttggaatcttctaggcttgtagagaattctagaaaaagcctttatcttgtaaatatcaaggacttgtataataattaatatttacacactagctcctaggaaactagtatataaagggggccactcatttgtaattcatcaagcaaacaattcaagttctctctaatacaaagcttcctttaacaattctcttgtgttctttcttccattcttttagcgatcttgagtgtagtaagactgacttgacatagaaagcacgtgagcaagttgtgcaagatcatgagcgagttgtcaagtgccgcacgtgtacttagttaacaactaaggacgtgacaacgtggtatcagaacgaaagtttcaactaagggaatggtgaacaacggagaaactaatgctgtcaacacccaagccaacgtcatccaggatgttgctggcaagagaggccgtagcaaaaagaggaatgccacgaacaagagccaggaggttccacctgaggttgtgtcaaacgaatgacttacatcccaagaaccatctgccactgaggcgagcgaggataaagtggaggtccttccagaggatgtctcgctcgataaagagtgggtgatgaagatgaacgcagggatggacgccgtggagatctttggccaacgtttggggaatgtggaaggcaacttaacattcttgaggggcacactcttgaaaagattgaaagtattccaaatgacttggagggacgtacacaaactgagatggaactaaggcaaaccatcactgccttaacgtgcagactcatggaggttttgagtactatcgatgctatgaaggcaaagatagagtcactcgaggagcatgtcaatgctggcgtgaccgaggtagccagcaatgttgtggtgacgagggaggccaagatcgaggctcccaaacccccggtgttcaaaggtgttcgtgatgcacaataagtggaaaacttcctttggcacttggagaactacttcaggcacgacaaagtgagggacgacgaggccaagatcaatactgcggtattgtacctctcagagactgccatgctatggtggagaaggaagatggccaatgtggataatggtctatgtactattagtacatgggatcagttcaaagcggagttcaagcgacaattctttccaaacaatgtcttgtacgaggcaaggcgcaagcttagggaattgaagcaaatagggagcatacgtaaatatgtcaaggagttcactacccttatgcttcaaatccccaacctgaccaatgatgacttgttgttccacttcatggacatgttgcaaaattgggctaagaaggagttgcaacgccgacaagtcgatgatatagaccaagccatagtggaggccgaatcattgatggatttcacgcatgataaacatgacaaaggcaatggcaaagagtcaaaggttaacaatgtcaaaggtgggggaggccgtggcaaaggcaaggagatacaacaacaatactccaagactcaagatttcaaaaagtcgagtggtcgtcagggctacaccgagaagaagacgcaggtctagaagaagggatgctatatatgcggagggccacatgtcttcaggaattgtcctgaccttaagagccttagtgccatggtacgtgagcggaaagaacagccacaaggagagagtccgggaaccgcacagttgggtatgatcggattatgtggtgctgtcacgaagcaagctatccaacctatcgagaatggcaatcagtacatggatctcaccatcaacgacaagcccgctcgtgcaatggtggatactggagcaactcataatttcgtgacttaggctgccgcaaagagactagaattgaaacttgctccaacaaactctcgcgttaagaccgtgaatgacgagatacagaatgctcgtggggtagctaacagagttggtgtcaaattgggaacttggaaaggtatgacaaactttaccgtaattgttatggatatctttgacatcatactggggcaagagttctttagacattgtcatattttaatcgacccctacctccaatgtctcttggttatggagcgagaaggagcttgcatggtacctacagtgactatgccacacggacagatccaagcaccactctcagctatgcaggttgtcaaggggatcaagaagggggagccgacgttcgtggcaaccattgcaagtctagaggaagacaagaattttcaagagacagtgtcgccttgcatagagaagttgcttgaggagaacaaagatgtcatacccgaggagttacctaagcactttctgcctaggcgagaggtggatcacaagatttagttggagccaggggctaagccacccgtattttccccatatcgtatggcactgcccgagctagaggagctcaagaaataattgaaagagttgctagatgctggtcccattcgcccatcaaaggcacctttcggcgcaccagtattgttacagaagaagaataatggatcattgctcttgtgtatagactatcgagcacttaataaggttacagtgaagaataagtacccgatcccgctcattgatgatttgtttgatagacttgggcaagccaagtactttaccaaggtggatttttgaaagggctactaccaggttcgcattgtggaagaggatgagccaaagacatcatgtgtgacgagatatggagcctttgagtagttggtgatgccctttggcttaaccaatgcaccgaccacattttgcacccttatgaacaagatttttcatccctaccttgatcagttcgtgatagtttaactagatgacatagtcatccacaacaacaccttggaggaacacatggagcacttaaggaaggttttccaagtcttgcaggagaatgagctatacatcacgagagagaagtacgagtttgcacaattgaaggtgcacttcttgggccatgtcattagcaatggcgagctacgcatggacgaggctaaggtacatgctatccaggagtgggaggcacccataaaggtaactgagttgagatccttccttggtcttgttaactactatcgtcagttcatcagtggatacttagcaaaggccgcaccattgactgagttgctaaagaggaacaagccatgggtttggatggagcattgtcaaaaggcatttgaatgccttaaggcagctgtaacaaatgagccagtcttggcattacctaactttgccaagacatttgatgtgcacacagatgccttagacttcgccatttggggtgtcctgatgcaggataagcatctcatagcatttgagagctgcaagttaaatgagacggagcggcgttacacggtgcaagagaatgaaatgactgccattgtgcattgccttcatacatggagacattatctgctcgggttgaggttcgtggtcaagactgataatgtggctactagctactttcagacacagaagaagatcacaccaaagcaggctaggtggtaggatttcttagccgagtttgattatgcgttggagtataagccgggaaaaggtaatgttgtagccgatgccttgagccggaaagacgagcttactgcaatcacttcagcgagatgggacattcgggaggctataaaagaaggcatgcagcataatccagtagccagacagcttatcgagttagctaacaaaggcaagacgagacagttttggatagaagacggcttactacttaccacaggtcggcgggtctacattcctaagtttggaacattagaagacggatcataagagagagtcatgacacaatgtgggttggtcaacccggtcaacgtcgcactagggccttggttgagtcagtctactattggccacgcatgcgagatgacatagagtgttatgtgcagacttgtcttgtctgtcaacaggacaaagttgaacaacaacaacccggaggacttttggagccactactagttgcagagcgtcgatgggaaagcgtgactatggactttatcacttgcctaccgaagtctgacggttatggtactattatggtggtcgtggatagattttccaaatatgccaccttcatgcccgcctcaccgggttgcacagctaaggaagccgccaagttattctttaagaacgtggtaaagtattggggcttaccaaggcatatcatcagtgatcgagacccccgcttcactgggaacttttggagagagttgttcgacatacttggcacagaactgcacctttttactagtttccacccacaaacggatggacaaacggaacgggtcaatgccttactagaatgctacttgaggcattatgtaagcgcgcatcagaaagattgggcaaagctcctagacatcgcccaattctcttataacttgcagtggagtgagtccactgggcggataccatttgagctagccacaggccaataaccacaaactccacattcattaccagtcgcgttcgagggaaagagtttgggggcttatcatatgtccaaaggatgggaggagcagctcgacactgctaagtcctacttggataaggcagctaagaatatgaagaagtttgcagaccataagcggcgtcccacatactatagagttggggacatggtcatggtgaagtttaacccaagacatttcaaggcactatggggcatgcatcagaatctgattcgcaagtatgaagagccatttaagatcgtcgccaaggtaggcaagatctcatacaagcttgacatgtcatcgtatcttaagatctaccctgtcttccatgccagcatgcttaagccatatcatgaagataaaaatgatccgagtaggggccaatcaagtcgagcgccaatgactatcaccacctcgcataatcgggagattgaggctatcatagattaccaggccaggcaaaaacaagggcaaaaagccaccgctatcttcctcgtccattggaaagggcaatcacgaaggaggccacgtgggaacgatatgaagacttgtggcaattcaaagataagatctgagagtttatgcagcagcattgcgccgcggtcatcgtaatattgggtgggggagagtgtgatgaccctccatgtcatcatgccacataggcgccatctggcattattaatgccatgtggtagcctacataagaagaaggctagcatttgtaagaagattctagagaggtatggacatttccttaggaagaacctagatccttatagatttgctaagaaagtccttggaatcttctaggcttgtagaaaattctagagaaaactcttatcttgtaaatatcaaggacttgtataataattaatatttacacactggcccctaagagactagtatataaaggggaccacttatttgtaatttatcaaacaaacaattcaagttctctctaatacaaagcttcctttaacaattctcttgtgttctttcttccattcttttagcgatcttgagtgtagtaagactgacttgacatagcaagaacgtgagcaagttgtgcaagatcgtgagcgaattatcaagtgccgcacgtatacttagttaacaactaaggacgtgacataggtctccttaatgcggcttggataattctcacctcttgaccagttagcttttttttggtcttgttgatcagttaacttttggaattgtctttgcttgattccttttggaggagatttacttcctttccttaattttcactttatcagcaaatccattaatcaaattattccatacatcaaacttccatcaatcttttaatttcatgggtgcatgtaaagtttctttcctttatttaaaagctattatctgcattttgaaatggggttacctatatccctattacgcttaatatgtcaatcctttgttatattgttcatggtgaagatttaagagtgactcattaggttttaagagtgttttttataataactttatattgtttagtaaatagttttttaatactgtaaactattataaatagtgcaatacaaacttaatttcgttttatatgttattgtttaattttggtacactaattattctcactggagattttatcactttttttaaaagtagcatgcatgtttaaaattaaactattctacttagaggattttaattcataatcaagcgtaaccctgaaatttaatatctcattttctccgcttcccccatccaaaagaaaaggtaaaaatttaaaaatacgcgttcaaaaataaaaatcaaaatcaagtataattaatccatgaaagcgttcatgcatatgagctaggcataacaatattatcgttattaatagcaagagaacaatattccatagtagacgacaaaaacattatatgtctctcaccactgtaaagttatattcttgtccacatgtgaccaagttgacaattccggaaatccaataaaccacagcactacaggctccgcttgcagctgttttgtaaatctgcttgtttcagtttgttaatgtacgtactatactataaaaaagcaatattaatacaatgaatgtacagtacccttatattataacgcactaaaggacattgaaacatcatccaagaccatgcaggaatctagctaatatctgtagccagcaattttcaagaatttcaactctttcgtaagcaacacaccgtttacacatgctcctttttctatttttaccactgttcattttgttaattccatttattctttttcttattggagtatcttgattagtatataccattagaattaaacgtgagagtttttttttcgtgtgtgtgttttgttttcttttggtagggtagggcttgtacgcgtgggttgctgagtcctctttatttttgtagttactccactgttgggcaaagtacagcctaagagtacagccatgagcctatataaattctttgtaatgtgaaggaagcaggagaatattatataaagtactcttgctaaggtggtgagaaaataatagtgaggaagaaggaaaacagaagtattcagcatcaaattaaagcactacagcattaagcaacatcaacgtcttgataaattctgctaaagatgattcttgagaaacagtgacaaatacttatgcatggtacgtttgcatggaattggcatgtttttggtatctttagaggattataaaacctgcatttacgacttaatttccacttctagctatcattttatatataattccctaatctcgatcttgccttttccttttccttttcctctgaggttgtagtgtatggatgctttcgaataaaatgtcgacgttcttctcgcacgtttatacctaattaagtttactgtgtttctacacaatttatatcattgaacttgaagtttagctgccaaagcttaagcagagcattgacaaattttgtacttcggtaaaactttgtatcgaaaatgaatccttgttttttgagttaattaatttcaagtcttatcttgaaaccgttctttcatttaatttgctgtatataagatatacattctgttggatataattgagttcttttagtttctatcattttaaactttttacttttaacttttttgttgactactttcactttctctttcttatttttgacttgattgccaattacacatgtttattcggttattctttagcatttacatatacattctgttttccaaaaatgcaaattaatcatgaatttctgtcaatttatctttgattatgtcaagtctagcaattctaaaaggtaacaatattaataatttccatcgcatgagaatttatctatggcgctcctactttgtgatttctaataattttgaagtagttaaactgatttttatttgttggcgttgctactgggatacagcaggtgataaattttgagatgtttgtcttattaatttatttattggaagaaactctgctttaataggaattgattctcatatatatgtgagaataattcatagcttgaagtatctgttgtaagttaatttttatagctggtcaaggaaataattcttttttaatcctttttgatctttatatatgttcaaaacttttatataatcaagagagaagagatactaaatataatatctgtgccaatgtgagaacaggaaaagattttccacttgaaaaaatacagaattttaagtaggcgtttgaagataagaattgtaatttttgaaaaaaaatactcatttagatttaaattgaaaaatggtatttcaaattatgtttgaacatgtatttccctttaaacataaatattgtagttttgttagtgaggaaaaaagtattttggaacattttgaaaaagtgttcaaaaccactttttgatttttgaaaaacttattttcgaaaaaatttcaaaaacttgtaaaatttcatggacaaatacatttttaaaaaaaaattctgaaaaaaagaaatttcttttttcataatatttatttcatattcagttacatatattaattttttaaaaaatattaatataaatagatttaaaattatgctatttactgtgatttatactctagttgataagagaccaacacgaacacaacttttatttttcttcaaaatgtatttattagaggaaaaatgctactatatagccgctttcaataaatagccgaaaaaatatatttttttgtatatcttttgtatatatgtacattctgtatgttatatacaaaattatacaaattttatatacttttttgttatcaaatataaatagtttctggcacgagctaaaaaaagccctattctatatgttaattagatgataaatgcttttaacttgtgaatcacattgtatagttaactgttcattcaggggaagttctttttaaagcagttgaaggctattttgtattgtttttcttatccaattgctcctagagcgagctaactctaaaaaattcgtccaaccgttcaaatttcaggctgcaatttgctcgcataaagtcaatttaaataaatataaaattaaaatttaattattcaaccatgaataaatgcaaacaaatatgtgtatagaatatatggtatatatatatgtgagcatgtgtggctctgtgtatgtgttttagaattcttgtgtagagctgatgaaaataagtggtattttaatgtttcaacattatcttatattaggacacgtagaatttggcattttcaggtgaaaagtggaagcatctgttttggattcaagtgcaaatctccactgtctccagctcactcgaggaaaaacttgtctacaacatatccattgcatgcatgctgctctcaattgttatttatttactctctgaagtttccaaatatttttgttttatttataaaaagaatttttaacggttttagcttttaagaactttctttgcgttgaaaatattcctatttcaatttaaaccgtatcttgtgataaggagcaggaggattgtctggcatacaactgtttttaatgatttttctagaaacattttcaaatcctgctcttttttttttttttttttttttttttttttttttctctttcctctctatcatcttctcgtcgttcctaattaaaacaaaaatttccttttaatttcatacaaattaacaaatatggtattgatgaaattttgatgtataaagtgggatcagaacaagttgaaagcatttattattaagcaatttaatttgatatgatgtaaatattttgagatgtaatgatagttgtaatgattaacaatatgttcaatagtttttttttccttaaacagagaatcaaattaattggaaaacagtgaccagaagacagtgcgctggaagttgaccacttctgccccttaggaacttggtgatttttttttatcttttagaaatgttttctaaaattgtttattaggtggtgtttgctgcattaattgaaaattaattttttcgacaaaataaatatatttgaatttgatcttcgcaaacaatcaaaaactgcgccaaaatctataaaaacgtgagccgtcagatagacacgtggctaactaaaggaccagaattgaaaggcatacggtaaacccgcggagcaggaaactaatccacctctctccgaatttccgaagcccccttcgctgaaaattgaaaatcagaaaaaagtaaaattggaggagaggcttagcggtagggacagagaagatcagagacgtatgaaaaaggcagagagttacggctaattttttgaatcaattttcacttcccttcgtaagtgtttttcccgcgttttttttttgtgcctcgaatcggttgaaattttctgtatttttaatgatttttttgtgtattaaattctttactaattatagttagattcatgtatatctgcaagtttatttgtttctattcgtatatcttgagattatatgcaaatcaaacataagagttaaccatcagatcgagaagaaatcgagcaatcgttttagcaacttcaaatagctgatttttatttgtttaactacgttataatactgaattagcgagggaattcgatttcataatttttaaatgcttaaaattgaactagaatctgaatttctaaaaattggcgtcaacagctgaaaaaattagaaatcctatacctttcttccctgaggaaaatgaatgattaatcacttgaaatttgattaccacgtcttgttccttgaataatccgatgttttttggcctttaatggttttccattatcctctttgagaaattagtaaaaccggacagaaaaggatagttgagattataatttggtgttgactagatataactcgatagtcgactaattgcaccaaaaagggaggaatttgatttcactgcctatctgaatgggtaaaaacagaaattcatgctatattttaaatcaattgtcaaggtaaaattttctcttgagaaaaataggggaaagatgacggttttgttacgagatctgaggatatttcatgcttatttctaaagagataagcttgcactctatggaggaaatgataagttatcagcttgaattatggactaacgatcactgaatcctatatgtcatgtggtgatataatgaattaattggaagtaaatagaaacaattaagataaacaaactgcagatgttcatttagagaaacattaacaacggattctgatgatgcatggagataaccttttaggaggtggaaagcatcgcaagtttgccatgttatctgattaacaaaggtgatgattgcagctatttagtgcaataggaaatcaaatctacgtataataaccaatttagttaaacaaattcagatgtattcacctgaaaatttattccttgattttgcaataatttcaagttagtctaaaggaggtttgaaacgagtggataatgttggagaaaaaacagcttggatgtctgaacattagcgaggtctaccctgataaacaataatatatggtagttagcattgggtatcatatctgagcattacctgagtcatggaacttgagtttgaagccatgtgtcccagttagtttaccatggtaacttctcaacccaaaaccagaaagaataaaaaaatgataatattaatatgagagcaggtgttgtgctggctatttctgcgctatgtttacagatagtattgttggaaggtcattttggccttatatggttgtggttgtaaatcaatataatgttctttgcatgtctaattagtttaaggtcttagctaaacattctgtgtcaatttaccatcaaaatgttaccttctgtgagagcacatgctcctataagcgcgtctagctgtctaccagtgatgaatgtggcttgagttctgaacttatggtatgacctacatttgccttaaactggattagatgtgaatattagaactcttttccaatttggaagttatttgaattttccagttgttggcttctaaccgaggtatatcattggatttagtgaagatcctgatgatgcatcttaattttgttggtggtgcaaacattatggatccttaaatcataagtgaccttgagggaaccctaattaagatggaatgactggtaaagtctgttccaaatttatttttcacagtgaggcctcctagcatgaagaaagaagagcccttatttttctttttcaaaaaaaaaagaaaaaaaagttgaagaaagaagaacctctcaccagcgttgtttgaacaaagtacataggaaagatggctactggttataacctttgcactttaacaagtgcaaacagattgtatgacatggagtgtgaagactaaaaatgagaattcgtgtatgccctgctctgctgtccatggactattatcgtcatggatttatttttaatttgtctatgtactttgcttccacaatatcttctccagaaatgaagtcaaggaaatcactgaagcctccttctttgtaggacaagatatgttgttcatcgacaagtgctggtgcaggtctaacttttttacctagagctagactaagaaggctggcaatggataggcgctttttctctgagttaactgttgctcggtggagaacacctttgtatcggccattgctcaatacttccatgtgatctcccagctgaacaatgagggctccttcaatgacaggaactgaatgccactttccatcatgatccatgatttgcaagccctgatgattttgaagaatgatcgttagcaaagcataatctgtgtgtggtggcaagcctagtgtaagatctggctcaggacatgctggatagcaattaatggccatgacctgggagccttctgcaatgtcttcatgtaagtaactagggtttagtcctaagctctcaaatatcactcccatgagttcttcttgcaacttttgtgctgcgatcgtgtaatttcccattttctccctgcatgataaactgctttaggtacctatagttttattattcttgaacagtgagaaaatatatctatcagaaatcatttcagataagggtgcaaaacttacttgtaacatgtgggatttgatggccacaaatcaatccaatttgagagtggattagcatagtgcttgaggaagtctctccaaaaggatactttgtctttgacatcatttaggctggtattataccttacgggatcatgaacatttgaagacaagagatgcattttcttttcatttggtaaatcgaagaactcagtcgcagcttctaaggcatctttcatgactgacaatgggattccatggttgactacctgcagagtcatttattgcatgcatgctgttattttacgtccaggttgaattagcgaagcacgtcttattctctttcctgctaaaccgctatgtatctaaaatctaggacatctcttttaactgatcaactgaaaataaagggacgagaggaggaggaggaggaggaggagatatgtctagaaaccaaatgcaccatgtatgctgcatgaagtttctttttcttgatttccaaatgcttttgtctctctgtggggaatctgacaacatcttttatttacgtggtgtgtgtatattgttcttccttaaatcatatcagcacgaaggaactttacatgtaacaaaataggataaaaaactatatcattttagtacatgattgcaggtgacatgacacgagagaagtacctggaagaaacctagttccttgcaagccaggtgtacttcctcgattatccgaggccgatgaagagggtgtcgcagaaaggatagatctacaattggcaggcatgtgttagaccgggttccatcggggcgtaaggatggcggaagaatgtaacgtttgggaactttggttagaccgtcttcagtaagtgtcatggcactagtaaatgaatcatttggtgaagctgagctcttttccatttttcctcatttttttccttgtttcaaatatggcttaactccttatttataagcagaaaatatgaagatttaattatatatatatttaaaatcatttatccggttatgcaatgaatatgtgtagtatgtgatgataccatgactataagcgatgaaaagtgtatgcaatgaattattattgtatgatattgttatttttgaaggccgagaaatgtcagatgacggtaattgttggtttcacaagttgatccagaatgtggggaaaagaaatccagaatgtaattgaatacagagattgtgttagattcaggtggctgtagcccacgcgccatgagggagaatagttttccaaatatttaaacgtggggtacgtaaggttgccatttgcttttgttgaggacgtaagcagtaagcgcgctctctggagtttgaactcattcaattcgttgcattgcgaataggggtgtttataaaaatccgaactaaatcgaaaatcaaatctaaatcgatcaaaaaaatcgatacttttttgtttggtttggtattggttttgaaatttaaaaatcgatcaaatttggtttggttttggttttaattaaaaaaaactgaaccaaaccgaatataggagtagttattttaaatttattattgcacctatatatgtgtacttttatacaaagttttaaaatttttatagtaaatattaatcgtttgcacttttagtacagttctttacctttacattctagtttaattggtggttttcttttgttaagtgtaagaatctatttcatgttaaaaaaaaatatttttaattgggtccttaaattattcatcactatttgattcaattatcatcaatatatcttggtaaataatagatttctcaaagggcaattgatttgatagtattacgttgaaaatatggtcgccgaaatgtgtgtttggtagtgtatgtcttatatttaagaaaaaaccgacaaataaccgaaaaaatcgaaaaatcaacataaaccgaatcgagaaaaaaccgacttaattggtttggtttggttctaatatttgaaaaaccgacttaattggtttggtttgattctaatatttgaaaaaccgacttaattggtttggtttagttctaatatttgaaaaaccgacttacttggtttggtttctttttagggaaaaaccgattcaaatcgaaccatgaacaccccaaattgcgagtaaggttgctcatgtttatatttgcttcgctatgtttgtttactaaatttataaatcaaattaaccaaatatagaaatagtcgtttccttttatttatttattttggcactcatctttcttcttgtattcgaacatcttttggactaggcttttacatggaggtatataaagggaactattcttagatatacataacaggactaggggtgtataaggaaaccgtaccatatcgataatccgaatcaaatcggaaaaaaaaaattacgattatgatttggtctaaattggtttggtgttgggaaaaaaatctaattataattgatttggtttggtttagttttaactaaaaaaaatcaaatcgaaatcaaaccaacccgacattatatttatacatataaatattttttgtaagagaatttattaatattttttaaaatttttcacaactttattattaaacatattatttcaagtttggacttaatattcttgaatggtccaataaattttatagcctataatgatggtaattcaaataaacttcaaatcaatactaatactaataagggaaattcaatttaacactagaaatgctattgttggatatatatttttttagttttgcattggtttataatgaagctcagaccctacttgtgggactccactaggttgttgttgttgttgttgttattggtttataataaaaatgcataacttagtttatctttttctttagtgcttagttgtgtaattaattagtacttattagttgtacttattttaacatgacctatatagtatttttaaaccaaaactacagctatcgtttgctaaatggtttataaataccctgcgtccatctatccgtccaaaaaaacatacgacattaattctattaacaaaaatacccccgcgactaacgacagagttggtgggtctttcatttaatgacgtgacgatttttaactgggccacgtgacaatctttgactggaacaaaaaatgaatattatttcaaccaatttaccttatccgacccatttacaaaaatgggtggtatgtatcatacccgctcccactaatctgacctcctctttcttcttctccaatcatacaccccatatttggataaattacataacagaaatggaccaaatttacactagtaaatttcagtttcagcttcctgcaacggagccacaacagatttcgaaatcataatcgtaccactgtcaacaggctcatctttcgcaccttcatcttctggattcacatttacagctctagaaccattcaccaccacaagcttaacctcaaacacctgcgtaaaaagtttgttcacctgcacaggtgttgctgcctcaaacacttcctttactttatttttgattgagtgaaacttcgactacgtaatcgctatcaaatctgactgtggaggtgttctagtagtaatcaactgttaaaatcaatcgctcgatgagttgggactccttatggttcgagaaacaagaagtggcagcgatgacgatgattataccattgataaaaacaaagagatacagaagtttaagccaagctataacggcactccaaatggttgggaattcgttaaaaacccgtggaattgacgcttttaataccattgctaaggaaactgccccaattgatattagcacaaccttcagtgatagaattaaacttttcgtcgacggtgccattttaatttctccgataactttaacgaaattgtttatttttccggctagtgttttgaatttttcagtgatcgatttaattcaactgtaaagtaatttaataaaggcacaatgtttacacataatatcaagctttgaaggaaaatttttttttagggcaaaagctcatatgagcttttcagatgaccaagatcctaatttggagaagaagactgaaaatcggtggggttaatgtagttttatgacccatgtaacaaacttagggtcggattaggtaagtgggtcgaaataagttattttggcccgaaactgccacgtggtccaataaaaaattgccatgtcattaaattaaaggcccacatgttcttccgttaaacgtgggggtaattttataataaaattaacgtcgtgtgcttttgataagggtagtttaggcccttttccgtatttttttttatgaattttattatctttggtattgaatattttttgtacaatgttatgactcatctcatatttgtcacgaccccaagtccactagtcgtgatggaacctaactcaacccgctaggtaagccaactaatatttatccaattccaataatattaacaagacaattaaacaaaagtaagttattgaatcttatacatttcccaaggactggtagtacaaatcatgagcatctaataatagagtttacaaaggtgataggaagtaaatacatcttctgtttgaaaagtacataaacagagttctatgaatcttctgtgagcacgtgatttttgccctatatatgaataattcccaaaatcccaaacaaaataatttttcttttgtttttacaatttttgtgcgttttggtgtcatcttctgataattgttgcattttatttgtgcgcgttaatttttataaaatacaaaaatacgcatttttctgcacttaggatttaattttatactttagtattaattagggattaacctgtcgcaaatagttatcaatttaattttaggcgttaattggttgtagcttaattgttagtttaatttcccatctttggaaaaaatcagaaaaaataaatacaaaaatacaagattgcaaaatgcaaaatggaaaattattgttaaaagaatatagagggggtcttgtttgagacccgaaatttgggccaaatgcaccaaatatttcaggcccaaacgcatcaaacactttaaaatgagtccagcccaagtccctacccggtctgcccccccctttaaatgaaacgacgtcgtttcagggcccttggatcaggaccgttggatctcatcaatccaacagtccggaactaacgaggtttccagtatataagggtccaaactgttccccccacccccatttccatcgtcttcttcacccttacccttctccccaaaccctaatccacgccgccctaaaattccttgccggcggtgaacgcgaactacaccgttcaccctggaattaacaccatgggttcccctcaccctcttcttgctattacacccgatggtttgcctcgaataaggccggaactcttcgaatcttgatttgaagttttccggccaggtgacaatttgtccgaatcagcccaaaatcataccctacaacccccagtccttccccaacactaatctgtggttgttttctttcaaatcaccttgaaacgacccaaatcttagatctaagaattgctgaccaaaccctaaaatcaaatccttttgatttcgaaccgtagcacccttaaccatgtgttctcgtgtaagaacacatggttagggatgttacgcgtcaaaaatctgaaagggttcagatgtttacgactggccggaaccccttttgcctttgtgagtttttcttttctttttttactgtttattttgctagcatgattaaaatgttatttgcagtcgttgtttcattattgttctgttaatattatggtttaattgtgttagtttaggtcatgttaattactgttaattctgagattgttagttggttgaatgattataagttcatggtttaataattagttttaagttcatttaatgttaatcgtggtagcttaagctcagtttaatttcattttagcttatttgagttggttaattgaacagaattgggtcagtcagtctgattagttggtttctgattgctagctaattaattttagttagtttctgattgctagttaattagtttttagttagtttcagattaggttagggtattgggtatagttgttaaggataaaggtaggttcagtaattctgaaaggctttcaggggtaagctgggtatggaaaagggcagttctgataggaatagtaatatcaaggtatagggaagggtagtatgggtattgtatgggtagaggaatgctttagggccttctagaatgggtttcaagtgtaaaatttaataagtgtactgcagttacttgtttagcaagatagaaatagagggaccaaagtaaaaataaggagggactaattagaaaatcagaacttagtttattctctttgggtttgcctataaaagggcataagatgccttgggaaagggggcgactctcaatcttctgccttgagccttaaaattttaatttgagctttcatttttattctgttagcatttcaattctgagggtattcagaaaataaaaacatcaaaatatggaaatctgaaacagtttcagaatccccttactagttttggacttcagttgtgagggacaggggtatgttagactgatctgtgggaattggcttacatttctgattttcgaagtagtctgtctgtgtttctgtggcatcacattgttgggtttgttgttgttgctgttcaaagtacctgactcttcaccttttctctatttcacattccaatttccaggtacatttccctgaatctcactgatgtatgtttgttgaagtgaattgaagtgttccaaggcctgttattcaactgaaagtagcctgtatctttaatgatagtagtagtgtagtctcttgttatgtaattggcagaatgtgtataattaaacttgttcagtagggtagattacatgttgaatgatgcatagtttagaactgttgaattggacatttgaataagctttgagcatgggcctgggctgatctgtaattcgtgtgaattcccttagtcatcagaaacaattagacctgtgtacatgacatgaaattcatgagcaagtttgatgacatttagcttagtcattggtattttgtcattatagtgtaatagaaggtttgcttttgttttaagattctgaaatcgtttggaagatcataattatggtaagtaaattggtatagaaatcagttggaaatcatgaagcaaactcattcataattgacttaattcattaaaaacagcaggtcgtgataggcaatgtggaggatagatcatttatggaatctgagaattcacgttttcagtataaggattcattgttacaataagaataaacctatcttcattgggccgctcggatcacgctaaggccacgggcaggcccaattctcctttaaatttggtccttattttatttcattacaatccatttccaaattaactagtcttttagaggcatacaaataagtagagaatcgtagctattttggaattactgctagccttgccggaataaatcacgtgcgcaaactgtcaacagtgggctactaaaatgattagaaattgggatggccatttagcaaattccatggtcctctttaaaatcatgttacattagaatttttaagcacgacctccttaagaattaccttcctaaactcgggtgcgcattgatgcgacccaaatccaaatctcgatgaagccgaaaggtgtcgataatcgcgggtgcattgattgcaacgtggttcgaaacacgttttcatgacatcgtaattcttataaataaataatgatagaaaagaggttttctgcaaattgagacgggccttaccgcacaaaataaataaatgtggggcccttagtaaataattatcgaaatatttagaacttggaaaggttgtttagtgaatttcaccgccttccccaaaataacaatacgttagtatctttagacacgatttaattgttaatttcttaaaattagagtgcgcattgatgtgactcaaatccaaatctcgacgaagtcgaaatgtgttgataactacgggtgcattgattgcgacgtggtacgaaacgcgtcttcacgacgtcgcaattcttctaaaatataattataataaaagtggttcaaaactagtaaaaggcacacaagctagcatgtattaaaatcagacaaaatcaaatacaacagttaagcgaccgtgctagaaccacggaacccgggaatgcctaacaccttctcctgggttaacagaattccttattctgatttctggttcgcggactgttaacagagtcataatttcctcggttcgggattcaaccggtgacttgggacaccattaatctctcaagtggagactctgaataattaataattcaattctgttccgattgtcctttaaatggaaaaactcctttacgccctttgcggggtgtaggtagtgaaaaaggaggtgtggcagctctggcgactctgatggggaatcgaacccagaatctctggttcagggttcagaattcgagcttagaaaaattgttgtatttaatcatatctgattttcctacatgttttatgctaattgtgctaaatgttaccgctttgatattgtctgaactgtacataaattgtgctgacacccttctctcttcacctccggggatgtgcttactggttgagactccccattctgttagtgtcataccctgaaataagaaagaggtcggacaagttacgaagccggatggccttttggttcccggtaagttgccccctcctcgactcgagttgtccgctcgggtacacagtctagtacactgacccaggttttgaatatagaataacgtgacttcatgccggatccctagtaggaacgcttatttgcatcacgttgcatttgacttaggggactcaacacaggggttgggtccgtctaggactagcaaccggaaatgaaaagaccattctgatgcatcctaattgctctgtacatatatttgtttcgaacttgcatgttgaccggtttctgaatctcaggaatgtcggaaagttgaaaaaaaaaagagaaaaaaaatatcagttagggagttaattgattattttagaaaaaaatcaatgaccaaacactggcgaaactctgccgaaattttgagaaagaaaaaaaaaaggaaaatgttttattttgttttactaaaaaaatagaaaaaaaaagtcttttattttagtttggaaaaatagattgttttattgtttgttgaaaatggaaaaaatcgttattttgtcttgttttcaaaaatagaaaaggaaaatagtttgtcttgccagggaaaaataaaaatggaaaaaaagtcatgttttaaaatagttcggttaatttgcccgaactacgcatggtttgattctcacagggtgtgagatacgtaggcaaccctcatcgggtccaacctcccctttgcaaaaaataaccaaaaatatcaaaattttaatttttgtcataaataaaccaggtgatgctgttttattcaaaaatagccgaatgttcccaaatggggcgccgggaaggctgactttgcataaacagccacctctagtcgtattttgattttttttttcacagccttaaaagtttcgccctcgaggcattgaaaggtcgtgtcgcaatatcgggtcctttatcttaaaaaaaaattagaattgagaatcgagttcttcatttgaaaatataagggtaattttgagtcgataatatagatagttttttttatttggagttaaataaaagttttcttttgcttaaacgctttaataaatgtgcaggatgagcacgatggtaaatgggcctttttcaataatgaccaaaatcccttttgagctgcaattgtggtggaatgatttgggcaaagaagggcaagacgaagtgagaaaatatttgaaagaccttccggatttattagacattcagcctcggggggatatcatcagggcattggtcgcccattgggattcggcacataatgtgtttcatttttcagactttgaactcaccccaacattggaagaaatagcggggtacattgggagtgaccaagctccattgagattcaagtacttgattgctcctagggccattactatacaccgattcctggattccttgaaaataccccggacagttcatcacccagattttgcaaagggtttcttcagtttccgctttgtgtatgatagatatggccatgtgggcgggttcaataatccagaatttaagctttgcagcagaaatagccgacaaaaatgggaggaacacaagcgagtggcatttatggtagcttttttgggtctcgtaatattcccaaggaaagatggtaatattgatttgaaagtagcaagcgtcgtcagtactttgcaaaccatggggaaaagcactttagcacctatgattgtggctgatatctttagggcactcactgcgtgcaaagctgggggcaaatttttttagggatgtaacttatcgttacaaatgtggatgattgagcatttgtgcccgcgctctcggttattgagttatggttcggctgagaaaacttgtataggggaattttgtacgagaatcaaaggggctagtctacctgaaggagtcacggcttaggcattattatttcggaacctcaaggctagctagatatagtgggtgcttggatggttgtctgtcgaggaagtcatatatatgccagcagcccgaccgcattttttgttaatgggactcaaaagtatacaaccttatgcaccatatcgggttctgaggcaactcggtagatatcaagtaataccgagagatgaagatttgagtacccaagtggtcgaaattagtcctgacggtcgattccccgaggaagaggttcgtcaaatttggagtgagtgtcaatatctaatggcaaacacttgtgtgtctgatagggtcaaaggggaaattgctccagggtatcacgaatggttcagaggtaacgtggcatatgggagaccagctaaaagacctcatctcgaagatttcgccaagtcgtcccaagagcagtgggattggttagcaaaggaagaaagctatcgagttgagattggtaaattaaagcaacaagtcgagagtctgaaattcgagaacagtgtacatgttgtcgcggatcaaggtgaaaagaatagactagccaaagaaaatgaagcacttagggcccagatccgacagttgaagataaccatcgataagcaaccgaggagccggtccgatgaacaattggtaaaaagattggaaagcgaagtcagagaatggcgggatgagttaggaaaagctaaaagcgtcatggcagaacttaaagcacagtgggcgacaagaaccgaagagcgtcgccaatacttgaatcggttgaaaagggaccatgagaaaattgttgccaatttaaagagaaaagtggttgcccttgagggtaaagcagttttaaaaacacaaatggctgaaatgcatcgggcattgtcgcagggacacccggcaccactatatcctgccaacccatcttacatcccacccatggctcaagctcaggagcctaccactccccacgcatcttcagctttcccttatcaggcccagggttatggtgctacgtcatacgctcccccagctccaccctctaaacagaaccctccaccacccatggttcccgtctttgtggcacctcccccagctccactacatagatcatctagtgagccgctattccaagctcacgatacccaatattaccctcccgaacccactttcaaagcgcctgagccatatacctactctccctattttgaaatcccgggagaagttgagaaaccggttaagaatgcagagcaagaggaggtgattcgtaaagtcaaaagcctggagcaatccttcaggaacatgcatggttttggaaaccaagttagtgtcgcatacaaagatttgttcccttttcctgatgtacagttgcctgcagggtttaaaatggcgaagtttgacttgtatgaggggcacggtgacctagtagcccatctgcgtggtttctgtagcaaaatgagaggtgccgggggaaaggatgagttattgatagcatatttcgggcaaagcctgagcgggtcagcgctagaatggtacacgaggcaagaccccggccgatggtatacatgggatgatttggcccaggcattcattggtcattttcaatataacctcgagatagtccctgatcgtctgtcattgttgaaactagaaaagaagcctggagaaagttttagagggtttggttttcgctggagggaacaagctgcaagggttgatcctcccatgagggagagtgagatggtagattacttcttgcaaacattggaacctacctattttggtcatctagtgacatctgtcggaaagtcgtttaatgaagtggtaaagatgggagccatgattgaggaagggttgaaatctaacaagatcttgagctactcggcgttgaaagcaaccacccaggccatccaaagcggtactggtggtgtgctggggaagaagaagaaagaagaagttgctacagttgaagctaatgcttggtccaggcacaataaccctccactctactacaaccaacccagaccccaccacccaaattaccaatataccacatatggcccaccgcaatactattattcaccaccagaaccacacttttctattcaccacgcccagacctacactcagcccccggtgcactcgcaatggcgtgcaccgaacccccaaaacacacatccacccccacaaagcacttatccaccgcccagggcaaacagaccaggaaccagcttccgcccaaaccaagcttttagaagtgagaaagccccaagcagaaaaacatttactccgctgggagaatcttacaactgtcctcttccacagattgaaacagttggggatgttgaccccaattgaatccaaaacaccaaacccccttcccagaaacctggaccattctgttagctgcgagtactgctcagggatgccggggcacgatactgaaaaatgctggaaattgaaaaacgcaatacaagagctcattgataatcgccgtattgaggtacaggctccagaggccccaaacatcaatcaaaatccgttaccagcgcattatgaggccaacatgatcgaactgatacataagggggcagagcctaagaaaccttcgtaggtagttatggtgattcgttctacggaagccaaagaaaagacagtgagtgcaaggccagtggttcagttaaaagcgataaaatacaagctagtgttagtaatgggaaaggggccgttggtggtcaagaaaaagcaggagccggtcatgatagtggtaccagggtcagtatcagcgcccgtggtggttgtgaagggagcttatgtagaaccggttgtcataaaaccggtagtccagttacccatggttgatagcaaagccgtaccgtggaaatatgacaaggtagtggtgacatacaaaggaaaggaaattgaggaagagagctgtgaaacacaaggactaacccggttgggacgttgtttcgctcccgaagagttgagaaaggctaagggcacaaaagataatccaatgccagttaaaaagtctgtaacagaagaagaggcagaagagtttctgaaaaggatgaaagtacaagattattccattgttgaacaactgagaaaaacaccagcccaaatctcgttgttgtcgttattaattcattctgatgagcactgccgagctttaatgaagatattgaatgaggctcatgtgcctgacaaaatttcagtgaaccatttagagacaatggccaacaagatctttgaagtgaacagggtagcattttctgatgatgaattgcctatggaaggcacagaacacaacaaggctctgtatttgatggtcaaatgtgaaggttcaatggttactcggacactaatcgataacgggtcgaacgctaatatttgcacgttatccacattgaacaagttaaagattgatgaggatagaatccgaaaaaatagcatttgtgttcgagggttcgacggaggaggaacaaacaccgtaggggacattgtacttgagttgactattggcccaatcgagttcacaatggaatttcaggtgttggatgctgcagtgtcctataatctgttgttgggtcgaccatggattcatgcggccaaagccgtgccctctacgctgcaccaaatggtcaaattcgagtgggacagacaagaaattgtgttacatggggaagatccctcatgcgccatgaatgatgcccttgtaccctttatagagactgaagatgatatgggaccatgggtttatcaggtctttgacatagttccggtgagcagggtgcccgagggtaaaagcatgccatgtcccaggatgccagctgcgaccgtcatggtagtgtcagaaatgctgaataacgggttcgtgcccgggaaaggtttaggggtcgagcttcagggcattactcaacctgtgtctttgcccaaatatctggacaccttcgggttagggttcaagccaacagcggcagatgtcagaagggcccgtaaattgaagaagaaagcttgggtgcttcctaaaccaattcctcgattgtctaggtccttcgtcaggccgggtatcaagaaacagttattggcaaaggtgttaggttcgttgattggggcagaggggaatttggataaagtgttcgagagagtatttgctgaagtaaacatggttgaggctggagaagggtcaagcggagcagacatacagtacatcggaccacatgtcaacatcaacaattgggaagctactcctcttccagtccggagggagtcgtggtagtgggttttgtttttcctttttgtcacctggattattccagggtctgtaatccagttgctatgttccgtccgtttggatgagttaaaaccttgttgtctttacatttaatgaaatgcaattttctttgtccctaattctctttccattttcttttctttcctttctttgtacagttctttttatgctgatatcaatgacatgacatgcatgaggaaccttcggcctagtgttaaaagccaatctagctcggaagtagtaatacaagagaacgagtgtgatgatggggtggattgtaacaatgatgaagcttatgaggaaattagtaaagaattaagtcactttgaagaaaaacccaaacctaacctaaatgacacaagcagttaatctagggggccaagacaatgtacgggaaactaaaataagtgttcatctggagccacaactcaaggaggagataattaaagtattgcatgagtacaaagatgtttttgcatggtcatatgatgatatgccgggtctaagcaccgattttgtggttcataaattgcccactgatctagcactcctccatgtcaagcagaagttgagaaagttcaaaacagacataagtgtgaagatcaaagaagagattaccaagcagtttgaggaaagggtcattcaggttacacggtacctcacttggttagccaatgtcgtgcctgtgccaaagaaagatggcaagaccagggtgtgcgtcgattatcgagaccttaacaaggcaagcccaaaagataatttcccactgcccaacatccatatactgatcgaaaattgtgccaaacatgatattggctcttttgtggattgttatgcgggttatcatcagattctaatggacgaggaagatgcagaaaagacggcattcatcacgccgtggggaacgtattgttatcgggtcatgccgtttggtttgaaaaatgctggggaaacttatatgagggccatgacaactattttccatgatatgatacataaagaaatcgatgtatacgtggatgatgtgatcgtgaagtctagacagcaatccgaccatgtcagagacttgagaaaattttccaaaggcttcgcaggtacaatcttaagctcaatcctgcgaaatgtgcttttggggtgccatctgggaagttgttgggatttatagttagccggaggggtattgagttagactcgtcaaagatcaaagctattcaggagttgccacctacaagaaacaaaaccgaggtgatgaatttgttgggaagactgaactatatcagcaggttcattgctcagctcacggcaacgtgtgaaccaattttcaaattgttaaagaaatatgccgcggtcaaatggactgatgaatgtcaggaggcttttgataagataaaggggtatttgtcaaacccacctgtattggttccgccagaaccagggagacctttgattttatatctgacagtcgtggacagttcattcggctgtgtactggggcaacatgatgttacgggcagaaaggagcaggctatctactatctcagcaagaagttcacatcttacgaggttaagtatactcatctggaaaggacatgttgcgccctaacttgggtggcacataagttgaaacattacttgtcatcttacactacttacctcatatctcgcttggacccattgaagtatatttttcagaaacccatgcccacaggaaggcttgctaagtggcagatcttacttacagaattcgacattatatatgtgacacggactgccatgaaagcacaggcattggccgatcatttggctgagaaccccgttgatgaagattatgagcctttgaaaacttatttccctgatgaggaggtaatgcacgttgatgaattggaacaagctgagaagtcaggatggacacttttctttgatggggctgcaaatataaagggcgtgggaataggagcagtacttatttcggaaacaggtcagcattaccctgttacagctcgacttcgtttctactgtacaaacaacatggcagaatatgaggcgtgtatattgggattgagattagctgtggatatgggtgtacgggaagtcttggtcatgggtgactcggacctactggtacaccagattcaaggggaatgggaaatgcgggacttgaagcttataccgtatcgacagtgtctgcatgagctttgccagcgttttcaggccatagagttcaggcatattccaaggattcataatgaggttgttgacgctttggctactttggcgtcaatgttgcaccatccagataaggcttatgttgatccattacagattcaggtccgtgatcagcatgcttactacaatgtgatagaagaggaaatcgatggagagctgtggatctatgatatcaaagagtacctcaaagcggcagtatatccaacgcaggccaccgatgatcaaaaaataacaattcgacggttggcaggtgggtttttccttagtggaggggtactgtacaaaagaacgccagatatcggtttgttgagatgtatagatgcacggcaggccacagctatcatgactaaagtgcattccggagtttgcggaccgcatatgagtgggtatgttctagcaaagaagattctccgagcgggttattattgactcacgatggagcgggattgtatcagttttgtgcgtaagtgtcatcaatgccaagtacatggagatttgattcattctccaccatcagaactacatacgatgtccgcaccatggccttttgttgcatggggcattgatgttattgggccaattgattcagcagcatcaaatgggcacatgtttatcttggtagctatagattattttaccaaatgggtagaagctaagacgttcaagtctgtgactaagaaggctgtagttgactttgtgcattcaaatatcatctgtcggtttgggatcccaaaggtaatcatcacagataatggggctaatcttaatagtcatttgatgaaagagacatgtgagcagttcaagatcactcacaggcattctactctgtaccgtcccaaggcaaatggtgcagttgaagcagccaataagaatataaagaaaatactccggaagatggttgatggatctagacaatggcacgagaaattgccttttgcattgttaggatatcgcaccactgttcatacctcggtgggggtgactccttactcactggtatatggtacctaggcagtaatacccgcagaagtggaaatcccatctccgcgaatcattgcagaggctgagatcgatgatgacgaatgggtgaaaagccgtcttgagcaattgagtttgatcgacgagaagagattggcattagtgtgtcatggccaactgtaccaacgaagaatggcaagagcatacaacaagaaagtacgtccaaggaaatttgaagtcgggcaattagtactgaggcggatcttgcctcattgggcaacaacaaaaggaaaatttgccccaaactggcagggaccatttgtagtaaccagagtgttgtctaacggagcattgtatttgacagatgtggaaggaaaatgtgtagaaatggccatcaattctgattcggtcaagagatactatgtatgatttctttattttattttctgaatgtatttgtttgtatctggcgtatcttaaagattgaaatgatgaaggcattttgtcctgctatccaaacactcttatcccttgttatccccttcgagccttacttatttttcatatccctcttccggaattagcggcgctatcaaagaacacaggtgccgaacataaaggaaagaagagaaaacaaaaggaaaagaaagaaaagaaaagaaagaaaagaaaatgaaaagagaagaaaagaaaaaaagagaagaaaagaaaagaagaaaaaaaggaaaaagaagaaaagaagagaaggaaaaaaggaaaaagagaagaaaagaaaaagaaaggaaaagaaagaaaagcaaaagaaagaaagaaaatcacaacaacaaaagttaaatacagtgaactacgtttgacttgatcccgaaagggtacgtaagcagccttaccccgaggtttagtaataccaaaacaaaaatccaaaaaaaatccccaagcaagaaactggggcagaatttgtgattgttatgaaagttggattccgaaagttgtaatttgaacccattcgatttgttttgagccttttatacctttctttctaaacccaatccaaaaacctacattacagtccaaagaaagaccttttgatcaatctctaagaaatgccaggtcgagcaggtgacagtaattcgtataagtgtccacactctggttcaaacaagaaagaacgaaagcaaaaatgagagagccttatcggtgaaaaccctcacgggcaccgtaaggcgacgggagctgagagagaaataaatgagagagtcctattggtgaaaaccctcgtgggcacctttaggcgaaagtgagttggaagatggttaaaaggcaaaaggtttgtgagtggaagaatgttttgtggtaccgtaggaaaacaaggttaaggtctgggtaattcaaacaattgatgaatttctgggcaatgaagcatggcaactgagagttttttagtcggattgttcgggccgattaatccgaaatgcatgtcatggtcattggtgctagctgttctggtcagataagtttctttctttacttcattttagtagtcatccggttttggattcttcttatccttaacctgttaaaaccattgcatttcattctcttttgggggattttgtttgtctaaatgttctaatgtcaattatgttcaaaagcaagtgggaaaggatttcaaggctcactaccagcttccggaattgtaaagcacaacgtggtcagagcatgtcaaaacaacatgaggtaaaatggaataagggaagtcgccggaagttgcatcggtagaatatttgggaaatgttatgggaaatatgaaggttcaagcaaaagggccggaaagatgagacaacagtatgggtacaaaggcattcaggtggtcaaaaattgggggaacgtggaagtcggttggaaagtcgggcatttccaaggatatcgggcaatacaaagcaaggcaatggaaggacgatgcagcaagaatgccatcaactaaccaccgtttttttttaaaactaacgaaattttcagtgattgaaacaggggcagaaaattgtttgtcatgaataattcgccatgagggaagagcggctcgcaggtttaggataaatgcaagttgtcaggagtccccctggagaacagagacatacttttcaagtttgatgtcaggagtccgcctggagaatagagacgttcaatttcaaatttagcagtcaggagtccgcctgaagaatggagacatgcactttaaattttaaaagtcaggagtcctcctggagaatagagacgttcagtttcaaatttagcagtcaggagtccgcctgaagaatggagacatacagtttaaattttaaaagtcaggagtccgcctggagaatggagacgttcagtttcaaatttagcaatcaggagtccgcctggacaacggagacacacaattcaagttttgggaagtcaggagtccgcctggagaacagagacacgtattttgaatttcagtagtcaagagcccgcctggaaaatggaggtgttatatattttaagtagtcgaagtcaggagcccgcctggataatagaggagtagtttcaattttaagttcggcagtcaggagcccgcctgaataatagaggaatacattcaagttcgagtttatttaagtttagcagttgggagaaaggtaaaaacatctcagtcaaccagggaatagcaacatggatttttatcgataaagaacaaggcaacaaggaagtacaagagcaagtttgaagaatttagataggatttttataattcatagagcatagttagtttagcttcttttatctttgacacgatgtaataagggaggtcagcagcagtaacagcaacaagcacagtgcagtcacagttcctggtagtcccagctaccagacactcccgaactacactgacctgattcctgtttagcccaggatatgtaggcaacctccgaagcaggatgcggtcaagcttttcaaaatgcttcacacagaattttcgaacgggcaaaattcgctcgtatttgctcacttgtctttgcccggaaacctttcgtgttcccgagcaaagaggggcagttgtgagcacgtgatttttgccctatatatgaataattcccaaaatcccaaacaaaataatttttcttttgtttttacaatttttgtgtgttttggtgtcatcttctgataattgttgcattttatttgtgcgcgttaatttttataaaatacaaaaatacgcatttttctgcatttaggatttaattttatactttagtattaattagggattaacctgttttggaataggatacgaagaaaatgacaaaaatagtccactttaacgtttttattattttaattgtgagacagtcgcaaatagttatcaatttaattttaggcgttaattggttgtagcttaattgttagtttaatttcccatctttggaaaaaatcagaaaaaataaatacaaaaatacaagattgcaaaatgaaaaatggaaaattattgttaaaagaatatagagagttcttgtttgagacccgaaatttgggccaaatgcaccaaatatttcaggcccaaacgcatcaaacactttaaaatgagtccagccaagtccctacccggtctgccccccctttaaatgaaacggcgtcgtttcagggcccttggatcaggaccgttggatctcatcaatccaacggtccggaactaacgaggtttccagtatataagtgtccaaaccgttccccctacccccgtttccatcgtcttcttcaccctacccttctccccaaaccctaatccacgccgccctaaaattccttgcaggcggtgaacgcgaactacgccgttcaccctggaattaacaccatgggttcccctcaccctcctcttgctattacacccgatggtttgcctcgaataaggccggaactcttcgaatcttgatttgaagttttccggccaggtgacaatttgtccgaatcagcccaaaatcacaccctacaacccccagtccttcctcaacactaatctgtggttgttttctttcaaatcaccttgaaacgacccaaatcttagatctaagaattgctgaccaaaccctaaaatcaaatccttttaatttcaaaccgtagcacccttaaccatgtgttctcgtgtaagaacacatggttagggatgttatgcgtcaaaaatctgaaagggttcagatgtttacgactggccggaaccccttttccctttgtgagttttttttactgtttcttttgctagcatgattaaaatgttatttgcagtcgttgtttcattattgttctgttaattttatggtttaattgtgttagtttaggtcctgttaattactgttaattctgagattgttagttggttgaatgattataagttcacggtttaataattagttttaagttcatttaatgttaatagtggtagcttaagctcagtttaatttcattttagcttatttgagttggttaattgaatagaattgggtcagtcagtctgattagttggtttctgattgctagctaattaattttagttagtttctgattgctagttaattagtttttagttagtttcagattaggttagggtattgggtatagttgttaaggataaaggtaggttcagtaattctgaaaggctttcaggggtaagctgggtatggaaaagggcagttctgataggaatagtaatatcaaggtatatggaagggtagtatgggtattgtatgggtagaggaatgctttagggccttccagaatgggtttcaagtgtaaaatttaataagtgtactgcagttacttgtttagcaagatagaaatagagggaccaaaatgaaaataaggagggactaattagaaaatcagaacttagtttattctctttgggtttgcctataaaaagggcataagatgccttgggaaagggggcagctctcaatcttctgccttgagccttaaaattttaatttgagctttcatttttattctgttagcatttcaattctgagggtattcagaaaataaaaacatcaaaatatggaaatctgaaacagtttcagaatccccttactagttttggacttcagctgtgagggacagggttatgttagactgatctgtgggaattggcttacatttctgatttttgaagtagtctgtctatgtttctgtggcatcacattgtcgggtttgttgctgttgctgttcaaagtacctgactcttcaccttttctctatttcacattccaatttccaggtacatttccatgaatctcactgatgtatgttcgttgaagttgaattgaagtgttccaaggcctgttattcaactgaaagtagcctgtatctttaatgatagtagtagtgtagtctcttgttatgtaattggcagaatgtgcataattaaacttgttcagtagggtagattacatgttgaatgatgcatagtttagaactgttgaattggacatttgaataagctttgagcatgggcccgggctgatctgaaaattcgtgtgaattcccttagtcatcagaaacaattagacctgtgtacatgacatgaaattcatgagcaagtttgatgacatttagcttagtcattggtattttgtcattatagtgtaatagaaggtttgcttttgttttaagattctgaaatcgtttggaagatcataattatggtaagtaaattggtatagaaatcagttggaaatcatgaagcaaactcattcataattgacttaattcattaaaaaaagcaggtcgtgataggcaatgtggaggatagatcatttatggaatctgagaattcacgttttcagtataaggattcattgttacaataagaataaacctatcttcattgggccgctcggatcatgctaaggccacaggcaggcccaattctcctttaaatttggtccttattttatttcattacaatccatttccaaattaactagtcttttagaggcatacaaataagtagagaatcgtagctattttggaattactgctagccttgccggaataaatcacgtgcgcaaactgttaacagtgggctactaaaatgattagaaattgggatggccatttagcaaattccatggtcctctttaaaatcatgttacattagaatttttaagcacgacttccttaagaattaccttcctaaactcaggtgcgcattgatgcgacccaaatccaaatctcgatgaagccgaaaggtgtcgataatcgcgggtgcattgattgcgacgtggttcgaaatacgttttcgtgacatcgtaattcttataaataaataatgatagaaaagaggttttctgcaaattgatacgggccttaccgcacaaaataaataaatgtggggcccttagtaaataattatcgaaatatttagaacttggaaaggttgtttagtgaatttcaccgccttccccaaaataacaatactttagtatctttagacacgatttaattattactttcttaaaattagagtgcgcattgatgcgactcaaatccaaatctcgacgaagtcgaaatgtgttgataactacgggtgcattgattgtgacgtggtacgaaacgcgtcttcacgacgtcacaattcttctaaaatataattataataaaagtggttcaaaactaataaaaggcacacaagctagcatgtattaaaatcagacaaaatcaaatacaacagttaagcgaccttgctagaaccacgaaacccgggaatgcctaacaccttctcctgggttaacagaattccttatttggatttctggttcgcgtactgttaacagagtcataatttcctcggttcgggattcaaccggtgacttgggacaccattaatctctcaagtggcgactctgaataattaataattcaatcccgttccgattgtcctttaaatggaaaaactcctttacgccctttgcggggtgtaggtagtgaaaatggaggtgtgacaaatacatcttctgtttgaaaagtacataaacagagttctattaatcttaggctaccataaacaagaggctgctacaacaggaacgcagttacatcttcaatccccctcccgtcgatcatagcaacatcatcagtcaacatctgcacacaaggtgcagaagtgtagtatgagtacaaccgaccccatgtactcagtaagtaacaaaactaaccttaggttgaaggcagtgacaagctaacacaaaggtcggttccaataccaatatttcgcaatagttcatgacggcatagtacaagtaataaaagaagtatctcagaaataaaatgctcaactcgttcacagttcaaaaaaaaaataagcatgcttttcaagtatctcagtgaaaacccaaatcttataccaaaattgcctaaaatacgagtaagtttgaaaaactctgatttttcccaaaaatccttttaacaatacgtaagatgttttattttcagatagcgtgaggaaaatacatctctatgcctatatgtcaagatacaggtaaaatcataaatatcaccaaactgggtagcagaagaaaatgcatctctatgcacgcatctcaggtacacatgtcaaataaagtgcctcttaatgataaactcaggtactcacactcttagaatactcaatctcactgtcttgcattctttcttaccgtgctccatactcagcatactcaatcactcagcactgtataatatttgttgcggcatgtaacccgatccacacatatatatccataaggctcgttgtggcgtgcaacccggtccacatatatatagccataaagctcattgcggcgtgcaacccggtccatatataaatattcataaagattgttgtggcgtgcagcctaatccatatacatatatataatcagttgcgctcgctgggggtgtgcagactccgaaggggctccttcatcccaagcgctatatcgttgcggcgtgttggccgatcccataaaatataaccaatataacatgcttctgcgtgcagccccgatcccaaaatatcactctcacttaggccctcggcctcactcaatcatcaatctctccagtctcactcacgggctcacaatgtcatgaaactagcccaacaacaatgatatgatgtatcaataaataacaactgagactgagatatgatatgaatgcatgaatatgactgagtacgaaatatcaataaaataagtgagatgacaacaagaaaagaccactatgggtcctaacaatatcaacataaagcctaatcatgatatctaacatgattgacagctcagttactttatcacatggtgaaaacataaatatcaacaaaatgagtaactatatagtgtcatgtagataacagagtcacaattcacatggtgcacgcccacatacccatcacctagcatgtgcattacctcaataccaattacacaacacgtaatttggggttttacacccacaacactaagtttagaagacttacttacctctaacaagcaaatttcagtatcgagcaagccaaacgatgctccaagaatgccatctctcgcgttccgacctccaaacagcttgaaactaaccaaaacaactcaaatgctaaaggaatcaattcaaatctaaaaaggtcgaatctttaatcaaaagtccaaaatcggccaaaaaacccaacccgggcccgcacctcggaaccgacaaaaactcacaaaatccgtcaacttattcaattacgagtctaaccatactagtttcactcaaatccgactccgaatcgaggttcaaaactcaaatttcatattatgaaactttaagccaaaactcccaatttcctttttaaaaattcatcaactaaagctaaaatcaaaggtagattcacgaaatataactaaaatcgagtagagaacacttacctcaagtcatatggtgaaaatcacctcaaacattgcccaattccgagctccccaacttaaaatatgttaaatgaacaaaaccctcattttaacactattctgcctcgttttatgtgtcaaaagatctcgaaactaacttttgatgcctcaaatggattccttgtgaaatgctggttaagttagactctttaatcactccatttgaccttatattgaaggagatatgttggtttcaatatttgaaaatagtgcagatttttaaatacgaaatcagtggcaatttcgtaattaatctggaaaaaaaactggcaacccaattcttagtaaaatgaccataaactcctcatacaatgtctaaattcgatgattctttttgctatggcttagtaattacgatacatatctaatgcttcaataaaaacagaaattggaactcacttgcttaatgtactaccatttatgcttgaagaaacgacgtcgaaacataataaaatgagtacaacacaacccaaacctatccgaaactcacccgagtcccttgggtactcgtcctaacataccaacaagtctcataaaataataccgacttactcgaggcttcaattcacgcataataacatcaaaacgatgaatcgcaccccaaatcaaacttaatgaacttttccaaccttcaaattctaattttcacaaattagtgccgaatctttctagaaatatccaattgcaaatccgtgcatatgccggaatccaaaattaccatctggatctaacggaataatcaaaactcgaattcgaggtcaaatactaaaaagtccaacttggtcaactcttccaacttaaagcttcagtcatgaagttcattcttccaaatcgatttcgaataacctgaaaatcaaaactgtcgattcacacaagtcataatacatcatacggagctactcatacccgtaaactaccgagcgaagcgcaaatgctcaaaacaaccggtcgggtcgttacaatattatcatgttattttcttgaaaaatacattatatatttgtatcctgctagggctaaaaaaatatttggagcacaagttatataatttgtgctatgaagacataccggaaaagaaaaacccaaaatctgaaaaaaaaaaacgaaaaactcgagaaaaatcaagattaaaaaatccgactttgttggtttggtttatagatttaaaaatctgacacctttcgtttggtttggtaattaaaaaatccgaaccaacacaacctatgcacatccttccttaattaggactttattacatattttctctaggtttagtagttttcaacaaataccctagggtttttaataatttatatacaattattgtattaagtgtccaagcccgtattattttcctttaatatgccggtgatctgcgaaattagttacaagcgaaaaagattggattcatgttacctcaaaatcgattgatttgcgcccaaaatctctctttcttctttcttaccattaacaatagctctatataatcaaaataacatcgattgaatttgtattttgctacaattaaagaacaaagttcaacacataacatattcgaggaaaaaaatcattgacgatagctatgtattgccaaaaaatcgtcaattgcatcgctctggacaacactgaaaatgaagaaacattgagattgttgctagaattatttttaatgtcgttctactaaaaatatttgaattcgatattcgagttttacgattttgtgagttgtttaatttgagtgttcttgcaaatgattgagaatgtcttatggagtttatatctcaattttgaggagattagttaagtatagagttgattttaggtgaaatttcatattgaaactcgaagaagaagaagttgcaggaattgtatgataattgtatcgtaattgtatatgatacatcaatgctaaaacataattatatcatacttgtatcatacttatatcataattgtatctaacttttatttgttatattaatactcaaaaataatacttgatataatactaacacaagtaatatacaattatcatacatttgtgatactcattgtgaaattggtcacaaactcacaactgcttgtagtgatatacaattaatatgtatttattatacatttataatacaatttatgcaataattatgatacgaatacaactatgatacaatcgcaatttatttctgaaaaaactgtgatacatttatgatctgcatcttcttcagtttttaagcacaattctaaacttaaaatgtactataacatcgtattatacttgtatcaggtattgttttaggtattaatgtatcatattcaagtcacatataattttaatacatttgtgatacaattctgaaacaaatttgatacaattacccaaatacaattatgttgggtattaatgtacttgatacaagttaaatataattatgatacaattatattttaggcattgatgtatcacatataactctgatacaactatcgtacaatatgaaattttacctaaaatcaactatagacttaatcaatctccttcaaaattgagatataaactctaaaggatattcttaatcgtttgcaagaacacccaatccaagcaaatcacaaatttgtaaaactcaaatatcgaattcaaagcttcaaggttttttgatcactattaatggtaaaccctttattgctacaattttagaaataatatcgatgaatttataatagttgaagcttttgaatggttgttggtggaattgattcaaagaaatatatgatgtgcaattttaaagagatatgcgcttgatttgtgtgaaagaaagagaggttttgattgatttttatgaaaaagatagaatgattttgaaacatttataatatagtacagacaggtaaaaatctctacaataaatacatactccccctatttcactttactatttatagagttagaaaggtttttttttggaacaagggagacttttatttatataaaactaaggaacattagtacactgatccactgaatcattacacaaagcattaatgtcatctatggcatttagattaccaaaaaatgctagagttctacaagtgcttctaagcactagttttcttctaccgcttctatccctgtccgccaatatcctggccatgacatatgagggagatgtatcaaaataaactatcttattgataacagtctgactggtagcttccttggctagacggtctgctactttatttccttctctgaagctatgccgaagaccttctccttcatggacatcagcaacctgcaattatgaacaatagagttaaaagtagttttgccattttccaagatttgtaatacctatattgagtcagattcgatttccataggaagtaggtttctttctattgcgaacttcagactttgctcgaaagccataagttctgcatgggtgcatgaagcagcatgaactcttatgttgaagcccaatatccagtggtcattgtgatcacgcaccactccacctattctgcttttagctttattatgagcaccatctagatttagtttgtaccatcctagtggaggcttcctccaatttgtgctgcaactgagtctaaggtcatggttactttccctttccattagataatagaactcactttcttggttgatgatacgtggtaaggagataagattgtttgtattatttttcagattatagtttctgttaatccaaatgttctagagcaggaatgggagcaagtggttctaattgataatgttggaaggaaccaagggattactatgtctgatggcatctagccaattgtgattattatactttagcgcagtggtatcccaattaatggatttccaaaggtatgtagctatttcacaatgtagaaagatatggggaagggattcctcccctgacctacacacactgcaggttttgtcaacattcattccgatataatgaaggaaggaacggaaggggagtctattgtggcaacatttccataggaagaattttattttgtttgggcagtgtgcgtcccatacccatttgaatttattagagttattttttggcgcgggttcaggattctcaattagagagtagcatgaagccgtggagaaggatccattaatattgggttcccagagaaggtaatcataatagcgattaatgggtatagaaatgttggtgatgttattaatgatgtaggcggtagggtgaaggataacttatcaaaagatcaagtattattaactatgggatcactaatttttatttcgtgattcttaatatttaaggggccttctatacatcttcttagaaggggagtatttggaatccatctagcgctccaaatggagagggaggagttactatggattgcccataggcttcctttgttacaaatgtgccaacccttgagggtactattccatgtataggagtgcttcgattttctgttattgttgacaaatatttgagtaaggatgttggcccaaggggcagtaggtgagttaagaaacctccaagctgtactagttagtagggctaaagtcttggacttttctttacgtaatcccaaaccccttttatccttagtcattgtaattgttttccagctaataaatgaagtttctttctagattccgtagtacccgatatgaaacccctttgaattttgtcaattgagttaaggattttaacggggagaagggtgtattgcatcacgtgactagaaatacttgctagagtagagcaagcaagcgtagctctaccatcgatatttaagcagctcgatttccaaatggctaatctagctctcataatatcaagaatatattggaaatccttagctttagggatgaagttagttattgggaaaccaagatattttccaaatgaatcacattttttaattccaaaaaatttgaagatttcattaatgcagctatttggacaactttttgaaaaaataattttggatttaacaagatttacggattgtcctgacatgttgcaaaaatgattaataccatagaggatagtattacaagtcttactgttaatatggcccattagggtgagatcatctgcgataaagagatgagaaagagataaaccattcgttgatagcttaataggatcccacattttaatgttcacttggtggtttatgtatctagtgaacatttctatgcaaagaatgaaaatgtatggagatatagggtcaccttgctaataccatgacttggggtgaaccattttgtggttgtaccattgactagcacggacatagtgctagtagtaatgcataacatgatgagagtggtaatttttggagggaatttaaagtatatcaaagttttatggataaaggaccactcaagcttatcaaaggctttttctaagtcaagcttaagaatcattttgcctttcttactattacttttcctgaattgattcataatttcttgaattaaaatagtattatcactagcacgtctatttttcaggaagctagcttgaaaggggctaatgattttttccaagaagtatttcagtctattggtgatgatttttgtaatcactttgtaaattgtattacatagactgataggcctaaaattttcgaggttgttggcattggggattttaggaatgagacaaatgaaagtgctattattttccaataggatatgctgagtagcaaagatctattggcagtaggtagtaacactagggccaactatttttcaataactttggtagaaaaaggggtggaaatcatccggcctccgggctttataaggtttaaaaaagaataaagctttttgaatttcactatcacaaagaggtctatctaggctggatagatctacgtgatcaaaactctttggtagattagaattttttgacagaagatgggacgtagtaaaagcatcctcaaaataattttggacatgaagaaggatttcattaggattatcaatccagttcccagaattgtctttaaagtagcttatatgatttcgccttcttctatttatgacactaatatggaagaattttgtattggcgtcaccatcattgagccaattaattcttgatctatgtttccaatagtcctcttctaattttaggaagctattataatctttttgtaatgaattttcaagctcttgtagaaaaatactagtagcttaatgggggagcactgaatgccattaagtctagctaatattttcttatttttcttaaagatgtcccaaagattgttttactccagttggtaatattgagaacaaattcgtgtgtggctgatttaaaattattattggccttgaagtcagggtgggtcaccaaatttttcaagcctaaaaggtttgtgagaaggacatcctttaaaggagttaagcttaagaagtaagggattgtgatccaaataggttttaggtaaatatgttattgaggagcctgggaagagacttagccaattttcaatagccaaaaacctatccagtctttccatgataaggcctttgtgcctatttctgtgattaaaccaagtatacttacatcctttgaaccctaagtcgaatagtttacaattattaatatagttccaaaacgtattggttctagaatgatttattgctctagctccaaatttttcagaagccacagtaatatcattaaagtcacctcctaataaccaggctccattaaaattgctcgcaatatattctagataattccgcgtggactctcttatgtagacatttgtacttgcataaatagtactaagaaaccaataaaatttgtaggggatttcctctatcattgcatggatttcctggccccttctagtaaagttgtttacagtaacaactttgtggtcatagaagacaactaagccaccaacttggccttcagcgggcacctcgatcatttctgtgaagttataatcgttgagtagggctacatcggaggacatcctagtttcgagcaaggctactaagcaggttctatgagtatctatcagatctctaaagttcctgcgaaaatcttcattgtttgctccacgcacgttccaaaaaatgatgtttgtggctctattcatcattattggattttgatggtttgagttggtcactgcctccaaaggggaattggggttcgttctgctgcatggaactaggatcactgcataagagcccactgttgggtcccttggtggccttctatccatcgagcatttgtgcactgagggaggccagttgaatatgaactttttgctcatgttttccttgaagagtagaacctttacctcgtttaggtttgcaaactccacactcagctccgtatttagaaactccaattcttcctcctcctccatttgattttctctttgaccttgttcgttgggaggtggattgttctccatctggtttggcatgttgactagagcttggtttgcatgggagtcccatataatgagaatgggactgagcagggagatctcctttgggagaaagaaaggaagatccagagtgtgagggattgtaatatgtgggtttgctcgtggtgggaggttctagtggctttgcatggcttgaagcaggttgacattcatagatggtgcaagaggctgaagcacgttgttgatctaggtttgagtcatgaagttgttcatggctaacctcaccccctccgatataagttgggccaggtagggggtgttttggatcactgtgatagtgtcctgaccattgatctccatattgaaggagatcgcatggcccattaagcctgtttccatcctgattaggggttgatagtttggaggtagtggtggcgacgtgtagtaaacttttggatttggaagttgagggggaagggggggtaggttgttcatagttggacgaggggattgacggagaacttggatgagtctgtttctccttctaggtgagtgtggaatttttggcatattgagactgtttgggacttgaatgggagtttatactacttgtacacttgataggatgtgaggcagtagatagatttatagggttaggatatatgtgcatgggaatggggtggggaagtgtaacggatttatctgaagatttag

SEQ ID NO: 3 - DNA, 666 bp, Nicotiana sp.
atgcagggaatatcattagagtttgatcagcaaaattttcttgacaccatgcagcatctcttcaatgatcccgactttccccaaatcttttcagaactaaactcattcaataacaccatccaaacacctagaaacccaggttcagagaacaccatatttgcacaaaacatggttcaacgcaatcaagaaaaatatgcagatgatcatatcgtcccattgcaaaagacttcgtcagaaaatgataaggagccatcttcagatcaggtgcctttggaaaagaagaaatacaaaggagttaggagaaggccatggggaaaatatgctgcagaaataagggatcctgaaagaaaaggcgctagactttggctagggacatatgaaactcctgaggatgcagcattggcttatgacagaactgcatttaaactgcgcggttcaagagctgtactcaatttccctcacttgattgaatctaatgttactgaaattaacagagtgaggccaaggagacgttcacgttcaccggatattgagctttcatctgatcagcatgatggtccgatttcaaagaggagaaatgttgacctaattaacagcttagctacagccaacttggatagccaaattatcgtggagagatgtttaacgtctagtttttttgcctga

SEQ ID NO: 4 - DNA, 409 bp, Nicotiana sp.
aaagttgttgtatgctttgggcagtccaaaaccacacaaaagtgcattctcatcatactcaaaaatgaccggactgaagctgaatttttcaatgacaaacagacaggaaccaagtagtgcaaagacactgaagaggcatgaaccattgtggatggttatacaagatgaagctaatcaaaaacttgaggacaacttacgcgttgccatctccgaagaagcaaaagaggatgacttgattgaatcttgtccggaagaggcggctacaactggagatttcacttctaacaaaactgaaaaaaagaaagtgactcaagaaataacactcaggcaactcccaataagagctgcaaagaaaaaaggggttgccacctccaaatctacgaaatccaatagatacgacaacaaatga

SEQ ID NO: 5 - DNA, 513 bp, Nicotiana sp.
atgcactgtaccacttctgctactgtggatgatgaagaatgccttgatagttttaatattttttctacattttctaacactcaaaccagtagcaggaatattgatgaacttcaattctacttccagaagcaaaaagagccttgcacaaaggaattttcaccgttgggatggtggcatgaaaatggaaagcaatttcctgttctttttgctatggctcgggacgtgttgaatgtgccaatttcaactgttgcatcagatagtgcatttagccaagcaagacaacaacttagagacacctgtcactcattgggaagcaatgctttggaagttttagtatatttcagagattggattagatcagaacgaagaaatcaaggacgtgaagatgttgatagcctagaagatgaggaacttggagatatattaatatatggtatcccatccgaatttaacactccagaagaaggtcactcagttcatattgattatgaagaacttactaaggcaatgtaa

SEQ ID NO: 6 - DNA, 547 bp, Nicotiana sp.
atgtctaacccagaagaaaatcttggaactcccttaaattcatcctcatctactcgacccagtgtatccccaaaacctagactacgaagggtgaaaatgcttgctcgaatggttgtatcatctggggctctgaggaaggctttaaatgaaaggttgaaagcaagccaagttaaagaaagacaagctccaaattccgactccagctctgagtctgaatcctatcaatccgcagctgagggggaaggacatgggtcttctgactttgaaaagattcaagaatctccttctgaggtaagttcatctatgattgaaaacctagagattaggtttgttctggttggaccaattagagatgttgaagttcctgagaaacataggagtggaggtaaaaagaattttgaaaaagaaaaagatagagagggtgcttgtggtgaagatatgggaattgagaaaattatagtgcctgccatctgtggggttgaacatgaaagagtagaagagagtggcatgaagtcaaggggaagtggttctggggaagatgctaagg

SEQ ID NO: 7 - DNA, 225 bp, Nicotiana sp.
atgcgtttcatcgaccatgatacaccatacccacaccttgagattattagcgacaagcagagtccgcgcgcccaagttctaactttaaaagttcatcctccggtgataggtgctttcccgctcgctagaaagccgcttgacgcctcccttgatcttgcagaatggtcgactagagagacgaaggatgcattggacagattttcgggcaaagcaaccaacatgaag

SEQ ID NO: 8 - DNA, 1244 bp, Nicotiana sp.
gtctatgacgccatctttgcttcgttgttcacatatgactacaatgagaatgtcctccgtgccttttgtgagctttggcgttcatctaccaacacaatttctacctccattggtgaactctccatctctttatgggacttgcgagaaatcggaggccttccggtgcatgggtctttctacgacgaagttatcccctcggctaaggagttgacacaagaagacgatcaaggaaaacctttcctcccaagaagttgtctgcacctgttctcggcattctacaaactcatgaaggatcatgtccacaaggtctccattcgtgattgggtggagttttgttttcgaggaccgagtaggtatgccaagcctccgcaaaagtcatcaaggaatcggactacaaggccgaagttgaatcataatccttctgggaatattgacgcgagcttcctaccacgaaccgatgaggagaatgacccctttattgagcttggcgtggaggagtcacttagagctgagacttatttggcggctttccttgcatgttggctttgcaaatttgtgttccccaacaagaagatcgactacatttgtgctagtgtcttcaaaatcgcgagtctgatggctcatgtagagaagttttccttggcggttcccgtccttgcaagtatttatcacggcttgaatgaggtctccacttctcaagatttgggtgcctgcaaagcactctttcctattcattacgtatatggatggataggagcatattttgacacctactatcgtgttaagcgtccacaacgaggtccgcaaatgtgcaaggtttctggcgagaagatggacaagcattttgaccttagtaatgcccgtgagttgtttcaacaagttagtgcgcgacagcttcaccatttggctatgctacaagggagggaattgcatcttaccgatcgtgacgaacaatcgaattcttggagtgacttttttataagtctccgctcaagcttcatcacccttaggcatgacgacattcatattgtggaatcttatagcctgcataggtttagtcgtcaattcggcttttgtcaagatgttcctggcaacctcatagagcgaccctataacggctcactgagaatgctagtgcaattctgggactcctgtgttcgtcttggaggttcatcaaaggttattgtccctacgtgtccatcagaggagggacctctaatgactcgtgagtatgcagattggtg

SEQ ID NO: 9 - DNA, 533 bp, Nicotiana sp.
atgccgttgtctgaactggagaaacgagtaaatattatttcgttcaaatttactcccttttttttgaacactaaagttgctattttttttgcagttgggcgtcaatgagttgtatgatgatgtacttggtgaagacacggtggaagactgtgttacaagcccaaatcccctcggtgtggccacaaaaagtcctcacactttatttgatggtgttgaacatcatgctgcaaacaatgctccgtcgacagatttgagtctacccaaagaactgcacctcgttcttccagaagatgttgtgctttccaagccagccatgacgagtaagatggaggttgccgcaagtcaagcaaaacgtctaaaaaccttcgagcctactccatggccgttgcatcttgatgctccaaactttaagccacaagagattatttcacgtattaaactttcttttgttaacacaatatggcataccttgtgtgaatggatcgaagagttctctcttgattctctggatagcttcacaaagttggaggaaa

SEQ ID NO: 10 - DNA, 506 bp, Nicotiana sp.
atgttcctggcaacctcatagagcgaccctataacggctcactgagaatgctagtgcaattctgggactcctgtgttcgtcttggaggttcatcaaaggttattgtccctacgcgtccattagaggagggacctctaatgactcgtgagtatgtagattggtggtcagctcgtcgagtgaactcttcccgacaaagtactcatatcattttgaaagttccaaggaaagatgatattcctttatcctccaaagatgatcaacgtcaaaagaacactcacgaaaggtcttccaagcccaagttaaggtcgaaagatccttcgccaagcaccaaggtcttacccaagtctaccccttcgatggggcggggaaaccatgtggacaaaggagctaaacatgttttgttgacttccaagacaactactgccactgtagaggtgacgaacaatccttgcaaaaggaaagcgcctgctacttcaccaaacacaaatgttgcgaagacaaccaat

SEQ ID NO: 11 - DNA, 289 bp, Nicotiana sp.
atcgactacattcgtgctagtgtcttcaaaatcgcgagtctgatggctcatggagagaagttttctttggcggttcccgtccttgcaagtatttatcatggcttgaagaaggtctccacttctcaagatttgggtgcctgcaaagcactctttcctattcattacgtatatggatggataggagcatattttgacacctactattgtgttaagcgtccacaacgaggtccgaaaatgtgcaaggtttctggcaagaagatggccaagcattttgaccttagtaatgccc

SEQ ID NO: 12 - DNA, 852 bp, Nicotiana sp.
atgcgtttcatcgaccatgatgcaccatacccacaccttgagattattagcaacaagcagagtccgcgcgcccaagttctaactttaaaagttcatcctccagtgatatgtgctttcccgctcgctagaaagccgcttgacgcctcccttgatcttgcagaatggtcgactagagagacgaaggatgcattggatagattttcgggaaaagcaaccaacatgaaggtcctacttttgaagtcctccacccatcaaaaggccgcgtctgctagtcctccttattgtgattacgatggacgtctcgccacttggagtgttcctccttccgcctttggtgaagttcgctatacgtccaaatattgggagtgggtagaagatgttcttgcctgcaacaagttgactctagatggcatcaaggtctatgacgccatctttgcttcgttgttcacatatgactacaatgagaatgtcctccgtgccttttgtgagctttggcgtccatctaccaacacaatttctacctccattggtgaactctccatctctttatgggacttgcgagcaattggaggccttccggtgcatgggtctttctacgatgaagttatcccctcggctaaggagttgacacaagaagacgatcaaggaaaacctttcctcccaagaagttgtctgcacctgttctcagcattctacaaactcatgaaggatgatgtacacgaggtctccattcgtgattgggtggagttttggtttcgaggcccgagtaggtatgccaagcctccgcaaaaatcatcaaggaatcggactacaaggccgaagttgaatcataatccttctgggaatattgac

SEQ ID NO: 13 - DNA, 720 bp, Nicotiana sp.
atggcaatggaaatgaatccagctgacgaaaccttgtttttctccgactctcatctccttgaatcgataaagcaacatcttcttgacgattcagatttttctgaaattttttcgtcgatgaattctagcaacgaaatattgcctaacagtcctagctcaagttttagcagcttcgacttcgactgcagcttccttaattgggatgaaaactctgaggaaacattaataccaactgatcagaatccttcacatgaatcccatgaaaagtactccgagtccgaggagaaaacccagggccctggggtggcgcgtgagaaaaacgcgccgcgagattggacgcggtacataggagtgaaacggcgaccgtgggggacgttttcggcggagacaagagacccaagtaggaaaggtgaaggtgcaaggctgtggttaggaacttacgagaccgcagaggatgcagcgttagcttacgatcaagccgctttcaaaatccgcggctcgagagctcggctcaattttcctcacttaatcggctcaaacatgcctaagccggctagagttacagcgaggcgtagtcgtacgcgctcacccgagccatcgtcttcttcatccacctcatcatcagaaaatgtaccaaggaaaaggaatatagatgtgataaattccatagccaaagccaaattcctttgtcatagcttgaatttacagagattagcttaa

SEQ ID NO: 14 - DNA, 1167 bp, Nicotiana sp.
atgggggacgtttgcggcagagatataagagatccgaataggagaggcgcgagactgtggctaggaacttatgagactccggaggatgcagcattagcttatgaccaagccgcttttgagatccgcggctcgaaagcacggctcaattttccgcacttaattggctcgaacatgactaagccggctagggttacagcgaggtttcgtatgcgctcaccggagccatcgtcttcagcttcttcagaaaatacgacaaggaaaatgaagatagatgtgataaactccatagctaaagtaaaatttattcgtcatagcttgattaatctacaaatgttggtataattgtgaggaagtaaggtttcttcgtgtttaacaattgcaatataaattatggaggcggtttcaggattttaattttatgggttcaaatttctaattctaccgctttcatctaattaactaggttcaaagtctattatttttgcacatttagtgaatcttttaaaacatatacatagtctatgccaaaatttagggaggttcaaaaccaaaccttaaccaaaaattgaaccacaaaattggcttaatgtcttatttgtatcgggttatcatattaactgttggtgagtggattgaaattttataattaacgatttattggttttgaggcgaattattcaattttcttaacggataaaccgttaacccgttaagaatttttatatttgtattttttacccttatgtatattaaatatccttccactatttaacaaacactacaagaaatatgtgatacggcgacatttaattagtgacaattaagataaatgtccgaaaaaagttaatttagtgacatttgttagaaaatgtgataagaataccgacatttgttgaaaacatgtcaaaaatattttgacatttgatttaaatgtcatattattaggaatataacaacatttaattagtaacatttataacaaatgttaaaaataattttttcgcccaacaagaaaaaataactttaagcactttatgggcctttaaacttctcttctttttacagaaatacaagaaagttaaaaataacattcaacccgattcctccacaactcttcaagccgcaaccatctccgtatctttcactcattttgatccaaatccgccg

SEQ ID NO: 15 - DNA, 291 bp, Nicotiana sp.
atggtctcaagggaaagaacaggtcccacggatgaagacactcaggtgaccactttagctgaaaaatctgcaccaagcatacgccgagtgaaaattatgcgtgagcttggtttgatggctccttctggccggtatccatttcataattaaggggaacatgtttcttcatttattcccaagggacatgtttctgctccttccaggtcttcatctcatcctaaggaacgtcttcctccaattcagagaatagttgtttgtggtctatctgctgctagatccgttatgaagtag

SEQ ID NO: 16 - DNA, 1256 bp, Nicotiana sp.
atgtcttcaccaaaccctaaccctaggagagttcccattgttgataccttccccaattcccccattagacataaaagaggaggtaggcttcgtagcttagggtctactcgtggtggtagttcgtatatacattctcctagttctggtccttcttctagaactagaggttccctttctcacaaatcttcttctagtggtaaagaaccttctaaaccattacgtgagcctttagtagaggagatagtccctacagaactatctttttaccatgatagggaatctcttaaaaatcatgtttctgctttagatcgtggtgatacttaccccactcaaattacaaaagttttgactcttgtagttcgcaaagattgccattggagtaatgattttcccattattatccctaatccaaatcagagaattacttcttacttgactgggttctcttttgttatacatacccttttactttagggttcaaaccagttattgacccagtcattcttgaatttttccgtttctttaatgtctgtttgggtcaaattggcccaatcatatggaggactgttggatgtttgaggcatttaaccaatatggctgacgtttcctttactttccctcacctgattcatctttactcccctaggcttttccgtaatagcgtttttactctagtggccaggagtaagagggttttggtgagccctgaagatgacaaggatcgtggatggtatgcccggtttgttgctgcccccagtgttggcttagtgggtaaggataacgttcccttctataagaagtggaattttgcacgtaagtcttttatccttctcgtgcctttttttcttcaattttatcaacttctctaattttgcccttttttagcaaccatgggagttgtggaggatattccaaatttccgtgattgggtagataaattgctgaagaccgcaccaatagatggtaggtcttggagaacactttctaaccattacggttggaaagtaaagactcatggtaagagtttttatttcatctttcatgcatatatatatttttctttatttctctaactcccatccttctttttatcaggatttgctattcgaggagttactgttgaagcagttgcgacctctcgtgtctcttcgggaacccgtactccttcggggacccgtatatcttcagaaagagcccgggaaatagtcttgggttcttctgcgaaaaggaaagctgttgaaagaggaaaattctga

SEQ ID NO: 17 - DNA, 684 bp, Nicotiana sp.
atgaacccagctaatgcaaccttctctttctctgagtttgatttccttgaatcaatagaaaaccatcttctcaactatgattccgatttttctggatttttttcgacgatgagttcaagtaacgcattgcctaatagtcctagctcaagttttggcagctccccttctgcagaaagtagcttggatacctctctttgggatgaaaactttgaggaaataataccacatctcgaagagaagtccgagtccgaggaggaaacaaaggggcatgtagtggcgcgtgagaaaaacgcgacgcaagattggagacggtacataggagttaaacggcggccatgggggacgttttcggcggagataagggacccggagagaagaggcgcgagattatggctaggaacttatgagaccccagaggatgcagcattggcgtatgatcaagccgctttcaaaatccgcggctcgagagctcggctcaattttcctcacttaattggatctaacatgcctaagccggctagagtaacagcgcggcgtagccgtaggcgctcacccgagccatcgtcttcttcatgcacctcatcatcagaaaatgggacaagaaaaaggaaaatagatgtgataaattccatagccaaagccaaattggtttgtcatggatggaacctccagatgttactataa

SEQ ID NO: 18 - DNA, 564 bp, Nicotiana sp.
atgaattcagctgatctttccctccttgaatccatacagcatcatcttctaaatgattctaatattccagaaatcttttcagctatggattccaatagccctagttcaagttttagcaactctccttctacagaaaacaacttttactatggtgaattaacaccattgataaaccctactttagtaggcgccactgaaaagtctcatgaatttgaagagactaataataaggagactgtggcggcgaaggtggcaaacgcgccacaagattggaagcggtacagaggcgtaaggcggcggccttggggcaagttcgcggcggagataagggatccgaataagaaaaatgcaagattatggttaggaacatatgagacaccggaggatgcagcattggcttatgatcaagccgctttcaaaattcgtggctcgaaagcacggctcaattttcctcacttagtcggctcaggcatgccggagccggctagagtgaaccctaggcgtcgctcgcactcgccggagtcgtcatctgaaaacggaacaccaagaaaactatttgtgtaa

SEQ ID NO: 19 - DNA, 627 bp, Nicotiana sp.
atgtacgaacaaacaaccatctcagattctgatctctccgtccttgaaaacatcaaattccatcttctaaacgataatgatttttcacagatatattccacgtttgatcaatgttttagtaatgcagaaattattaatagcccggactcgagttttggtagctctccaacagaagaaattagctggggcgatatgttaactagtgtcaataccacgtggcaacgagtcgataatttggagtacaaggaggaaacaaagaagaaccatgtggtggcgcgtggtgtgcacgcacctcaggattggaaccggtacagaggtgttaggcggaggccgtggggtaaatttgcggcggagataagaaaccctgataggaaaggcgccaggctttggctaggaacttacgagacacccgaagatgcagcattggcttatgaccaagccgcttataagatccgtggctctaaggctcggctcaacttccctcacttaatcggctcgaacatatccgagccggttagagtggctccgaggcggcgttgcctttcgccggagatttcatcatcttctttttcgttgtcatttgtaaaaaatgtacctctaaagaagagaaaattggctgaaaattga

SEQ ID NO: 20 - DNA, 7495 bp, Nicotiana sp.
atggatatcgaacaaaagcaagcggagcacatcgactactttgtgaaacaaacatcagcgctcaagggttctgcccttaacaacgttattagtgaagccacttcgcatccctcacttttcgctttctccgagattctttctgttcccaacgttgttgaggttcctgcttgttctttctgctattgatttgatttgattatattttatttttctgatttggattagtcggttttgtgtcgaactgtttgtatttctgtgtttttttctaggtttcgtggtatttacagtacacattgtgttgtgtttatgttatgttattgctttggtaatatctagaatatgatggcattttttctgataatttggctactgggttttcatgtcacattgaatcacttgctggttttctgtgtgctttctttatgtcagtagaaaataaagaacatgtagtgtcagaaccccaagtaagtgaatattggaatcaaaccccagcagagacaaaaggaatgaaaatcatgaaatgcagagtggaagtaaatagaatcgagatactacgaaattgaacaaattttagtggaggttaaggaagcatagtggatacagtagattgttgaggaaacaacttggatttgtcctcccaatcccatcaagttcagagcattaggccctaagcatattgagatgggtattatcccaggttgtgattctctttagagttccttttatgtcaattagatataaatctgggaataagtcaccttgatatactattggcaagttgtgttggtaactctctgttgccttgttgctttatgtacactttaggatccctttcacatttgctgctaatttgtttttttgttggacctgtatgcagcttgaaggaactgaaaattcaatataccttgatttgctccgtttgtttgctcatggaacgtggagtgattacaaaagtaagcatacatttttgcatctgattcacttctttttttactgggtggggtgggacggtgagtagctgattggatgaggttttcatgtttgagatttcaacaatgttctttttatgctgttttttataaggaaaagttctttttattgcttttatgccattttatttgtaactcttcatctgcccgctgtcagattaaatgccttaagttttatagtacggggaacttgtaccttatcagcttgagatattttttgactctaaaagactatgctattttttccatctgtataatatcttgaagattcttctaattattaaacatcacattattacaatgttgtatctccaaaactgagtatattactggctagaaagttgattagggcatggcttagctgccctttctactgctgtgaattcttttcattatcatgggtaagtaacactgttacatccttaactatgccagtgctcgtgtcacttaccttaatacttctcttgagtgacaagtgtcacatttagcagtgatttccttctattgatcctagtgtgaaagggatggaatttcatatgcaataagtgctaaacatacaaattagggaaaatatcgtttgtgaattgccaatgaacatattaccgaagagggttgtcttgtaagaggaagatgatgtactccggagttctatattacctgcatttcaaatttgtcagttttagcatgtatgtggttctataggtattgctggccgtcttcctcagttggtgcctgaccaagttctcaagttgaagcagcttactgtgcttacgctagctgagacaagcaaggtacagtatattgaaatgtaataaacatttggcgttgtaatttatcctttggcgaaagtgagcaattgctgcatccttattaacatcctttcttcagttggttattgctaaaatttcagaaatgaagcttgtaatgaatgagagaaatgtcttagctttctggtgcttgtttgttggagcttttgaaattttgtttttggtacctgatcaggataatggatacaatctatttattggtaaatttaagacattgacgttgaattgaatcagtattcttaaagttgttttgcttaggcctccctgagtttgaatgagttcattgttgcttccttctttttgttgctgtgtaacatttgagtgttacttcaacccactataataaagtacatcattggccatgactcaaataatgccattcaagtaaataatgggatactttgttatatgcctactttgctcaatgtcaacagctatatatcgtactattcatgagatgtctcctgcgacttgcatgattagcatttctctcaagtacatttctcatagcggaatagaataaattttatgcattattttttcgagtctttgacattctttttttgtgtttcttcactataacctgttcatatatcaaaacctttgatattcatattgagtatttgtttgacttttgtttcactgataccgtttgttgttagtcactgccaataatgactcctttcgtctttccaggagcttccatatgatcaacttatgcaggagttggatgtcacaaatgtgcgtgaacttgaagattttctcataaatgagtgcatgtatgtggtgagtatcacctctcatccctggatcattgtgttattaatggaggtaccattgtaccgtcctctattgaaagtgtgttgggctaaagtttattgttggaatttgcttctgctgatgttcaagtggtagttttttgccttctggatagaagttcaactcaatcttttaatgtggtttctgttgcctcataggttatttctggccctagtttttcctattccttctcttcttcacttctttcccttttttttggggcgatttggtggggtgtgtgtgtgggggggggggggggggggcgctttgctgctaataattgatttaatgtttcaggctcttgttaaaaaattcactaactcccatctttctgtatccatggatagggcatagttagaggaaagcttgatcagttgaaaagatgctttgaggttggtactatgcttttcctgttttgccaactcttggttgcaatgggctgaaatagggtaattaactgtcatcatacaactataggtacaatttgctgcagggagggatctcagacctggtcaattggggaatatgctacaaacattaactgactggtatgcttatgttttttcccttcaaaaggggttatgtttatgcttttatctagatgggtctaattgcgatgccattgtatcttatcgtattttctgagtgtgagtatattatttagttatttctttgtgggctttggctgtgcattgatccttcctgtcaagattctgttgtcctatttatacagcaaacatcttctgtccacaaatagctggtcttaagggttgttgttgaagttctttttctgtatttctcctccatgtcttgatctcctgtgcttcataatgacttactgagctgcaatttgtaaagactgatgttttctttctttcttaaaacaaagcagtcagctaggctataggagtgatttgagttacacctgcttatgggatcttgccatttttccagtttaacttataagaacttggtgtttaatggaaacatatctatgtaatttcaagtagaattcttacttatcagaaaaaaattaagctgaagtctttaaatttctcaaagcaggatacctgagttcaaaaaagaatgctctgatttttgaaaaaaattcaatgctgggtacctaaataagataattatgtatatctatcaccggatgagaaataaacaagtagatgctattagtagattgaataagcatttgatgaaggaattctcttcaattaataattgaagggcagagaagcagttagtgaaaaagttgagttcagtcaccttatttttatcgttcttctttattcttcatcatttctttttccctttttaagaaaagcgagtgcagcctgtttctatttggttatggagatgccattcttgttgacctacattattgatgagcatatggcatatagagatttagttgctgttatttgaagttcagcactgctggtaaaaaacaagaaaatcttttaggactatgggataggatatgtagattgcagtgtttctggtaaagctcttatatagtaagttaggggggaggtgtttcctcatatggatagacaaccagggtcccaggaagacatgagtttccagtggaggttcggtttttttattgaagtaagatttgattaaggaagatgggcagaaaacttaaaggctgagttttgattaaggaagatgaaaacaggaagataggcttgaagactgagatttgattaaggaagattaaacatgaagatgtcaaaagtgagtgactgttcattggaactgttacaatctgaatactcataaggtaggtcaacaccccctccccccaaactgtacttgcaagtttccccgcaaaaagctcttgttttctttgacccacggccgagaatcggtagctgtgaaacttgctctggcttgatgaatgactaacttttagctttttcctagggcataaaaagagtttatgctggtcgaggtaaatggatttaggaattcatacacggttgaagggaaaaggcaaggaacttttaactggcatggtatgagaggaaagagaccagccttaggcctctttacctaatagatgtgtcaaagaccgttgccagctactgcttgtcgcaaacaagctcttcccttctggactaggagtgatatgccctcgatcgatcaagggctaaaagccctaatgaagactgagatttgaagaaagagtgaaggtttttggctggggggtcttgcctttgatcagttcgttgtcttattgatggagcttgaaatgcagaaggtaaggcaggcagcattgcatatgctggtgtagtagctcaaagatcttggccccaaacaggaggaggaaaaggttgggccctgctgtccagtgcggaaatgttgtggggttctgggaattctgctccttgctttgaaaaggtgaaaagtagaaaggtgttcgacttttcaagggaagagccaatagtgaaatgttgtggttgttgaaaatgtcaaaagaaaacaaggtagaatgaggtttttggggtactttaatttgagcgaacttggaggcatgcaacaagtcattatctcattggatcattttgcgcctcctctttggctttttctgtaacttagttgcattcatgttgggttctattttctaccaaaatttccatgtctagctaccaaaaaattgtttagttcagatttatgtttggatgagtccttgtggagtccttgtgtctgttgaatgatttagtagtcaagaaattggataagaatgaattgtgtctaacatgtgcgcaggtcatgtttgacgcaaagttgtgctaagagctgtcaacacaaactttcctaggtgatggatctctgtcctctagttttctaccaaaatttcctaggtgatggaactcatgttgggttctattttctaccaaaatttccatgtctagctaccaaaaaattgtttagttcagatttatgtttggatgagtccttgtggagtccttgtgtctgttgaatgatttagtagtcaagaaattggataagaatgaattgtgtctaacatgtcctcaggtcatgtttgacacaaagttgtgctaagagcggtcaacacaaactttcctaggtgatggatctctgtcctctagtttaggaatatagactagattttaacccattattagtagccatttttgacatagaagcatattattccttacctgttctggttttaaggttagtatcctttgaaccaacccattaacaagtccatcttggaccccaattttggaaacatcattttgtcaatgttattcatcatgtcaagatgatcatacattttatttgagctaataatgaaggcatcctgccaaattcattcatgtcaatttacacaatggttatatatacttgtttttttctcgataagcatatatacatgtgtgttcttcttgcaactatgaacaacacaattttggcaatgtaaatagtaactgccggctgaaattatgtgataatctgacttactgagtacagtcccactcagctttttaagccataaatcaaatgtaaattgagtctgtggagttgaggtataccaccgtagttaggcgagggataagattataggtgtttgacatttttctgtacagtgtggtgtatgcctcttacaggagggccttgtgaactgtgaatgtttcccatgcaaactatgagacatagccatgatgattaaaaaaagctgtgaaatttaactgtaatttttcaacctacttgctaattcatttcattttttttgatgaaaaacataggttgactacatcagacaatcttcttatctcaattcaagagaaaatcaaatgggcagatacaatgagtgaatctgacaggaagcaccggaaggaagttgaggaaagggttgacgaagtgaagaagtcactctctttgaaggtgagtcaagtattgtgtttcaaaagatgagctctgttaattctaaaccataaatgggctttccacaatgcaccagaccattggtgatcgtgcctttcataggatgggcttggtcaacctgggatgtgattcttttgggtagagaatgccttagtagttcgctcatttgagtcttagtaaccctcatttcatatttaagcacttcgttatgttgaagactcattttataattaagcactgggatatttttgtcgatgtgtcttacttactctgtggcagaagctacaaactgtaagcaggccgatgttgacttcagagggcatgaggagatctactctgaatctggtggagtgatggattatgaggaggaccgaggtcgaccgaagaggtagtagtagtctaatattcccgggattaaactttatagtcatttagcagctagtcatggtctgtatattgacctgtgagatatgtcatattaaaacatctgattaagtcctattatttgctaatccgtaagtgcagccaatggggtatagtgtcttggggcggggggactgctgggtcacttaagtcaattccaatgccattgtaaagatgcttcaaaccaaaaatttggatctattgtttcatgcgtgttgactgctagagaccctggaagcctttactttcaaattgtagaatgagtttaacatctatacactggccgtgtaaaagtattttttacattataaggtcacctaagagataacactacaggtgagtgtctgtaactaaaagtagaattagtaaacctggaaagtaaggtagttagaatccacaaagatttcttatattgttagtgtataacttaaatctttatagaattgtctctcgtctgctgatctttttacttgtaaaatttgcaggagacgacaccctattggttaa

SEQ ID NO: 21 - DNA, 396 bp, Nicotiana sp.
atgaccccggatgagaaatactttcgatgcaaattctgtactcaacatattagcggcacaattaacaaattgaagaaacatttagcagacactcataaagggatagagccttgtccgaaggtaccggatgaagtagctgaagaatgcaagaaggcattactaaagcttcaaaatgtaaaaatcatgagaaaggctacttcggaagaaatgcgagttgttgcaactggaagtggtaacatggatggtgaatcaggttcttctccaactatgagcaatttgcctccaaaggctagaggtctgctggatgattttgttagtgctcaagcaagacaagctactttaaactccaaatggaaaaaaagaggaaagaaaagaagtttgtcagcgaattggtag

SEQ ID NO: 22 - DNA, 11691 bp, Nicotiana sp.
atggtgaaaccacttgccgattcgcgcagcaacagagccgccgttcaggccaccaacgacgacgcttccgccagcaaactgtacgtacgcctttttattcaactgtacagtaactcttcaattttcttcagttaatttcctagatgtaatttagagatatacagttgtataatagaatgcttcagagaccatctatgaatatatcattttcactgcaaattattggaaattgagctgaaatttaaacctaattatcctcaaattccgtcttatatgattactgttttttatattttgtgtgatgtgaaggtcatgcgtgaaaaagggatacatgaaagatgattatgtcaatctgtttgttaaaaaacccctgaggcgatctcccattattaatcgtggtatgatatctctttttttgcttcttaatccatggtggtgatgtgcttagtgtttattttttggggttgtttaatagatgtgtaacttaattataaggttattttgctcgctgggctgctcttcggaagatgctctatcaatttcttgattgcaacccaaatgctgatggaagtggcaatattaagaagcagatattgtcgcttggagctggcttcgacacaatgttttttcagctgcaggtgcttcagtttctatgggttgttttaatatcttccatgatgattgaaaatttcacataaaggatcccaaggcacattttgtacttttttcacaaaaaaaggattttctttttgtagccaatccaatgccctgattccaactagtttgggagttggaactaaggcaaagctgacagtatgctattgcagttctggagctttagtatggtcttgtttacagtgtctattcatgtatcaattttcctccatcttgatcttggcgacccttaaatgaagttgtcaagagaaaatggaggttaagagcaaaacgatccctcaaatgggttactgtacgtggaaatttgagcatctggttcaggctacctgcaatttttgttgaactaggctgacagtttgtgatagtagaattttgctttatgttaagatttttcttatattgcttgatgctgcttcatgtagttttccaatacaatagatacacgcttgcacgtttactgtaatttccatccttcagaaagaagattaatagctatatttgtctttggcaggatgaaggaaaagcacctcatctttacgtggaactggatttcattgaggtgggattttcaaatgctaagtccccgaattatgtcatagcataaacgaggcaatattttttgcattttggcaaatccattttactttcttggctcaaagagctcagctctagatgtttgtctcacaggtgacaagcaagaaggcagctcttattgaaacctatagtcagttaagggataaagttggtgaaatagcatcaatctcatcaggtaatgagcatgttcaccgcttgcaaatatgcaaatactcttctcttgtgaactgccaacttggtgatccctgcctttcatttatcttgggcaaatatatgatttcatttccttgacaagataccatgttgttgagcgcgaggtggatacatcaagcatttaatctctgtcatctaactttctgaaccatgtcattttttaatacaatatttgttcaattttatcttcttagtataggttgaatcagtatgaaggaaaaacgttagcttttaaagcatcttctgtgacagaagggtgttccttttgtgcaaagcggaatctagcttttattcacgactacacgatgtttctttgataagtcaaaatttctctactaaacaccaagttggatgtcaaaggaatgtacaagtaaattatcattttaactaactcgaatgtggtcatccacggtcatctaacaagtacgccagttatctttattgactttacaacaccgtattttctcgacaccagaaatccaagtgaaatatgatgccttttacatcatatttcacttatttgaagcaattttctactattaatttttcgccataagcacaaaaaaagagacagtggtgatgtttccctcttttcgctgaactctccagcttgttgttgcttcctttacttttcttggtatcactcataatatttgaacaatgaaatacaagggtccacatttgtgaagccaatatgcaatgcaacaaaagatgattagcattgtttttagtttttttttggtcacatgcaatgctggctcctaccttcaccgggtaggaataaggtctgcgtacacactaccctcccctcccagaccccacttgtgggattaactgggtttgttgttgttgttgttgttggctcacaagtcacaagtatcatcattctctttctcaagttatccgctataggatagcatccttttctgaacctactcttcatgtcctctatctgacaactccacataaaaaggtttggttgtaaaatatcttactcggtctccctccatactatcttatttccccactcaccccacccccacttctcctacagaggcatcgtatattttgtgaaatttccttaatgtcatacttataacattcatagacatggatcaccttcttaaaacatatattccatataacgccttgagcattctttctcaaataatcaattacttctgcatctttctcgtttattagaccatatacctgttaatatgtattctccaaggatattcaccgggcatctttccaaaaccttaccctacaaccctcactcacctagtaagcaatacattaaagtgaattttcctgctccttactacacttttacagtgttactccataagatcttgtctagtctctccattgttctaatatctatacttactacttagtagaaattatctgtctacataaaaggtctgctcttgagtgaatccccacaaccgttttctaagagtactatattgaatacggacaatctcctgattcccaatcccctttgcttatggaaaccaatattttcatccataattccattccacttaatgaaatgttttctccccatccattccttcttactgagaatctcacagcattttctccgaccaatttgcgccacttgcgtgcatacaaaccatagacataataagtggtgtattagcgaggtagactttcataatgttattttccctcccttacacagatattttcctattattctcccccgtcttttctcaaatttctcaaccacaggctgctacagattttaatctaattttttcctccgatcggtaaactaaagataccttgtaggtagtgtaatcaattttggtctacagatttgttgtaatctaatgatgttttgtacctcccctactggtaccaactggagtttcaaatatctacacatgatcctggcacaactttaaaccataccaaatttctgaacaagtatcgaatatgtctaatctggggttcacaagaaattaaagtatcttctgcgagtagttgatagatatggttacattatttgtcctatcaccgcctacctcgatacccttgatgacacctcattcccccgccctatgaataagtttgctaagtacctccctcacaagtagagttaacaatagaggcaaatgatccccttgtttaatgatccccttgtttcatgcagaaaagggagaagtccatagtgatcattacaaattgcttcctgtagatttgcgcaacatagacaatttaaatgatgttatagcccgtgcaaatttagaccccaggtttgtcgttgcttcattgctatattttcttaacatttttttctttaatctccacgaatgaagcacaagttatgttgaaggattttaatgtattaggtcttcctttgtcaagctcagtgagttgtgcctaaccgcctctaaatttattgctactataatggtaagtgtaatatgacaagctctgtttacatctatgtcttgactatattacaatcctggtggaacaaaattacttgatgtgaaagatgtggaagtactacaagtaatctaaattgaccagttttagattttttttttgagactggtaacaatatattaaaaaaaagaaggcactaaggcagtgcaaagccatatgtacgtgggggggatgtgaaaactgatccaccagacttacaaaaaacctaacatgacaaccagggactccgtattctttacatgcctttctttacaccaaaaataaaacaaaagaatacaattcatcttaacattctgaagagtattgtatctgtcttcaaaaactcttgagttcctctctgtccacactgtcccccatacacaagcaggtatcagtctccaccatgtcttctgactgactacacctccaatgttattccaggactttagaagctctagagtagttgcaggcattgtccatctgaggcccacaatgttaaggaacaattgccacaatttactagtgataggacaatgcagaaacagatgactgttgatctccagatctctgccacataacaaacatctcgagcataacagaaatccctttctttgtaggctttcttgggttaaacaagcttctcttgctaccagccatgagaaacaaaccaccttaaagggagcttttgctttccatatgttcttccaaggccatcccactgtatgctgatctgcatttgtaagcatgaaataggtggatttgacaatgtataccctgtttttgcaacagtgtcagaataaggtgtcctcattttcattgagccctttgaacccttccaaaaccttaaaaaatagcaattctccccatttcccaatcattcagaccccttctgaaagtgatattccaaccatgctgaccccaagctgcttccattaaaatatcaggcatgtttgcaatactgtaaaattctgggaacatctctttaagtggaccatgcccaagccaattatcattccaaaatagtgtcttcctaccattacccacccttgtgcaagtgttaaccaacacagagctccatagttgtctgatagattccaaacacctaccccataggaactgttaacaggactagtgcaccactgctcagtttgaccacatttctcccttataacctttctccacaaagcattagtgcctgagttgtatctccacacccacttcataagtaaattttggttgtgtgccttgaggtccctgagtcccagacccccctgccttttgctggtgataagtgagctccaatttaccaaatgtatggctctcaattacatcaattcctcctaagtgcatcaattacatcaggtacatcttttgggttataggcgagtacagagcacaaaggcattgtattgattttggggcatcatgagatcttaaccctgtaaaaacagtagagctgacaaaaaagagcaaggttatatagttcttttttttccccaataatggtggtgtccaggccagtttgcacgtgcctcgacgattctgcctggtacctgctacctgctacctcccactaacataggtgccggtaactattgccacataggcttagttagtggcagagaggtgttgtgacttgtgtccaaagaatcatgtctcttagcatgtaaagacttgtaacttgaaagccatgatgagctattaaactaaaaagttgggttactgctaattgtggttgcttatagttaaagattagggactacaccaggaatcttgtagttaatagtcatttgttggacaactgaaaggcatatagggtataggatatttggatacagaacaactttttcctggttgcgcttaacttgattaattggctgttaggttcttttgcagtttacagattctacgctactattcattgtattggttctcattttcttccttcatttctccacttttcaaatttataactgtccttattaaaaagaaacttttagaatttagatctatcttgtctcctttctgattcccatgttctgaaaagacttatcattgtacatgtccaagatcatacctgttaactgcacattctgatgttattatcagtttgccaacatttataatcgcagaatgcgttctgatatatttggatcctgattcgagccgtacaattgttggatgggcttcaagaaccttttccacggcaatatttttcttgtatgaacaggttgttgaagctattaagttaaatcttggattctttcctgagcctgatccatcccttggtcctattaacttgagttctactgctctactttcctaagctactgtgaatgtcctgctgatgtattataatgacttatttgtatataatttggcttattacagatccacccagacgatgcttttggccagcaaatgattcgtaacttggaggtacttttggctgattacttttttgatgattgagcatatctgctccctcaccctaactcgtttttataaactcaacaccaatgttgaccttgaaatagactttattcttcaatgtatgtgtaacaacattataattcctttttcactttccagagccgaggctgtggactactaggaatttatgctacaccaactttacaagagaaagaaaatcttttccttgatcaaggatggcaggtatttccaaagtgcaaatctgcttcttaattttgacattaagaatcaccatacctttctgtcaaaaatttaatatatctaagatgttaatagcctggattaggcctatgacttgttcctccattccaggtgtaggaggcttatttagtttttatacagacttgcagtatttccaaccatttgccttgtcatcccatctcctgtaatcaaggatggtagaagatttaattttcagctgaaactgcctttctgattgagggtcttaaaccttaaacatgatctagaagagaattattgattagcttcattgtaaaccaggaatactatccaatatgataaataaggctaataaatcatctccttaaccactaactatttaggtatagcaggttagataaaagcacatgcattagttgcttcgaacttgcattagttgtaagctcaatcttttccaattactgattaatttgaacagttacatattgctaaatactaacagtggtttagctctagctaattcattaactctatcaaagaacacatgtatttataatcaatggtttgtcttttattgattgcagaaagcagtagcttgggacatgctacgagtttatagtgattttattgaagctcaagaaagacgcaggttagtatgagttttgattgtgcttgtacattaatttataaacatgggaatgatatgaaatgatatgattcatctgaaggtgatgatttggtgctgcaatctagaggcatattactggctttaatgaccatactaagctacccaagatattccaggtttagtcagagccttagaggtctgtaagtctattttaccttcctgtctctcacccacacaaagggggagggggggggggggaggggggagggtcttcacatgcatattgtcagggtaaatgcttaattgttgttgcatgcacaaggctctaggtaacatgtttgggcacttgatctatctatacacagtctggttgttatttggtctcatcgttgtttttgtagaagtttatctttcaatcgtataggtttcttcctattcgcacagtactcttgtagctccccatttcaatatcatattaatttgtttattaactctttgtctatgtctatcatgtcttcatataatttttcaagaaaaaactgcatatagatgcttcaattgtccacaattagataccatagtgccattttatctcacttcagcgtaattcttcttatgggtgcggttgacccccgtgcagttttgtcagttaacacaatgtcatctgcaaatagtaggcatggaaccttatctttcaaggcaaatcctaagtttaaacctattgtcatgggaaactcctctcctatgtatctcctctgattattcacacttgtgttggctccttcgtacatttcttttatatgacgcttagcctggtttaagtctattgtgtgccagtctttctctctcatttttgctagtcatgcatctctttccctctcctgcatccctaactattgatagaagtcatctggggttttacctcaagcttaatagccttttttagcttctagtcgagtcttatgctcttcgaaggtttcactatctcctgcttttggtaatttcctataccactctttttttgctttaataactctttgcacctcctcattccacaatatgattcttctatttgagatctgagacttgtacacatacctaaatcttcacttttatgcaacttgtcatttttccactgaatatatgcatccctgctccctccaattgtttgtccttagtgtcactaccaaattcttgataatgcaactcttctcctcccttgctccactcttttgcttcagatcagtaggagttcttctagtataaccttgtagtttttacatgtaatgatgctttctagaagtatgaactctgttttgctatggttatctcttaccttatgttatcaagtgcgattctctttttctaaagtatgtatcagttaaactactgcataagttaagaaactctaaaatagtcttcactcctaaaacctatctcctgcagttgaagttgtctctgtctaccaacatgtctattcagatcgtcttcagtaaaatatgttggtcatttgggatccttggaccaaagtatccatatttctccgcggaatattggcactaatgatgttgaaagttttctttctccgctgactagacaatccgtcactatttcttatttactcctataactttatccttaggcactggttgtacaacgatcccggttttcattcctgttcttatctatttcatagtaatacattttataacttgtgtcgtaactctagcactttcttgattcacctactctcttgtagacacacctcatctggcctaaaagaaaggaaaaaggtagatttagtacatcatcctttgggacattgtagaggatagaaatcagagatgttttaaggagttcatacttcatagtcctactcaaaatttgaagttcaaatcttagtatctcagtctctggcattttggtgtaggtttgaatttgtaaattatgcagcagatgattagatgaagtacgtagagcgatgcaactacttatatattgtaatttccactttgtcgttcttgattcttcactgataacaagtgattaccttgtcgcaagaaaaaaaattcaatatttgagaaaaataagagacacattctagagaagatcaaatactagagatctgatgctaagattttggtctcatatatgattgtgtgtttattctttttatctgtaacaatcaaaatgctttatttccctatgaaacaaaattgaagttctcttattttttagaaactttttatgctacgaagctactatggttttcatgaaatttattcgtgccttttttaggttctgatatatctttttcccaggataaagctgattccctatttttcttttgccccttttcacttatcttatgttgcgcttggagaactcacaacttttgcagtctcaaatatacttgtatgtgattgtctggacaggattgaaagattggaaatatttgacgaatttgaagagtggtatatgatgcaggtaagtttttatcaccccttctgcatttgactgcaaaaattattcagtgtgtttgcttggaatggtgtgaccttatccataccactgtgaaagtagagcactttgttccagattcgtagatgggttggctatctttcaccttgcaaaacgaatttctggcctgtaaattttgtatctggcatcatattattctacaatctgtaactgctggataattaacctgtaagatgtcattatacaacttggaagttggaaacgatgagaaagtatatccaagttaaaaattacaaaatgcaggcttctttactttggtcaattggcgtattcagacttgccttttcttgaccttatgttttggaggagcaagatgctgctctttcttttattttttacatacgaatttattttagggtccattgatgctttacctatacatgtcagctgttttagtcgaaagacaacctttctgtatgatgttatttgaatgatgatgttagtgatgtagtatctgaatcttcctctgccaatcaaaataagtcattgatgtagtagaaaagaaaaaaatctaagttaggtgtactgtttcttatgtcatgtgctcacatgccttttgatcaggggactttggctgtttaaaagttcttaatctgttacaacaatacatttgcattatgtaacttgggatcttgtaaactattagtgcttaatgtcaacagaatttgggaatgaatacataaaatttgatactcccctcatcatgtagaccctgttagactaagtggaatttaaaaatgaagaagaaaaacaaattgaaatagaatatttcagtatactggattaatttacagaactgctaaagtttcggaaaatggattgtttgatgaaaacgtcttgtaccaaagctaaaggcaatataaagtagtaatatggtggtaacttgaaatctacgatctggcaaactttcagcatctaggagaagaggtgaagtaaattgaaatggacgaaaaagatagtaagacttgaggaagtatttgaaagacccaaaaagaaaaaataccagaggggaaataattacaccaaatggctgcagtttctttaagtgacagccgaggtagatttaatataatcttgcttttgaatcttgtcacatctttcaaatattgcttctactggaaattcaaattagatttactaatgtgtgaaactttatttcggtcaggatgatattcttaagcttcaaatatatccatgatatgactatgtcacccccccccccccaaaaaaaaaaaaaaaaaagatccatgagatgaagatatttatcatgtaagaagaccctacatagtgaaggttgaaaactttatgaagatgatgatcaggtatcagaacctaagagaaaagttgactcatagcaataagtggtacgtttctcaagcattgatgtgtgatacagttcacattaacaaagtacgcaaagtttaatttgtggtccaaattgctagtccatcctttgccagtttatgctcgaaggggaagttcatgttagtctattcagtatttttcttcttgcaactgtgtctgttaatgaaagattgcatagttatacgtctgtgatccagtttgctggtccatctcttttcagatcatgctcggggagaaagcttgttttatttcactactttatttatcttgtataatgttcctcttcattcagaaattaatctattttcttctgaaatcccaattgcaggagcactattgtgttacatatgcaatcaacgatgctatggtatgcttatatctcttctccattaaactatctaattcattctagacttccaggagtacttcactaatcgtgtccatctttaatgtgatctatattacagtgtctgttcaaggaatttggtttccccaatacacagcctatgacagacacctccattgcaacatccacatga

SEQ ID NO: 23 - DNA, 4733 bp, Nicotiana sp.
atgggttgcacggcgtcgaagctagataacgaggacactgtccggaggtgtaaagaacgccggcgattgatgaaagaagctgtttacgctcgtcatcatttagcttcagctcattccgattactgccgttcactccgtatcaccggttctgctctttccaccttcgccgccggtgaacctctttccgtttccgatcatacccccgccgtcctcctccgtacaccctctactactaccaccaccattaaaaccccagctccaccacctcctgttcgtatcccatccccctcaccttcactccacccaccaccaccgccgccggcattttctccgtctccgtcaccgacgatagcttcatcaaagctacctcacatactttcttcctcctctgtttcctcccaccacaaccaccaccaccgtcagcctcagccgttacaacaacggaaaaaacccgtaaaacttccacacattctttcgggatcaagcttgagttcatacaatgaggaggattatacgtacgatgcgaaagcgaattcgacgtattcgagtactccttcacaaacttcctctgtttggaactgggaaaacttttaccctccttcccctcctagctcagattactttgaacgcctccgtaaagtggacacaatggatgctgacgatgagcatgatgatgataaagcttcaaactttacatcttattcacactactctcagcatcagcatcctactactgaccaatcatcacttagtgggaaatcgcacaagcaaaagtttgattttttcgatagtcatagtgttgatgatgagaagttgactaatgggtctgttaggaatcacaaaatggtgggtgaaaacaagagaggtcaccatttgaataataatagcaagtgggaggatagtgaagctgagagagaagaggtacagtgcagtgaatgggaccatgatcattatagtactacgagttcatcttctgatgatgatgaagaggaagaaaaggatgagataagatctgggtttgggccaacccggtctaattttgggtcaatgaagagtgaggaagcttctaagattggtgatgtcaatttgaggatgaagagttattcagggaggaaatcggataaggtatcgtcggaggatggagggtcgtcttcgatgagttgggggaatgggaataatgggaaagtggtggaggagatggtatctgataataggagtatagtggtgaggcacaaggatctagctgagattgttgctgccattagggactactttgataaagctgcttctgctggtgaccaggtctctgagatgttggagactggccgagctcagcttgatcgcagctttaagcagttaaagagtgagtctttttggattcttgatttatgtggaatgcataatgatttttttattttccatgccttttgatgatttgatcttggcatagcaattagatggtattgtaattttctggaattgcatttgcaagctcacccatctgagcttcggttagccagtttagagtctggataaaggaggggaggggtgtggtaggttagtgtttggggtaaaatttgtcaaattatgatgaatccagatgattcataccattggctacaactagtttgggattgagattagttgattgacattgatttatctttcccctgagatccagttgggaaaattttgttgaaaattttggattcattgtttggaatttaattattgttttttttgttcattgcagaaacagtgtatcattccagtggagtatttagtaccataagctccacttggtcttcaaaacctccactggccgtcaagtatcgttttgaacctagttccattgatgaaccaggttcccaaaagagtctttgttccaccttggagcgactcttggcatgggaaaagaaactatatcaggaagtgaaggtgctcttctcaatcccgccttagtcttcactgcattcttttcactttctcggtgttccttaccaattggtcttttatgaatcatgatctcagttggttaactggttgtctgcaaagatagaaaagctgtagtgaaatctactctgattcaatcaagaataggttaaaatatactcaataatcgtaattgggtatttgtactttagtcgagtgacagaagccgggttttcggctgggaatcatatgcatgttattgtagtcagaggtgtcaaaattggacggatcatgcttatcatccaaacttcttcagattattcagcttgtgtaatctaacttgtttgcactccatttagtcaataatggcgtaatgactagagtatccaaggtaactgcatgacttgacaaggacaacttggagctattatgagatatattaatttagatgcaggtggccctgccttgtactaagttagctctaaattgatatggacttcattttgaaagacttactccttcttccttttgtggttattactgtggaaaagagtagtataagtagtgtgtttgagcagttttaaaataccttcaactccttatagacaggaaactgcttcttgacatgatctaaaattattcatggatatatgcgtgtctctgcatatatgtaagtacatcttaagtaagtacatcaatgtgttctttttatttggttattttgatgagactgagtacaaaaggaactattcaaaagaatagaaaaagacaaggaaaaaaagtaggaaaaaggaagaggaaaaggtttgccaacttgagcaactgcttctttgcacgtgtctttagccctacacatttgttaatccaagtactgtaaatgcaggcaagggaaggagttaaaattgagcatgaaaagaagttggcaacattacagagtcaagaatgcagaggtgatgaggaagccaagttggacaaaaccaaggcctcaataaagaggttgcagtcgctgatggtggtcacatcgcaggctgtttcgactacgtcctctgccattattggtctaagagactctgaccttgtcccacagcttgttgaactttgtcatgggtaagtccttatgtttggtgcatacttgatttggaatttattgactgcaaatcttattcagattatttgctgtcggacacatgcatgaattatgggttcaaatgagatatggttagtacttacgtcgcgatactgctctgaagcaacatcaactacccttaagagattaaagaagtttggttacatccttaccgaaatttcttccaagctttattttagaacctaaatcaccgagccatctcaagacttatttccttaaaattgaattgataacctgaacttctcctacctaaaattggcatcttctatagtcatgctctcaaagcatgttggtgttgctactggcctgtttcagtgggtagttggaaaattatttatcttttaatgtgccttgcttttgtcttcctgagcccctaagcttgtccacgttgcatctttctatagtctaacagcctctccaggacaggttgtggtcatgatggaaccactatttctggaaattgggaacgtctactgtgctttgacatgtgtaattgatggctaaatatggtggtgcttcttaggctgatcattattgttgccttgataagcttaatctaaaaagaaaaaagtagtgttcttcatggtagttacaactgagccaggtcaagtcaattacagtactaagctaaagtgttatggtcttggatttgaaggctaaagactcagtttctttgacccctggaattttgacaattactataatgattgctgtggacatgtgtgctcttctactaggaagaaagttttaaaagattgtctatgtttatgttttgaacttgaatggcagcttatgataaagtgtttactgttttctaagttttgcccctgactagtcctcaactgatattggtataaacgggtgcagattcatgtacatgtggagatccatgaaccagttccatgaagttcagaatgacattgtgcagcaggtgcgaggtctcatcaatagagcaactaaaggtctatcaacgtctgacctacacaggcaggcgacacgtgatcttgagtctgctgtatctgcatggcactcgagtttttgtcgcctcataaaatttcaaagggactttatccgctcccttcatggttggttcaagctcactcttgtatctgtcaatattgagccaactaattgcaacagagaaccttcagattcatttatgttttgcgatgaatggaagctagcccttgaccgtattcctgacactgttgcatcagaagctatcaaaagcttcataaacgttgtccattcgatatttgtgaaacaaacggaggagttgaagatcaaaaaacgaactgaatctgcatcaaaggagcttgagaaaaaggcttcgagtgttaggagcattgagaggaagtattacaactcttactccatggttggcattggacttcctgagatgggacctgataatggtagtgttttagatacacgagaccctcttgctgagaaaaaggctgagcttgcagctagccaacggcgtgtggaagatgagatgctgaagcactccaaggcagtggacgtaaccagagcgatgactctcaacaacattcagacagggttgccgggagttttccaggccatgaccagcttttcttccttgatgacagaggcccttgaggctgtatgcactcattcttatgctattaagtag

SEQ ID NO: 24 - DNA, 2831 bp, Nicotiana sp.
atggaaaggatacatgaagtaaaacaaccaccgaggcaattccctttagaggctaaggtgacacatgccttttcaacttccaggaaggagatcggtgttaaatgcaatgtgcaggacttccgagattttgacttgtctgttctgagacaaacatggaaaggaaagacctcgtatcaggaggaagaggaactcatgatagatgctggttcagtcaagcgcagtgatgattcacttgaagacagtggctctacttcatttcatggagcgagtcatcctccggaacctgttgatacagacctaatgagaccagtgtacgtacccattggtcagaaaaaagcagatgggaaatgcttagtgaaaagcatgtctttgaagggtcctttcctagatgatctttcaatccgggttcctaatgtgaaaccgagcccatctcttctttcacctgcagagagcttggttgaagagccaaatgatctgagtgtaatctcctctccgtttacaattcctcgtccatctcaaaacacagaagcaagtctgcctcctgactccgaagagaaagaatgtatttgggatgcatcgctgcctccaagtggcaatgtaagcccacttagtagcattgatagtactggtgtggtgagatctatgagcattgtcaacagttgcacaagcacgtataggagtgatgtgatcatgagcgatggcatgcttagtgtggacagaaactatgagagcacaaaagggagcattcgtggggattcacttgaaagcggtaaaactagccttagcagagcaagtgacagcagtgggcttagtgatgatagtaattggagtaacattactggcagtgccaataagcctcacaaaggaaatgatcctagatggaaggctattctcgcgattcgggcacgtgatggtattttaggaatgagtcactttaggttactcaaaagacttggttgtggagacattggcagtgtttatctttctgagcttagcgggactcgctgctattttgcaatgaaagtgatggataaggcttcacttgcgagcaggaagaaactgactcgtgctcagacagaaagagaaatcctgcagttattagaccatccattcttgccaaccttgtacactcattttgagaccgatcgcttctcatgtttggtcatggaatattgtcctggaggagatttacatactctacgacagcgacaacctgggaagcatttttcggaatatgctgcaaggtatgcttttatcattctatctagaactagaatatgcagcataaaaattatcctcccctttcacatgtagtcctgacataagcataagcctctgcttattttggcattccttagatgttatgatttatcacatccatttctcttgcaccatcgttctgacttctgaacatgtaagctctcccctgtagaggagagagtcctcttcatgcggtcaagagttcgagcctggtaccctgacaaacaaaaagctctcccctgtagaggatatggttactaatatgactttttttattaactctcgtccacaaaaagaatttctttatctgccattaattgcacctttacttgccaaaaaaaaaagtgattgtttcccatgtcatatcaactcagaccaaattagatatttatcactcttggattttgatgtttgtcccactcaatccatatttgggatcctcccataccaaatagtttgatcctacttggaagttttttccagtcattgggtcttaagaagagaaggtggtaaatatgtaatgacatgtctattgatattattaaagtctggttaactaatattattaaagggcttttcgtgctaacaatcttccacattttcttcatttgggagattttagaatctttaccctcacatttctgtttaagctgttgagttccttaatcaaactttaacaaaccccgcgtttctgccacaggttttatgcagcagaagttctactggcgcttgaatatctacacatgcttggtgttgtgtacagagacttaaaacctgaaaatgttcttgtgcgtgacgatggccacattatgctttcagattttgacctatccctaagatgtgcagtttcacccacgctcataaggacatcgtctggcgatccttctaaaaaaggagccgcattctgtgtgcagccagcatgtattgagcccacatctgtatgcattcaaccagcatgcttccttccccgtatatttaatcaaaaaagcaagaaaagatcacctaagcctcgagccgagactgggcctccagctaatgcactgcctgagctagtcgcagaacctacttcggcacgctctatgtcatttgttgggactcatgaatacttggcccccgagattatcaagggagaaggccacggcagtgcagttgattggtggacatttggtattttcctgcatgaactactatatggtaagaccccattcaagggatcaggaaacagggcaactcttttcaatgtagtaggccaacagctcaggtttccagagtctcctgcaaccagttatgccagccgtgatctgatacgtggcttgcttgttaaagagcctcaaaaccgacttggggtgaaaagaggagcaactgagatcaagcagcatcctttctttgaaggcgttaattgggctctgatacgttgcagtacgccacccgaagtgccaagacccattgaggcggagcttcctgcaaagtttgggcaagtgaaccctcttggggttggcaatacgagtaaaagagtggtgggaacagatgcaaaacctgggggtaaatatcttgactttgagttcttttag

SEQ ID NO: 25 - DNA, 33624 bp, Nicotiana sp.
atggctgccgccgtgaccgagaaaattatgtcgccgtcgcctccgccctcgcaacacatgcatctgtcgccttccacttcccggcgtggccttgacgccgcctccgatactgatgctctcgatcgccgcccttcccttgatctttcctctgcttcttcccctagcccaacacgattatctgatgctcaggttaccttcttttaaattaatttgttcaattaatttctactcgatattgcattaggagtctgaattatgaattaaattccacaattttagtgtatactatatgaattttatgggtgatcatagcttcaaagaaagtttctactctggtttattgttgcatgcaaatgaagaactcttttacttttcaagagtttgtcacaatcaactaactaaatttaaacaaaattggagttgtggttggtgaatgatttgactgtgtgtggctgattgcaacaattatcaattttgtgacagaatcagctgtttgtgaagagtgaagagtatcgacaactgttccgtttaccgcccgatgaagtgagtatccgtctcttatgtgttaatttctctatgaatttgtttgcattgaattgtggcagtttacttatggttatatatatatgctattttgtgattcaccaggggcggatgtagtgaagaagctacggttcattcaatcttagtagctttggcttaaaccctttatatgtgttaaaaaacccattaaataagtaaatataatagatttcgagcccagcaattggactggatgtagtagaattccgaatccgaacccgaacccataaagtttaaatctggtgaattcaccagggtatactctgacctttttcccttggtattttaatgtctttagaagtgtcagtatttctgattatcatttcttgtttgaggcttaatcctgtaagacaacaaacaaattgcaaaactagtaccaaatatcaaagttctttttttggcgtggttatggaaataacttctccggctatgtgcaaacacatctggtcccacgttggaacaaagaaagagcattgtagtcagagaagttgttttgactcgggataatcttaggaagaggggaatgccactttgttcaagatgctatttgtatgggtaggatgaagagacaatcaatatctattttcacactgcaggattactagtcaactttggtatttgttcatcaacattagaggcattagatggccaatgccaggtagaccttctgatgtgttgacaagctggaccaaagaaggaactgcagctgaaacaaagacaggtggaaaattgtctctggtggacagtatggaaagagaggagttcgagatattttgaagataggagcagtttcttacagctgattaagattgattgtgttcctctttttagtttttggcgtaaatctgaatgtatagatgatcctgaggctctcctatatgcgctagattccttgtaagaagatcaaggttttattttggtttttaatttggtgccatggtttaacaatttattttccaccacaacctttgtgctgatgtctctctcgctgtctctctctctatatatattaaagggcagtccagtgcacaaggcattccgcgtttacgcaacatccggaaaaaggccgcacccaaaatagacaacctaccttagtgcaagcattagtggttgcctcgatgggtcgaacccgtaacctataggtcacacggaaataaccttaccattgctccaaggttccctttctctctctctctatatagaatgttgccttctccaaaatgaaaaggagcgttgcagtaggttgacaaccaatgtaaattaatgtagaactagtctgactatgatcaaacctctagagcggaatggtacaaaagatttgtatagctgactccaaccaatttagggttgaggcataaatgggatatgttcctgtttgagatgctctacaagcttaagaaaacattaggttgttcacttaagcagatgcttcctagtgcttgttagcaaagaaattatctagaaccgtttactcaaaaagtacttagccttcgtgtgtccaagtcataccttgatttgcaccccatagtgtgtcgttctgccaagttcaatttttgtacatcttatcttcatgtccatgtttcgaaacaggaatagataatgtgatctttagatccttttcttttacatctcttcacttaagttgttgattgagcatgtcttgtggaatctttatttcatctgtatgaagaatatagttccacctcttctttcccgtggctgaatgcagctttcaaatctgcatgctaacagatattttatgtttatgttctgttggcctgtataaattctttacaggtcctggttcaagattttaactgtgcgctgcaagagagttttctacttcaggtaaacttgaactgtatgatgtttcacatctatccgcattaaaaagatgatattatacatgtatagttgaacttgtggcttcttgaaccaccctaatttctaatatgtaacattttcccttcctttctaatttgtttacacgcttttgtgcgttggttaatgttttactgttgttacagggtcatatgtacctctttggccattatatttgcttttattccaacctcttcggctttgagacaaaggtttggtgttctgtttttttttacccttcaataaattcaccttttataaagcctatagttgattgagataggttttcactactgataaggtgttcttctctgtacacaaatatagctgagattttgtctgtttcgattatgcaattattttggaattgctattaacaaaatatttactagattcacggggtcaggatagaggttatgtgcctgcatgagaaggaaaatgcatattttgatttgtttggatttgttttcatagcactgcttgattgagaaggcttcatgtgattcaaggtagaaagaagaggaagggaaggttctatttacttagaactagatatgacaatttgtctgtacaaggtgcttacgtgctacccacctgaaatgggtgcattagagaaagtaaacattccaagtaacactaggaagggtttggctcacatgtttgatgtttggactgatacaacaggatataggttatagaagggatataggcaaggatggtaatgatacgacctctcatgtgcggtgggatgtcatatggaagagagattcgaaaagcttatagtggaatgctctattatcattccatcttaagcagtttgttttatatgagagttttgtgaattgaaggcgatgaatatttgaacaacaaaggaccctctgtttcctatgtcttcctttttatccccccccccccccccccaattctttgttctggtgccatatacagatttcctttttttatttgtcgtgttgctttcctgcttggcaactgttgacatattttagtctcgatacataaaattcttgctgctattgtttgcaataggagggtacaccatcatgaggtcctaagaatgtgtttaaaggattgctttgtctgtatttcattgtttggccttgttatttaagttttaagactgactaataagctccattcaatatttaccaagaattatactgcatgacatctgaggatagcttgtttcctttttttttttggataagtaaaaagggaatcaaggaaaatatagtaagataaataagaaagtttctctttctcatctgttttgctatacatttttaccttgatgtaaattaagttatcaatatccatcttccagaaaataatacattttcatgagatcacgtcagtacgaagagctaaagctgcggccatattcccgacagcaatagaaatagtagccggagaaaagaaggtaatgtcctggatttgtgatgccatttataatgccatatgttttttttaaaacatgatgtatgccatgttaatgctatatgcctgttctcctttcagattaatacttcctcggcgtagtcttgacttgccttctgttaatgcagtacttttttacatctttcctgtcccgagatgaagcttttaagcttatcaatgatggttggctacaacacaatggtgcagcggaagagtctacagatctggtgtgtcgtcacttacatagcttgggaatttataaaatgtgtttaggcttgttgcaatatggagcaccccccccaccccccaaaaaaaaaaaaaaattctattttttggttaatgctgataaattatgaatactccgtttgtgctattttggttagtcagtaatcagtcgctctccgtgtaacctaacattgatgcattccccagttccttgaaaccttgttatgttacttgttattttcaactctaaaggcaagtgtgaaaaaacataattttttccagcataaatttgaaaagaaagatgccgcagcagtgtaagggtattagtattgaatgttccaagtagaatctctattacagttttgactttgctttttggatttatttccttcacttcccttttagtcgtcatctgtgcggaatcttggtattggtggtacatcagctacataagtaaagggaaggatttagtcatttagcaacctaagtaagtggaagatttagattttagacccttcaaagatattcttctttgtggaaatggaacatggtatgcaattaaaagttaagcaatgccaagaaggcggcgctttttactagaaaatctaatatataacttgcattctttaaatgaaaacacctgatagtaaaacggatggaatctacccttcattgccaaagacgttattttggtattacgaatagttgttcccttaatcgccaaccaagcccatataatttggaggcttctgtgcctcacttcattgcaatgggttgactcctggataagttgtgtgggcaaagtctcagacatgtgccatgtgctacttcactgacatcttaaatttggttgtgaaagcattggtgaccgtgtcctttcatctcccttagcctgttttctcaccataatggctctgcataagttacgtgaaaatttggacattctacctcttggttttcttctattcatttttctcttattttgcaaagagaagtttgagaattctctttatattcatcttccaagaaatatctgtttcaatcctgaaaatatttcttgctgatgcttttattttttttgggccttctctttgcagttctgactgtgtttaactttgctttgacgtcaggagccaaaatctgatctaaacagtcaagatagtggaataccagaaggaacagatagtttcaggcaggctatggaaggggtagaatccctcgaaaggtatctagagtcaagttaggaattatcttcccttgcactggagttatttcagtctgttaattcatgtgaccaggaataaggatgatacagtacaggaagactcaaagcccttggccaatggcgaatttgaaattgtatcaaagcctttaggattgcagcgcaatgtggaagaaaaagcagttattgttcaaagtactgattgctcctcttctgggaggtcctcagctttgaagcaggaggattcagatgcacctcggggtcagtcaaatgtccctttgggctttttgttatgtgcttcttcattcttcaagtgtgttaaatgattttctccattcaattaattaacaatctctggtttctagtatttaaagaaaaattgcttattcgttggctgatatgttgaagtcatgtgcattcttttgttgcaagatgttagatacttatgtgtaaataatcttagtcctatatgtagtaggagcagaatacgttctagtcccatatgtagtaggagtagaatatgtcctagtcccatatgtactaggagtagaatatgtattatatatagggctcattgtatcattgttaataaatagatttttctcccatgcattctcacatggtatcagagcttagtgagaaaattattgttatgcgtcattccagcgacatccgggaagaaagatctcatagccgtgcaattttccggcaacttagtcttgttccagggttcatcactgctacagatacgaaacccttgtgcgaccaaaccctagaaattcccgtcctatctgaacagaaaagtcagtcaccgtgtgtttttccgattgactactcaagattgatttgcgttatctcctcatcggtaagtgtttgtgcaaaaaccaacactaccatcttgttcgaaaaagttaggcgacaaaacccagccaatcgctctgacagaaagtcacgcgccgccagaactagggttccgtcgagctacagtaacttttccggtgcgtgtaagccattctggccactttttgacaaaacttcttcaggacaacttactcgtctggtgattcgagcctacgcatataaattacatcaaattctgacaacttttattttttccagcgtaaacagtgcacttcaggcatgaacagtgatttcccggtgtgaatagtaatttctagaaaagttctgttttctggtggtgttttagaacctattttgtagtgtggaattcggcgtagtctcaatattttcaaatttttccggcaacctttcggccaacttctgtttatcagcaaccacttggttttgttgcttagggggagtcgagtggccttgtatgtcgaataatcaacttgcagatattttcaccaagtctctcacgagtcctcgtattagttacatatgtaacaagttcggtacgtatgtatgcacctgcttgagggggagttttagatagttatgtgtaaatagtacgagtcctatatgtagtaggagtagagtatgagcccgtttggcttggctgatttattgtagctgataagcattagatgctgaaaaacacttttaagtgctggagctgatttaaaaaataagcagttatgtgtttggataaaagtgctgaaattaataattagcagctgaagaactgagtatacgaagatttttattttaaaaagaagtattttaggaatagaatagtaaatattttggtcaaacctaaagcgcttataagttgaaatttgataagttgggggagaccaacttatgacatttggcttatttttggtttataagcacttaatttataagtacttttaattttaccaaacgcgtagataagccaaaaagtgtttataagtcagtttgaccagcttataagcttagccaaacaccctctatgtcctagtcccatatgttgtaggagtagaatatgtattatatatagggctcattgtatcattgtcaataaatagattttctcccgtgcattctcacacaagaagtatgtgctcatgttgcgttgcctgtatgtttacttcttcttcataatactgagaattgcagtgtcactagtctaaaacatgaaacggaattagagctaaatgtaatgcgcaaagctaaatctcatgtaactctcccaaatgtgctaacgtgtaacaagggaaaaggcaggaagaatgaattaaactacccggtgcatttaggaccttcaagttggaaagtgctgtcatttttatcttccacaccttcccagataacatatagtgtgcccttatcttggtctggttttctaatcctatttctttgcctctatctgctaatatgggattaagctgggtttgttgttgttgttagtccgctaatatggtatcagacgtgcacatcatgaagtgagagaactgtctgctaataaggtatcagacgtgcacatcacgaagtgagagacagttactaggacttatgagcaggtttactttcctcgtactagacagatgttatctggtattctcctatggggtgggtgtctattctcagagttctgaccacaagttaatgctcaagttctgtttgatagatgcgtactttcagccagaaacaagattctctttggtacttgtatccaataggttctaaagctattaaagcaattgtttcttggattccaccagcaaaactttccttttcttttttatattctgtgtttgaaattctattcagttcctgatttacctaaactttgcattatttgacatgcagtccctgaatgctttacacttgttgcagaggccaagtttccggtgatataactttatctttttccctagttctttcatttgttctgaatctctagttttcttcatgatggatgtgtaattaatcttagactgttatttgaacttaatatttgaggtgcaggttacggttgagaagttctttgaactcttcatttcagatgacggtattgcttttcaggagtcattccgtagaaaatgtggtgataaaggtgacagtattcatggattttgctgacgtggatatatttcagcgcattctgtcagttagatttagaagcaatggatcacaatgaactgataagtaattatgtggttaaccaaaagttttccgtcctttttccccagattttaagtgcacacagtggcgtcctcatgaagaacttgggcactctcgtaattggtcgtttcagcatcctattaaattctatttaggtgtgactacacctctatatcaacaatttaatttcaaacatgacttgagcactctcaagtgaatcaagatttatttatttttgactaatttatggtttgattaggtgcaaaatttggtggctgccatgaggtacagaactatcgtttttatagaaacaggtaataacttctactatggcgctactatagttcactgattttgcttttttttttttttaagagatactggcactttaagttctctttgatgctgtcattctctctgctgctccatgcgttagcttgtctcttacatgataaagttctttgcataacatcatttttgtggttacatgtgagtttctccgaaagcaaaagcttttgagtcaatgtaattcaatgaccggagagcatagatttgtggaaagttgtctagcttacgtgctaagaatacaggattccctaatttcaatgcacaatgtatgctgcaattttctcatcatatcaataacaattaacaatttgctgaccatatgattcttctaaggtctatcatcaatatatttaaaaaaacctttcatcttttcctttttggtaactttagctttttgtcatataaaagcatatgtaaagcacataaaagataatgttttctcacagccgatatatgatatagatgtccgagaatcatattggaaattttttttagtggatcacgaagcagaatcttaataatttggttggcttaataatttgattgtgcgccaggttccgcctacagagaatctattcataggagaggatttcaatggtcatattggggcgactgcaggtggttatggcgaggtgcatggagactttggttttggggagaggaacggaggaggtacattgctgttggacttcgctgaggcttttgggttggtgattgcaaactctagatttccaaaaaggaaagagcatttgattacttttcaaaatgcggtagtggagacctagattgactatctccttcttaggaggtgtgacagcgggttgtgcaaggactgcaaggtgattccaagtgagacactctcgtcgcagcatagacttttggtgctagatgttggtattaggttaaagaggaggaaaaggtctgctcgggaaaaactaagaatcaggtggggagccttgactaaggataaaacccaagagttggagtgccggttgtcagctatgggagcttggaggagcagtggggatgcgaacactatgtggtcagcgacagcagactgcataagggagtctgcgagagaggtgttaggggtctcgatcggtgtctctagtaggcataaaagagactggtggtggaatgaagtggtccaaggtaaagtggaagcgaaaaaggcggcatacctgaagttagttgggagattaggtgagtaggagaggcgagcgtgcatggagagttataaggtagctaggaaggaagctaaaatgtcggtcacggaggctaagactgcggcttattgtcgcatgtacgaggaactgggggaaaaaggcggggagaagaagttattccggctggccaagttgagagagaggaaggctcgagatttggaccaagtgagatgcatcaaggatgaagatggtagagtagtagtggaagatgcccagattaagaggagatggcagacttacttttataaacttctttacgaaaaaggggatcatgatattgtgctaggcgaattggagcattccaaaagtcaccgtgacttcgggcactgcaggtgtatcgaggtcgaggaggccgtgggggctatgcgtaagatgagtaggggcagagcgaccgggccagacgaaattccagtggaattttggaagtgtgtaggaagagcaggtgtggagtggttgactgggttgtttaatgttattttttaggccaagaggatgctggatgagtgcaggtggagtacggtggttccattgtataagaacaaaggtgatatccagagttgtaacaactataggggtatcaaattactgagtcataccatgaaagtatgggagagggtggttgaagcgagggtgaggatgacaacgtctgtatccgacaaccagttcgggttcatgcctgaccgttccaccacagaagctatacaccttgttaggaggttggtggaactgtacagagagagaaagaaggatctgcacatggtgtttattgacctagagaaaacgtatgacaaggttcctagagaagttctccggagatgcttggaggcaaaaggtgtgtcggttccttatattatggcaattaaggacatgtatgatgggctaagacctgggttaggacagtaggaggcgactctgagcattttccggttgaaatggggctacaccaaggctctgcgctcagttcattcttatttgccctggtgatggatgcgataacaaaccatattcaaggggaagtgccatagtgcatgctattcgtcgatgacatagttctgattgatgagtcacgagccggtgttaacgagagattggaagtttggagacagactcttgagtctaagggtttcaagctaagcagaacgaagatagaatacctcgagtgtaagttaagcgctgagccgggggaagtggacgtcgatgtgaggcttgagtcacaggttatcccaagtagaggcagcttcaagtaccttggttcggttatccacgggggaggagagatctacgaggatatcacacaccgtattggggtaggatggatgaagtggaggttagcatctggagtattgtgtgacaagagagtgccaacgatactcaaaggtaagttctacaaagcggtggttagaccggccatgatgtatggggctgagtgttggcttgctaagaactcacatattcaaaagatgaaagtagcagaaatgaggatgttgaggtggatgtgcgggcatactaggatggataagattaagaatgatattcaggagaaggtgcacgtggctcccattaaggacaagatgcgggaagcgaggctcagatggtttggcatgtacaaaagagaagcccagatgctccagtaaggaggtgtgggcggctggttgtgaaaggcacgagaagaggtagagggcggcctaagaagtattggggagaggtgatcaggcaggatgtggcgagacttcagatttccgaggacatgacacttgataagatgtggaggtcgagtattaaagttgtaggctgggaggtagttgagtcttgcgttactttgtacctttgtgagcctagtctggtagggttttgtctaagaacgctaggggcaacgtcgtgtcttactattttatttttcgacgttggatccatttactagccaccgtttttggtttgcatttttcttctgcattttatgttcctattttttctatgatctccgtgatgaatctaatatcctctccttttgtcttctttttattatcttgagccgagggtctttcggaaacagcctctctaccccttcggggtaggggtaaggtctgcgtacacactaccctccccagaccccacttgtgggattttactggattgttgttgtttgtttgcttaatttagtgcctgaagtagcaagtatgttagtaatttgggtggcttaatttagtgtcccagtagcaactatgtcatatttcaaatgatcatgttaattcggaacttcttaggcgattaactgagttaacagtggtttaacatctaacatcaactcttgctagcactcctggctatctccatcctctggatgaggtctctgccttcaattaaggggtggttggacaagcataaggtttggcaatctaccttttcagaattttacatggttgtggagaggaattaatgatgtacggacaaacttgtaatagcttttgaggccctaagttgcagcctaaaagcgttaataattggtagacagaagttgaaaggggaactgtttgagcactaagttaagtgacgagagaatgaattaaacgaatgccgtaaagtgatatatggacaaacacacgtagtagtttttatatgtgctctaagttactgataaaaagactgaaggaagttaaaacaatagatgtttcgagggctctgggttaagtgataagaaaattgaataaatgacgaagaaaatgtcacttcctgcatggtagatcttatgcgtcaaagtacgtctaaattgacgctacatgtgcaaaaatatggaagaggaatagtgggaagggggcctcatatagggaaaggaacaggagaacgtttgaagaaaagcagaggaaggttctgcaactagaaatgattatgctgatagattttgtagctaaagactcctttatgtagattcccttccatttgtgcaggtgagcttttctttcttgccataaagtttattttgttgtaggagaaagcattgcatcacacaatgtgaaggaagcaaatttatctgaaaaattctttgatctttctattaaaaaaattatctgaaatttctgtattagctgagcagtctgatatgcaatgatatctttgtagatgctagaacttcaaaaggatgtttaaaaccaactctaacaactaatattacccaaactctacatagacaaccttaaacctttcactataaattttatgctcggtgctgtaacaactaataattaccaaattatcgtagttacagaaatatccacaatactaaaagcttgaaatatagaaagtacaataaaaagattaattgaaaaggtttcgaagtctcagtttgtatgcatgtgaatacacacagataccaagtattgatgtaagaagacatttaaactgaagaatggaagataggaaatctgatccaaagtctgtatctcaagaggagtgaatatatagatctttcgtattggttttgagaacatttgttgtgaaatgtggcccgacatcaacaaaagacaatagctgaaatgtggtctcctcaaggatggggacttgtatttaggagaatgttgaatgattgggaggtgactagattcactgatttctacaaacatctggaaggcttcacaggattacagaatggggtggatacactaatatggcagggacacagcagtggcattttaaggtgaatgcatcatacaagattctgagctaaactgacatgcagattatcagttggccttggaagcacatgtggaaaatcaagatcccctaaggtggcctggttcccatggttactagcaaaggaggctgttttgaccaagacaatcttatcaagagagggatgccactatgctcaagatgttatctatggagaagatgttgagacaattagccatctatttttacattgcaagataactgaccagctatgtaagatttttattaatctcaaggcatattttggacaatgcctagcaagatgactgaagttctatttaattgggatggagctggagttggatcaagagacagagatagatggaagactgtcccagcatgtatttggtggacaatctggaaagagagttccagatgttttgaggatagcagcaattcagtgcagaagatcaaactcgattgtgttttgctcttttacttttggtgtaaacaaagtgttagctgaaacgtaaaagaaagaacacaagatttaacgtggttcggatcaaaataatcctacgtccaccagagaacaattgcccttttaatattaacaaaggaaggggagatttcccagttacacttaagagaatttctctcttagctctctactcactacaatgtattgtattattttgggatggtttctacaaatgaaggagtacatctatttatagaggtaaagacctccttttgatgtcattggtgacatcaaactacctcctcttgatgtcatgggtgacatcaaaggaggaagcttcctcctagcatccacactaactctttccaccaactcttccaattggcatgccattgttgactaaacataaaccaacaccttcaatctccaccttgatttgcgtttcgagcgtgcgtgtgaacaactctggccaaaacttctaagcttactgggcaacccgttgtaagaaacaagaagaatcaaaccattgttgaacataccacctccacctaacaacttttctcttcggagttgcatcagttgatgcacacccccgccaagtccttgcagtgtgcaaacttagcgagcgggactatcttggtcaacatgtctgcagcattatcgtctgtgataaccttcacgaccttgatagttccctcatcaataacatctcgaataaaatgaaatctgacatcaatgtgtttagtgcgctcatgaaatctttgatttttcattagatgaatagcactctgactatcacatctaagagttgattccagctgaaccaaactcaattccgctactaaacttttcaaccagataacttcctttaccgcctccgctgctgccatgtattctgcttctgtcgtagacaaagcgacaatcgactgcagagtcgacttccaactgacggcactgccaacgagggtaaagatgtatccagtcgtggaccttcttctgtcaagatctcctgcatagtcagaatccacataaccgagaattgaaatacctgtaccactttttcgaaaggtaagaccaacaccagaagctcctttgagatatctcaatatccacttgacagcttcccaatgcctctttcctgggttggacatgtatctacttaccacacttacagattgagcaatatctggacgtgtgcataccataacatacataatactaccacctgcactggcataaggaatctttgacatatgctccacctcatcctcggactgaggcatttgtgactctgaaagtttaaaatgaggagctaatggtgtacttacaggcttgcacgtttgcatattgaatctctcgagaaccctttcaatatacctcttctgagaaagatgtacaacatcgtcttctcttgaaatctccataccaaggattttctttgcagctcctaaatccttcatgtcaaattccttactcaacagtttcttcaaagcatttatctctgtaatgttgttagcagcaataagcatatcatcaacatacaaaagtaaataaatcattgagttaccagacatattcttgtgatacacacagctatcaaatgcactccttgagaattcatgtgtagtcatgaatgcatcaaacctcttgtaccactgtctaggggattacttcaaaccatataaagacttctttagttggcatacgtgatcttcttttccctcagctaggaaaccttcaggttgatccatatagattgtctcttctagatcaccgtgtaagaaagcagttttgacatcaagctgttgaagctccaagtcaaattgtgcaaccaatgctagtagcacgcgaattgagctatgcttcacgaccggagagaaaatctcattgtagtcaattccctccttttggctgaaaccttttgcaaccaatctcgccttgaacctagcatcttccacttcaggagttccctctttctttcggtagacccacttgcatccaactgtcctcttccccttttgtcttttcactaagacccatgtctgattcttgtgaagagactccatctcttcagtcatggctaaccgccattgtgcggcattcttgcaagaagttgcttcaatatacaaggagggctccaaatctttaatctcttcttgtgcagctacgaacgcatatgcaatcaagtttgcttgatttataaggcattccggttctcgtgtctgcctcttctccctccccttcgcaattgtgtatggttcattgacagcaagttcttcaaggcctacatcttctgactcatctttaacctgagtctcttgatccttttccttggcaagctccaccggaagctccacctgctcgttgttcttgtttcctgaaaactccacggaaactttacgaggatcaagtatagaggattcatcgaaggtgacatctctactaactataaatttgagtaaagacaaacaccaaagtttgtacccttttactccatccacataccctacgaatatggccttcttagcccttggttcaagctttccttcattaacgtgataataagctggacacccaaatactcgtaagtatgaatagttagagggttcacctgaccatacctcattcggagtcttaaagtcaattgccgatgctggagatcgattgacaatatgagcagcagtgtgaactgcttcagcccaaaatacttcggacattttgacttgtaggagcatacaacgagccttttcaagaagagttctgttcattctctcggcaactccattctgctgtggggtatgcctgacagtcctatgtcttgagatcccatgaaccttgcagaattcattaaactctttattgcaaaactccaagccattgtctgtgcgaagatacttgattttccgctccatttgattttcaaccaaaatcttccactctttaaatgcttcaaaagcatcactttttgccttcaaaaaatacacccaaacctttcgtgagaaatcatcaataaaaatgagaagatacctctttccgcccttcgatggaagtttagaaggaccccataaatttgaatggatgtagtctagcactcctcttgtcttgtgtttgccagtgctgaagctgaccttcttctgcttccctagaacgcagtgctcacagatgtcaagcgtgcttatcttctcaccttccaaaagtttacgattgctcaacatctccagtccacgtgcgctcatatgacccagtctcatgtgccatagtcttaccttgtcatcattagataactgcactgtagatgcatttgcagagccaacaatggtgcttccggccaatgtgtaaaggccgttctccagcttgcctttcagcatgactaaagaacctttagtcaccttcatagttcctgcttcgctcatgtacctggagccttgttcatccagagtacccaaggagataaaattcttcttcagatcaggaacatgacggacttgtgtaatagtcctcatgattccatcatggcagcgaacccgaactgagccaatgtcaactattgcacaagttgcattattgcccattactacggttcctccacttttctcgtagctgctaaactagtcttttcggaacgtcatatgcagagtacaagcagagtctaacacccatttgttttcataactattattattattacacgatgttgttagtacataatcattatcaaaattatgtacctgttcaactgtagatgcactcgccttttccttggactttgacattgggcaatctcgttcaaagtgccccttcttgccacaaccccaacactctgtattcttcttgttcacacgagactttgatctgtgctttaatttgctctttccctattggctagtccggcctcttacaaagaggccacttgcctggtcatctctatctccttcaatgtgcctccgcacatcactagagttaagtgcctgccgcacttgctcaagcttgataggctccttgctatacatcattgaattctcaatatcacgatatcctgaagtcaatgaaaatagcaaagcacatgcaagcgtctcctcctcccttttaattcctgcaatctgtaagtccatgacaagtttattaaacgcatctaaatgatcttgtaacgaaatacctgaccccatcttaaatgtgtgaagacgccgttgtaacaacattcttgttgtcactgatcggtcttggtataacccttctagcttttcccacaactgtttggccgtctcttcggtacccgtactcacttcacaaagcacgttaggtgcaagggatagttggattgcactcaatgcatccccttcaatcttctccttgtcgggggctgatatatccgtaggatactttccgtcaatagcatggattgaaccttccctccgcagtaacgccatcatctggatgttccagatattgaagttgttgcgtccattgaatctatcaatttcaaacttcatggaactcatatttgcttgttcttcctccttggatcgttaaagaatcctgtcgctctgataccaattgttagctgaaacgtaaaagaaagaacacaagatttaacgtggttcggatcaaaataatcctacgtccaccagagaacaattgcccttttaatattaacaaaggaaggggagatttcccaattacacttaagagaatttctctcttaactctctactcactacaatgtattgtattattttgggatggtttctacaaatgaaggagtacatctatttatagaggtaaagacctcctcttgatgtcatgggtgacatcaaaggaggaagcttcctcctagcatccacaccaactttttccaccaactcttccaattggcatgccattgttgactaaacataaaccaacaccttcacaaagttacccagaagatactgtttcaatcctagatgtcttagattcttgctaggactgcagaatagtcttttcttctccgtcgctgacttgttaatattgtctcagtacaagccatgtactgattctatatatatatatatatatatatatatatatatatatatatatatatatgttaccatctcaaaaaaataaaatataattggacacgtgctgtacgaggcttctctagtatattaagttctcataggaagcaagatatatagcttggatactttgtatatagagatattgtggacatggacaacacagtaattggtagaacaaaggagtagttgattatagttgggcccctgtcctattttctgaatgaggatcctatctagctcatgaagcccatcaatagttgtgctctttgactatagcctccatagcggcatcctcactctttttatggtggaacaccttattagtcatactttaaggccaaggatgctaagcagatcttctattctgtcggattccactagtggcattggatgacctttgctaatagggccctatacatatatgtggaaggttatgctgttgataaattaaatctgcaagtgtgaatcatctgaacaaaaatctaaattggggctttactcgtctttatatagatatacttttaaggactgttagtttgatagttaaatagtatagtaaataactctaatcccatatgtattaggagtaggaaatgtatgatatatatataggactcattgtatcattgtcaatattgatcaagaatattttctcccgtgctttctcacatggtatcagagctttggtgagaatatatcgctgtgcgtcattccagcgatatccgggaagaaagacctcagtcaccgtgagattttccggtgacctaagtgactatttgcgtcaaagccactaattatcagtgttgtgcaaaatccaacaccacctgaaaacactcacctacgcgcctgccggagttctgccggtggcgacgcgtctgtcccacgcgctggcgcatgagggctgttccggctagaatttcaaaaaatttcttttggacagtgtaatagccttgcttttccgagcctacccatcaagtttacatcagattccgacaacttttttattttccggcgagctacagtgtttccggtgaacagtaacagtgaaacaatgatttccaaacaattttctgacctttccggcgtgaacattataatgtcattcttattagaagccttagactcacaattcgttggatcaaatgcattaaatccaatccagatggtttctttacccgattatattgagttccttcagtacaaagcacgtaaacagacatcttcaggattagcctttgttgttccaacaaatagtagcatgactggtgtgtcccaatcttcaccttctgagtcttgggtcattgattcaggtgcatctgatcatatttctggtaacaaatctcttttcactagtatctcatattctcaatctcttccaacagtcacaatggccaatgggtctcaagccatggcaactacaataggtcaagcaagtccacttccttccttacctttagactcagttctttatgttcctggtagtccttttaatctcatagccgttagtcgcttagccaaatcacttaaatctgatgttttatttcttgatgaccttgtttttatacaggaacgcagacagggcggatcattggtatcggacgtgaatcaaatggactttattaccttatccttgcaaaatcacatggactcgcatcttgtcttcctccaataatttctcccgttactgattcaccagatttattacattaacggttaggacatccagtttgttaaaactttagaaaatggtacctggcttatctcacttgtccactctagagtgtgagtcgtgtcagatcggtaagcatacccgctcccatttcccgcgacgtcttgataatcgagcagagtcaccttttactttagtccattcagatatttggggtcctagtcgggttagttctaccttaggattccgctactttgtcagtttctttgatgattattccaggtgcacttggatatttttgatgaaaaatcgatctgagttgttttctattttccagacctttcacgctgaaattcaaaatcaatttggggtttctatccgcacatttcgtagtgataatgccctagagtatttgtcttccccatttcagcagtttatgaactcctatgggattattcatcaaacatcttgtccgtacacatcccaacaaaatgggatagctgaaagaaagaatagacatcttattgaaactgctcgtaccctactcatacaatctcatgttccgctgcgtttttggggatgcagttcttacatcttgttatcttattaatcgtatgccatcttcagctatccaaaatcaagttccattctctgacctgtttccccacttacctttgttctctctttcaccccgtgtctttgagagtacgtgctttgttcatgaccttactccaggaaaagataagttagctcctcgtgctcttaagtgcatatttctgggttactcaagaacgcaaaagggatattgatgttattctcctgaccttcagcgatttcttatgtctgctgatgttaccttctttgaaacccaatcatacttcacaggtccagttaatcacttagatatttctgaggtgctactcgtcccttctattggagattcagtccctatctcccattcatcttcctccatagctccaccgcctacaactctagttgcagctccaccacctatagctccagttccaccaactatagctccagtaccaccacctagtctagttccaccaactatagctccagtgccaccacctagtccagttcaaccttctacagctccaccactcctgacttatcatcgtcgtccgcccccagcatcaggcccagctgattcatgtcctgcaacctgaccctgctaatactgcggacttgtctcctcttaaccaaccgattgcactacgaaaaggtatacggtccacttaatcctaatcctcattatgtcggtttaagttaccatcgtctctcatcatcccattgtgcatttgtgtcatctttgtcctctgtttccatccctaagtaagcactctcatcccggatggcgacagacaatgattgacgagatgtctgctttacatacgagtggtacttgggagcttgttcctcttccttcgggtaaatcgactgttggttgtcattgggtgtatgcagtcaaagttggtccagatggttaggttgatcgacttagggctcatcttgttgccaaaggatatactcagatatttggactcgattacagtgatactttctctcccgtggctaaaattgcatcaatccgcctttttctatccatggctgctgttcgccattggcctctctatcagttggacattaagaatgtttttcttcacggtgaccttgaggatgaggtttatatggagcaaccacctgattttgttgctcagggggagtctagtggccttgtatgtcggttgcaccagtccctctatggtctaaagcagtctcctcgagcctggtttggtaagttcagcacagttattcaggagtttagcatgactcgtagtgaagctgatcactctgtattttatcgacattttgcttcaaatctctgtatttatctggtcgtttatgttgacgatattgttattaccggcaataatcaggatggtattagttagttgaagcaacatctctttcagcactttcagactaaggatctgggcagattaaagtattttctgggtattgaggtcgttcagtctagctcaggtattgtgatctcacaacggaagtatgccttagatattcttgaggagacaggaatacaggttgtagatctgttgacactccgatggatccgaattctaaacttctgccaggacaggggagcctcttagcgatcctgcaagatataggcggttggttggtaaattaaattacctcacagtgactagacctgacatttcctttcctgtgagtgttgtgagttagtttatggattctccatgtgatagtcgttaggatgcagttgtccgcattcttcggtatataaaatcagctccaggcaaaggcttattgtttgaggatcgaggccatgagcaaatcgttggatactcagatgctgattgggcaagatcaccttatgataaacgttttacgtctggatattgtgtcttagtaggaggaaatttggtgtcttggaagagcaagaaatagaatgtggttgctcggtctagtgcagaagtagaatatcgaacaatggctacatgtgagctaatttggataaaacagttgctcaaggagttgaaatttggtgagattagtcagatgggacttgtgtgtaataatcaagctgctcttcatattgcgtcaaatccagtgttccatgagagaactaaacacatcgagattgactgtcactttgttagagaaaagatactctcgggagatattgctacaaaatttgtgaagtcgaatgatcagcttgctgatattttcaccaagtccctcactggtcctcgtattagttacatatgtaacaagctcggtacatatgatttatatgcaccagcttgagggggagtgttagtttgatagttaaatagtatagtaaataaccctaatctcatatgtattaggagtaggacatatatatatatatatatatatagggctcattgtatcattgtcaatattaatcaagaatattttctcccgtcctttctcacaaggaccaaatgtgatcacatgctttgcgtggattcactcattatcatacttcaggaaatgatcaatatgttaacttttcatcaaaagaaaatgataaacttgttaactcttggaaaatgcagtatttatcaatggggggcagactaatgttgattaaaagtgtcatggacaacattcctacttatatcatgtccctcttccctatgccaagcagagtcaaaaagcagctagataaagccagaagatcattcctatgggagggcaatagtgaagatcacaagtttcatttggtcaagtggtccaaagtaatcatgcctgagcaccaaggtggtctaggagttagggatctacaaaagcacaataggagccttttattgaagtggtggtggaggtatgctcaagaaaattcttgcatatggaagaaggtggtgacagctaagtatgggaagttggacaactggagcaccaaacaaagtagagctccacatggagttggaccctggaagtatatcaacagcttaaaacaggaattctttccagaggtatacttcaaagtaggggatggcagatttgttaaattctggttgataggtggatcctgccccaacctttaaaagacacacactcaggcattttccagatagccttggatccagactcatcaattgcacagaatagagcagggaacttatgggaaccactcttcagaaggaacctgcaggattgagaactagaggaactatttgatctcttcagaatcattgaaggttcttccatagaccttcaaactacagacatgctaagatggggcaactccaaggaacctgcaggattgggaactagaggaactatttgatctcttcagaatcattgaaggttcttccatagaccttcaaactacagacaggctaagatggggcaactccagcaagggtacaacaaattgtgtgcacctaatggaatgattgacaattggccatggaaacatatttggagatcaaaactacccactaaagttatttgtttctcctggattgcccttaggaatgctacactgacacaggacaatctatgcagaaggagcatccaactggtcaatagatgttacatgtgctgcagcaatactgaatcagtaaattacctttctttgcactgttcagtggcatctgacatctggaacatgttcttagcagtttatgcaatacctatggacatcagagaggcatttgaaggctggtgctcctggaaaatttgagaaatccataaaaaaaacctggcaagtgatcccaacttgtatctgctggagtatatggacagaaaggaattccagatgttttgaaggcatctcaacttccaccagctgtttgaagtctaaatgtctagtgaatttgtttagttggagctacctctcccctgtgaatgatgccattttccttttagattttattagctcccttagcatggcataatgcctcttttgattttggtcttggctaactcaagtattatagttttttgtctttacagagttagccaaggactcacactttgtaattttctggcatcttcttgatgcattcaatgaaacatcttacttcatcaaaaaaaaaaaaagagtattgtgtcaaatttgcatcaagataatgctattattcttattattttataaaatgagaacttacatcaataaaatttggcggtgggaagagataagatccccttcttcaaaataatgctattattttgaaacgagaacttacatcaataaaatttggtgtaagtaacgagaagggaaaaaaataatgctattatttttattattttataaaatgagaacttacatcaataaaatttggtggtgggaagagataagatccccttcttcaaagacttaccaaattagcttttgacgtcccatgattctgctagtttagaaacaccaccagggaccggctcaatgagcacctttgggcggcacaagacgattccacatatcgaggtcggaatgggatcgggtgtttttacgtcttaccgtagaggtcggtccgtgacccccggatgctgaaggcgtcctatcttccttctctcatatttggggttccacatatgctctaacccccacccccaaaccgaaaaaccaaaaataaagggccatggagctccatcaacattatttccatgatcaggcccatagatcagtggaggggcatttttgaactctacataaattgccattgacacttcagataattcagataatagtagggtaaagcggctccttttggatactgcctctgtgctcatcgcagtttcttcagtaagcttagagcttctttctggcttattttgctctggatagctttttgtctcatcttacctgggcttcacattcgttttcatgttttcctctcaccttatgttcctccatttcaaacctattcttctttaattgcaatcctttctatgtctggtttccatcttgggattctgcctttttcccctctacaagttccagggacatgccaaatgcaaacgttgtgttacttaagtgatggccgccttttgctttgttgcttgtttttcccaaagcacctgaatttgtattgaggcatagctgattgatgtttttggatacgtaggtgattgaatttttttttttttttaaatattcacgaggatattgcatgaatcgagtaaacttcaaacaaagcagccattatggttccgataataaactatcaaggtttaaaactttgtcaaagtttgtttcatagaaagattcaaatatttcaaggccagtggcatgtttccaaaatccaacctccatcctcccaaaaatgctccttcctgctgcacggctgcaagaaagaaaaaggatctgtttcacttcactcactgggataagcacatctttttgttttaacttgctagattttgaagcttatattgatctatttacttcctaaagagatgtcccaggcctgcttacatctagagattttgactttaggctttcttcggtttttcgctatcatttagaaatgcacatgttttagtctgttgatttgctattgatatttatgttgctattctaacttctttgattgcagtcacctggtgattgagacatcacaagaagttagtgatgttccttttgcagattattttcgagtgcaggtatgagctttacttttcataagggtctgctttctcgttagcactagtactacttgaggttatcttggacgggtttttgatcagtattgattataaatctgcacttgcatctatcctttttttttaaatgaaaaactgcacttgcttctatcattaaggtggtgcacaattcatgcgagataaccgattgggacatattcgtaccaaagaaatgtctcataaacggaaaattaaaaggtagacattgactgtgaaaattaagaaaggaccttaggaaatgctgctgctgtctttccttctcacattgcgatcatgttcgtaaacaaccattgctacccttctgtaatcatcagtcactctgttgaacaccagccaaaggggtcatttttctgggatatatggggttatgtttggtgggataaactttgggcaaatgtttgatggtcttaagtgcttagtctaattcttttctgggccccgccggatgaggggatttttggcatttttccctttctctccccactcaccttggactcttcttcccttaattctgtgttttgcgttgaatgttccttggatttttctttgtttgttttggactataattcaaccttatttgaatagattaaggatcgtattatagtattgctaagtaggaaccggatagttttatctgcccagtgttattagcaaattagtgtaagcactctgaatgttggtacatttatcttacctggctttgctgcctgggttattatgttcttaacttatcctgcctgaagtcatgtgaccttaatattgctggtttattatccccctcatgccagggtcatctccacaaacattagaattccaatctccttgcaacagtttgcaaccttccatagctgctactagcctgttaaatttaaactgtcaattcctgaaaacacattatcaaaatgattatgtatgttatgttattttatgttattttattatgcgtctattgatagtactaatatatcgtctctcttgttgctttcttgagccgagggtctcccggaaacagcctctctgcccctcggggtaggggtaaggtctgcgtacatattaccctccccagaccccacttgtgggattatactgggccgttgttgttgttgttgtaaattcatagatttgaaaatactatctggaacttgaagcttggaaagagaaatatcaattgacctcagtatttcttatgtacaattcaagcatggttagttttgtcctcccagctataggactctcatacctaagagggccaaaatatgtgtttttttttgttcttttagaggctgtttgaggttagtttgttggtgaaaggagaggttgagttgtttctctttcccactttttattttctttttctcggggatggtaggggatagaatgtggggatggggaggtgacaaggagtggtggctgtttgttgtctaaactgggtctgtcttgctgagactctaatgcaactgttcttgataaagtaataaagggattttcatgtgtaagtcagctcacagataaattatccccaaaaaagggttagccagcagagagtttaaactttaagcagccaaggtaagtatactttgtcagttcatttatgtctaactgaacaaccatttttacagaattgacaattgccaatttttatatgatgcttgaagatgaatatataagtaagtgagatacagagatactgaggagagaacaatcacattcaactgtacttttccaggatcatttgttctagataacgttgttcaatctatattgctgcatgtggtgtctgtttcacatctgagccgattctaacttaaccagtgttccgtctgtctaactttgttttctagttgaattgtagaccatcaaacaatgtcgtcttttgttttcagatttcccaatcacaaaattggtggctgatatatagtatattcatgtagtttatagattccatatgtttcaggttagccaatattggattccttgtgttggaggagggggggggggggggggagggttgttggtcatgttgaaatattttcgattttatcttagtttcttctcatgatatatttcttcctttcacattagggtttttgggatgtggagaaggatcacgatgaaccagtaggaggctgcagtttgaaggtgtacgtaaatgtggccttttcaaagaaaaccatgtttagaggtgcacatgtgtctttattgctcatatataccttcttcaagtttgacttactgtaattttcaaagaaacagcaagtgacttcttttttctcaagaaggaactgcaagtgtgatcttactgcgactttaagaggcgttgaaatctgggctagaatatcgtggctttttttcctttcctcttgtatgcagggctttccaccgactcatcaataatttaataatttcataaagcatcttgccttctcattattgaaagagttatgcttttggtgatagattaatcaaatgcttctatatgctataatccttctttattcaaagggcttcttatttataactctgacttggcttgtaagtaaacgtttgtgggagcacgggatgatgatgaaaatataaatcaataaagagacagaaaaaatgcaaaaaacagctactgctatcaatacaatattaaagtaaaagtgactaagctcaacggacacctatgtagcaattgcacaggaatggtcaattgtggcacaattagttcaattattttagagaccatttgatccaaaaagttactgttgctgcttttgccatatcgtggggctctccagctctaggaagtttgtgtctaggatctggtaattgacgattacttcttctggtcggcttgtactaacatgtgctttagaggcatatcacttttactatcaggatctggatctttgttttctagaaggaaaaaatgggttcctttcacttcgagttcttttgttgtaatcaaatatgatagagctggataaacaaggcaaggatcgcctgctcttcaatgcttgataggttaaccaaatgctttgatgtgcttagtacacttttgatgattgattaatcaaaatatttcgccactgatgctacatggggcttatccactcatattcgatttctttgcttctcctgaaaaggggtgtcaaataggcggattgggctacatttggacaggtcaaaataggttgcatcaaataaacgggctgggctataacctgctcaatgtttgcttgggttgaaaggggcgagtcaacttgggctaaacaatgggtcattgacccatccagcccaactcaaaacgttttccatttatttgtttgttcttttataatctgtttaataatcatatcaaaataataaaatatttttctttgtttattatgactattttaaacaaactgaactcaaaaaaaaaaaaacctttttgtgttttgataagttttcttatggatcattgccaaaatgacccgccaataaatatatccaagcccaaccctcaacaccccagttctgatgttgacttgaaatgttgaacaaatctacatcccattttttggagaattaatatagataaccatttgctagtgctcttccttcaactgagcctcatttatgtttgatcaatcatattttagttagtaatttcctagagtttatcttttaagttgctggtgattttccattggcagtcattatgagcatctatgttcttagttttttgcacaactaggggtttaatagttgttttatgctaagatgaaacttaagctttcagaaaattcctttatttattctgacactaactgtaagaccgtgaagccgacgcagctatttgctggtgctcttccttccacccagtcttagttgtgttccatcatatcatgtcctttaagttgttagcaatgatccattggcaaggtattatgaggatcagagctatattttttgttgcccaagttgaagtttaaagagttttatataaacaatccccacttgtatgtatagatattcctgagtctggggtctattggaaacaacctctctaccttcaagctaggggtaaggtatgcgtacattctactctactcagaccccacttgtgggattatactagtgtttgttattgttgttgctatacttgtatgtatagatattgaagagttttggtttggtaggctctttgaaagtgtgttttcatgttttcaaagtttacatgattgaaaatagagagagtttttcacctcatccacatggcatggcttgacatgatagtaaatacagaaagaagtttttcaccaaaggcatgatatgtgcagcactttttgcgtatatgttttgatataacaaattttgagcaagacgagatacaacagaaaaaagtggtcctacttaggatttgatgtgcattttagtgtatccttgttagtttcaatgcttaagcagttaagggaaaaaggtaacttatgatgatcaccttacaaaaatatctgtttggctgctaaatgcttggaaatctctgcagggaagatagtgcagtctactgttgatgaatgtcgagacgtgtatgcaatatggattgcccttgtatttttctcatcccttccggtttcttctattttcagtttgcaggtatttcaaggctgtttaagagattgatttgggtttttatttcaggcacatgaactgttgaagcaaaagaagttagagaaggaagaaggtagtgcttctgggaacctcttgtatcatacctttgtctgtaacaattggcatctgctgttttatatgttgcagtatatgttctttgattccaggctcacattatctgattaaattattttctgtatcagccggtggtcatgctgctaatgtggtaacaagtgctcagcagaaagaaagttctgaacatgtggaaatattagacggggcaagtgatgaagttaggtcacaaacactgccactcaaccagctagctgctgattccctgcggggtagttgtagcagtaccgtctctgttacttccttgtgtagaaatttcatggttaagtgttcatcatctttcaaatctcaaagccaggtttccattcttatagtgatcaccattgctgtgatcctgctcttaatgcaggtatgtttctcaatttgcgccttctatctgagattacgtttaactaatttgctaccacaaactgttcctcatatgatgttgtgagcaagggaaagtaaactgctttggtcatgtgatcacgcagttgctgattttcatgcttttttctgttaatcgttagggttgttagggtcaacaaatagttactggagaatttgtcaactgcagattgtacgcttgtttttggtctgaccctttttccctgattttggggttagtgtcgtgatactctctgtaaactattcttggtacagtagaattcacctttcgatgtccaagatagcgatgcaaacactccctccttaccattttaattgacttgggttgaccttcaaggtttgaatggcttattgtattggtttatttgaggagatcaaaataataatttgaagtgtgaggaagtgtacaaatttgttggaaagatcaattttgaagtaataaaaagtagcatatattcatatttgtttgaatagaaggggaaaaagttggaacaaattatgattgaaatcatagtactgacgaattaaggtagaaaccgggttaataaaatggtgacaagagagggaatgtaattagctgcatgttacaagagttggctgactttcggtggtagaagtaggttagggctatacgagctgatattcttgtatgtttgctctttccatcttgtttaaatgtaggaaaatgctgtccttgttcccttcgttttgatgcatgtggaacatgctttgtatttatctgtctctcctatgagatgtacatcatctgatcctggcattactctttttcattatatgccttctggaaaacaagtcaacattaccccctcccctgcaaccaactaatttgcgagtttcagcccagcctggcttttgtttgactctgtcaattttgttctaatttgtttgttactttgtatatgtgatgcattgatcttctagtgtgcatgacttaatctgttttcacatatggtggtcctcagaacagatcgatcagtcaatattgctgtcagaacttctcttgcaaactgaggtgaaacataaattttgctgtctaatcttttggtgtaatcaaacttcatttgcagatgagcatactcgtgttattaggtagacctcagcacgtccacgtgatacctcaaggggactgcacaggtagcatgtatcgactgggagataggggtatagacacactagcctttctggataaacagattagtcatctcaaagaggagatggttatggtcgaaacactgctcggcaaaatgcagcaggagcatacacttctaaacacgaaattgaaagagtttgagcgcctacggaagcaccagaaaggataa

SEQ ID NO: 26 - DNA, 5170 bp, Nicotiana sp.
atggcggaagaagtcgtgggagaagtagaagcagtagaatcagtttacggcgatgattgtttactccttcaaacttatcctccttcttttcatctccatatcagacctcgtacggctgatgactcttctcaacaggttccctctcttccctaatttcttccccctacccaaattactctttgtgggtgtgtgttttattatttttaacaatgaattggcttcttgaacgatctttctgctgaaatccttatatttagtgcgtgtatgattttagtataattgtgtggtattgtaggatttaggctaattaattacctgaatgtgaaaactcagctttgtatgtctgttaaaagagaattatgagttggggggaagcggaaaagattctttttttggttaatgaatctgttttctaatttgttgattgggatacgaacattaggagaactgacaccctaaaagctagctattgagtggagagctcaatgtcgtataaacctccaattgaaatctggtagttttctgtttgtacgtgtcatccttgcatagtggcgttgttaatcttctctgtaccattccctccaattttattgccttgatactcgtgctgaagtgtcgaggggaagtgctcagcttgagcttcaagtaactccaggacttaagcacgctttaaataaagcctttgacaacactatgacaacaactacgcctctatcccaaaagagttggagtcaattatatgagttccatttaagctcgttacagacaagcctttgttgcctagatcgaaagcttaaagcattaccaaaattctgtccgtttagtcacaatttggcgggtgtaggaaagtgcagatccggaatctcatagagagattgatagaagaataatgttctatacagattatatacacattatgcatgcagtgactaagagggaattggttttggagtagttcgtgcttcctaaggctgtcaatatttgctgatattttcaaatgaatctgatgaagtgtcattatactttacagttctttttgttctttggttttctggttactttcctattgttttatgttgtatgttgctatagccttataaagaatagttacattttttcattctcctgtcttgcagtttgtggaagcaatcatcggaatccaggctggtccaaaggtactctgtcactgtgattaatattctttttggggttgttgattatcatttggttcttttgttgtctaattcattcgcgcttaccttagcgaatttcatgtccattttcatctgatagctttgtgcagtccacccacacttgcgtcccatttcatctcttatttaactagttcatgttactattacggttgctactggagctactaatgaattgtcttttcttgttttttatttccgtctttctgagccgagggtctatcggaaacaacttctctgccctatcgtggtaggggtaaggtctgcgtatacattaccctccccagaccccactttgtgggattttactgggtagttgttgtatttaactagttcatgtgatagccatacttgtatgattagacaggtttcacatttctttcctgcactgatataattattttggcagtatcccgacgagcctcctgctattagaattgttgattccaagggccttgatgaacaaaggcataaacaattgataagttgtctttcagcaagggcttgtgaactctcctcgtgtctaatgcttgtagcactttgcgaggtaaccattgcaatgtccagatccagttctgtgattgatgataatcctaattagaatactctcttttattaaaacctagctacataatctcaagacttgcattatgatgagtaactattactttggatctttttgtcctgaaattaagtcaaaaggaacaggttttgtaatttatctaaaagaagagaaactcctagggttttggttcagccataagaaagtacaaccatggtgtgtgggttggactcacaccacgagttcgaattcttccactgacaggtgtctggtagttaagtggtaattcaaagaattgtttgtgtcatttatatataatatagatttatgttagaaactcgagctttactggtattttaactttgtttagcggcagggtgctctgtttctttctgaaagcaagtctgatagttaagtggtggaattaattatgactttttatgggctgggattggattatctacttgtcgaactattgagtaaaactcttatatattgattgtgtcagggactcacatttatgagctaaacaactaagacaatgtgttgctaaataggccaaattactattagaatctgggttatttatagccggccatattttgttgtttactttttctggccatatgcattgattatatacaactgtacacatataatatatatattatacctccaccggctatttttagtttaagggattgggagagcggctatttcagttaattcttcttagaatttcagaagggggcttaatttccagaaagctgatgctctgaatgtattactaggaagcagtggagcagctttccagcatgaatcaccctgatggggagtgtccattgtgcttgtacccattagttgatgaagatgcaggaagctctgcgccatttatgaaactgatgtcttgttttcattgctttcattggtaaattctgtcagtagtacccctttattttgattaatttgctactggctgaaagatgcatggttgtaacttcgtactcatttatttttcttattgctgcagtgagtgcatcatcagatggtggaattggcttcaactattaaaagaatctgatgcccctacggactctggttctgcttcgtcttctaggaacagggatcaggatggtccgtcgcaatgaaactgatgcgttaagatttaaatgtttcatagcatactccacttccattttcttctcttggtctgactagattcagaaaaggttaccttaattttattgggaattaagataggtctttaggatgatttctcagatattgccttttcttagataattattgatatgaagattgttgagcatataaaaaaagttgtgtttggacatgttggaattagaagaaatctctttaaagttagacccctttactccttcaccttgccctccaccccccacccccaccccccaaaaaaaaatgaaggcaaaagaaagacaataggattgacggaatgcataagatattctgtggggtaaaccagttacttgagctcaaccatgtgtcgtgtcaacttttgccaagggatttgatttttctttgctcaactcacctgactaatgagattccgttgaaataatgcgtgcattcacatactctgtcagcatacctggtctagttgcaagatgttatagtactttcacttatttcctatgttgctcggactctctgaaaatatcgatgggtgcatgtcagatccgacacgggtgcggcaactgttttggagagtccgcgcaacatagcttatttcattagaatagctacttgcatcatttggtccaagaggctctgcatccactaacctaggggctagggcatcccctgtcttgtctcttctttctgcagagaggatgaggtttttatttgattctgccttccttctttcctgtccgtttctccatcttatagattaccaatgagtcaacttatttcgatccatttcttttccatcttttgctcctataccactcgcagtggttataccaaaaggtttctttttgcttgcaacctcagtttgtcgagtactaatttgatatcttaatgcttcaccgtaaaagccctcatgctttgaggacggggtaaagagatttttgaatttgttttattatttttaggtttctactttttaaatattttccagatggatggtgtttacagctgggggttttgggggacaaccgagggagaattttatttttatccatctgtgctcttttttttgcagacatagtttcccaacatttctagttccctagctcactaattatcttgcttggtgatgtgtgattcaacagaagaagatgtggggaagtgcccggtttgtcgcaagtcttttctagcgaaggacattgagcacgtgctagacttcgtgaagactcagcatgctgtggtatgttatgaaagtatcttcttttttttttttaggccaactcatatcttttccctaatttctaggtagagaaaatactttgatttgctgaaatgttataaaagctgcttttatgagaattcctgatttcaaaaagaaaaatttcctctcttacttggggcaaggaaactcctcatgagccaaaagaatggggaagtgtcattttttgctccttgttgtgaatgtatttgagcatccaaacatagaactccgttggatgtccttatgcatccgatgtgatgtattatgtatttgtaacaacctgtcacacatgtaacctaattctggggttcatacctggatttgaacgtagacttgagatcgtcaggaagggtttgtcaaaagagtctcaaaaaagagtttgtaaaaggtattgcctactaaaagtgaacaaataaactaggagactcgatatgctaaatctgaaacaaattacagttggttagtgcccttggttagtactaaatggaatgaagtgtttgtttttggtatagttacaacattttgttatttatattggaggtagtctggtagagcgagtgatatttgttcatcttttgaatccagacttccagtggatctgaagtcaacaatgaagacaagattctttcctcggactcggaaaaactaagaagaaagaaatttgatgctattctgaaactccagcaagagaagggtggcttaattgaaataaaaaagcatgaagtgttgcggccaggtatttatcttccacaacctgctgcattaccctcaactgcacccaccgaagaggcaaatgagcaaaaagacagagatctggcagccaaccccagaccaaattctagtgcttcctcaaacaaacctagtaccagtagagcgagaaactccggcacaaagaaaagcaggggacacagttcaagaaaacaagcgactcagtgggttaagaaagaaaatagtaatacagcatga

SEQ ID NO: 27 - DNA, 1248 bp, Nicotiana sp.
atgcattttggacttgcactgcctaatactaattggcagtgcaactctaaaattagttatgctccgagcagtcgtctaaatttgagtattgctcggagtatcaagatcagtaactctggccataactacctcgttgttgatgataaagtcaaactcggagagaggtggatggaatttcaaggaatcaaaaattgggatggtttgcttgatccactagacgatgatcttcgcgaggagattttaagatacggagaatttgtcgaagcagcctattgctgcttcgactttgacatgttgtcagccacgtatgcaacttgtcggtatccaacgtgtacgatgctgacacactgcggactaggtcagagcgggtacaaggtaataaaaaacttgcatgccacgtgtgctgttcaaatgccacggtggactgagagatttcctaatttggtgtcgccgcggtccagctggattggttacgtggcagtatgcgatgacgtggacgagattgcccggctaggtcgcagagacgtggtgattgcttttagaggtactgccacttgttcagaatggcttgaaaatttacgtgccacgttaacttgcttgcctgatgacatggcacctgaaaatagtgaacccatggtacagagtggactcttgagcctgtacacttcgaaaaatgaagggaatccaagtttacaagatacaataagagaagaaattggcagcattctcaatacttatagtaatgagtctctgagtataacagtcacaggacatagtcttggagctgccttagctacacttactgcatacgatataacaacaaaatttagtgatttgcctatggtgacagtagtatcatttggagggcctagggttggtaacaagagctttaggtgccaattggaaaaaaatggaataaaggttctcagaattgtcaactctgatgatcccataacaaaagttccgggattcgtgattgatgacgtggaaagccaaggagcagccacgctggcaagattgacaagctggcttggaaagtacatggaagatactcaatgggtgtatgctgaggtggggaaggagcttaagttaagtagcaaaggaaataatgtagcaaaatgtcacgatttgaagacatatttgcacttggtgaacaattttgttagctcatcgtgtcccctcggggccacagctaagaaagtagtatcaaagagaaaacaacgtgaaagaaaagcagttgtagtttaa

SEQ ID NO: 28 - DNA, 31371 bp, Nicotiana sp.
atggcgattcttgcactcccattagtcacttccattctcaaacctcacaagactcacttctcctttctcctaaccaccactaagcctcttcctatcatttttcacaggcgttttctctctaaatcttccactgtctctgcactctccacttcttcttcttctacttcttctgtgtctcacaatacagaacatcaaaagaaaccatctgttccaactttccaacaagccattcaaaggctccaggtatttttctacttaatggggttgtgtaattgtgttacaatttcctttcttgagcaaaatatacattgaataactaatgtagagaagcttcattcatttttcttggacaaagtttatttgttgctaaaaaattgatctttagtatttcaagattgtaccaagtcaacaagttttaagtcttagcattaatcctaccacaagcaagaagctatgcaaaaaaaaaaacaacaacatttttttcaataagccattcaatttttatttttattttgataaggtaaaacttttattcataatagaaagttcaattctgtagatggctaatgaattcaagcaacttcccctccttaatctttttaaccttgccactcggtgtagatacacttcatatctgttttaaaattatttatggattaacctgtctttttaacatggtaggagtattggggttctgtaggatgtgccgtgatgcaatgcagcaacactgaggtatgattatcatccttttttagggctcaaaaaatatactctagcacataacaggaaaaaaatgaacttgcttttctgctggaattgatgcttttctttttaatgaaacttgatatcttatcaaagtcgtaaatggtgatttgcaagttgcaagaactaagtattatcttccttgcatacttttttttttttgggataggtagtgtgtaacttttctatgataacaacataaaggaaatgcatcttggtagatatagtcttccgtgtatcttctttgagatctagctagctgggagtagctaagctgtgctttgtaatgctgttctttggtgattaatgataattttaattaccgaaaaaaaactgaaaggaaatgctgagcatattctccttccgtactttgggactgcatgtttatatgtaatgtgtatcgcacttaatctggattagatatgtattgcacttacatatggttggtgatgatagtgctttgtacagccataacatgaatgggcttttagtggttattagatctttaagtgtttaaattgaacttacaatctttagagttttttgcatctactttactaacttgtttaagtttaaattgcattgaccaggttggcgctgggactatgaatcctctaacatacttaagggttcttggaccagaaccatggaatgttgcgtaagattttttgataatttcatctctaaagttcttgaatacaattatcattctcatatttgaccagaattctttagaagaagagagtaaatgcgtagggaagtcgtgcacatcttagatagtctctttaatgcaaagtaacatattagtcattgttacttgtcctcccatgaagaaacgggggacctatggcatcaataagttctcttgttgctcctgggttggcattgcctggtgccactctttagtaagattctcttttgttcctcctttgtaaggtaaaagaaatcaaagttttattaggtcattactctctcctgccacctaaagcaaagtaggggggggggggcatcttccgtggtgatctagctctatttaagctaaaataatgctgttcatgtcacgagtcagtaaatattgattgaacatgggctacacgctgacttaaatattagggcttctgatatttggagatgatcttcttaatctaaaaagacgaatacatgtcatgttctctatcctgaaccaaaagttctgcacacaataaatcatttatgcagaaaaattaagttgaaggacatggtaactgttagaatctggagatattgagtcccctataaaatcggacaggagctttgggatgcagagctcatttcttttcttgctaatttcagatggttttcttatcatgcttttcccacctctcagaagaattggaatttttgtcattctaactagatgaaaataaattcggcacagagaatggataagtcttattttgttgaggtgtgcctgtggaagtgcctgttgtaactgattcactatctagttctttgtgcttcattttctcttttctggttctcataatcttgataatgagcaagaagaatgatgtcatattagcaatgaagcgaagacattactttgttttcttgtatggctatcaattgtaactgtgtctgatggcaggtatgtggagcctagtattcgtccagacgatagtcggtatggggaaaatccaaataggcttcaaaggcatactcaatttcaggttagtttgccttcaatttattgtctaacattttgaatcacagttgattgtttagtactattgtatgattttattgtacttttgactactccagatgcctttcctgtttgaactgcaatgcaggtgattttgaagcctgatccaggaaattcgcaggacttgttcatccgtagcttgtcagctttaggttttgcaacctatatctactttctttttctttttcctacattatgtcttttggactaatttatgtggtaaaaacaacttcaagttgatgttatttctgggataagtcaatttgatacttatggtaagtgataagactgtaaggcttaccaataacaaagacttgcaaactatcccatgtttaagccttgaagcattggaggaatggaggagttattccatgatttcttttttattcttctaattttttgattttgtggtgtggctagaatgccgtggtcactgaatttggatatgtctctgatctgcttggtaaaaggcatgtgtggcaaccattttttagaaatagagcacaaatttagagttcgaagtaggattaaaatataatataaggttgaggcaaagaacctgttgctggaaaatgtgattaggaagaattgcaaggatgaactgaaggaaacatgtgccatataggtgattgagcatccttgcttgaataggccaacgaaactagagtttttttctattcattattcacataaaagagaacatactttgcttcatattggaggccttgatatgtgataaagaaatggcttttaggcctaactcaaccccagaagctagatcaagaggtgaggaatgcccaaggtcatataaggagatcaaaggaccaacacttcaccaatgtgggatatccaacacccccttgcacgcccaggaaactgcagcgtagaaaacataagatgggggcccaacatcaggtgaaacaagtggatgaacccggctctgataccatgataaagaaatggcttttaggcctaactcaaccccagaagctagctcaagaggtgaggattgcccaagaccatataaggagaccgaaggaccaacacttcaccaacgtgggatatccaacaatatgttaaaagggaattgaggaaaagccttgtggcgtagctttgatttgaaggtgtcgccgttgggtgatgccacattcccatttcagtccgcaaatgaagagcaagtttcaaaagtcttcaagaggacggagaatgggtaggggcagttgaagactagctaggctgtgactagctagtctgtgttgaacccgaggcagttgaagacttcattgttattgatattacttgggttcttagagatatccaaaatgcccctaagatagctgaagactttgagagggcagacggtacttgggagttctttaagaaggtggaggatttgtgtgggacatgtggaaattggaggtgaggaaaggagaatttttacttgcagctcatattagaaatcagggcaatagggaggagcagagatttgaaggattgtatggacaaatatagggaagagatgtccacaataacggcaggtttgggtattcagtgggtgttggggagggagttttaggtaccataagatcccggaagaaaatgagggtgcagaacatgtctagggcaattgaggagttcttggagttcctctagaaggggctagatttacatgagcaaggtgaggatttgtcatcaagaacaagacctggtagattcgtggtgtccactttataggaggagattgtgctgaatgtgttataagtttgacttcctagacatcttctcccatgtcgaatcatctggcacctattgactatttatttcatatcctcttttattttacaaatttcccgatacaagttattgctaacctagaaaatgcttaaacatttcacttcgatcctggaattcaagcctggtatatacaaggaagacaggatagagaaatttatcacactggctctatatagtcagccatttacttaccttctaagcttcaactaaaagtgtatgattttttttttttttgagtctgtttaagtggcttaaatggtaaatgggattcttctgaagagcagtttagaaggttttaaagttctatgttagttgaataaatggattagtctttttctccttttcttgttcttatttttatataactaagaattgtgtgactttatgcttagattcaaccatacttaaccaaatagggataccctttacggtttgttatttctccttctacttggtggattcgtgcaagtttcacggttgtgtgtgtgcgtgtatatatatattttatagtagctctagataccgttctggcttgagattttactttgttgtgttgacaggtattgatgtcaatgcacatgatattcgctttgttgaggacaactgggagagccctgtaagattattctttctcttgattaactttcctatatatgcacatataatgtttcatgaacagtgcatctcctttgtacttcatttcctttgtacttatttccttgttcaggcaaatttccaactttttgtttggattgcattaatgatgtcttttgctgcatgaaacaaagctgtattgttaaatgttctgttgacttgaactactagtaggtgcttggtgcctggggattgggctgggaggtgtggatggatgggatggaaatcacacaattcacctacttccagcaggttattctctctcttctgacaaaaagtgtactgcagttttagagtcctttttttcccaacaagaacaagtctcaaatttttcatttgcttttggctactaatgacttataagaacttgtccttctgcttttctattctgttctttttctatttttgagcgcatacagttatttaacttttattttccaggcgggaagtatacagttgatgccagtatcggttgaaatcacttatgggcttgaacgtatccttatgtcacttcaggttaattttgcctgttgagatcactttcaggcttgttctttctcctcttatgatttctttctttcctttttcttcttcaaacatatgatgaggctcattgtatacattctgcatcctcttctcccaccataggagaaaaaggccttatctatctatttttgcaccagagcctccagcatgatagctacatttactatgtctcttagctagcagaaaaatcttcatgtaggaggtcattactgccggcatcttagaaaatgaagagcataaactaactaagcatttctcttctggttctccaatattttgcttgttatgacccattattacttgtctgcagggtgttgatcattttaaaaagattcagtatgcagatggcattacatatggagagctttttctggaaaatgagtaaaaaacctactccagccaaaacgttttcttttttctgcgtattgactgccttactatttggatagatcatgttgcttctcattaattttcttttgctctttcagaactgttattatctggtctttctttaggctctaactatcttcaatatttgaacaatatctacttcattttctttttgttgagcataaatgttgctttcccaagttctaactgtacaagtaaaggaaccttgcatttatgatgtctgaaaaaaagcactagttacagaggaggaatgtaaattggactaggcatatttactggcaacctaagtgtatcaacatgtcagatatagacactagcactagagcatgggtttctttttgaaattgcggattggtcatgaaattttcaaactgatttgtattagactattatctagattagtattttgtagtggtctactggaaaagcatataaaactgttctctttgtttcaaatgaaatatttaccttttctgtttagtccattaatatttgaattgaacttaagacatctgcaagttcagataccatgttggagtgggattatctcatctaaaagcttaaactattggagagagcactttttatttgcttaattatatcttcaacattaaccttgcgaagtcgagcatggtgattcctttgggacgaatgtaatttcaaataaatgctctaagaatagcatatgattgaggcaatgtctagactattttgccaagattttgttatttccgatttaatttggaactctgaattatctgtatctcaagggtttttttatgtggtttactatgcgataataaaatttggagtatgtgtgcgtgataaatctgtcatttttagaaaagagattctaattggtgcttctgtttcaggaaggaaatgagtgcgtattatctggagcatgctagtgttgaccatatacaaaaacattttgatctctttgaagcagaagctcgccgtttgcttgatttaggccttgcaatacctgcgtatgtacttatatcttaataattttattatttttcacggaatagagagaagaagaatttgtgttttttcttcatgtgttaacttctacattgaataacaatattccctcactgtgctaggtatgatcagcttttgaaaacttctcatgctttcaatgttttagattcgagaggctttgttggggtgacagaacgtgctcgttattttgggcgtatgcgtaggtagacatttttatcacttcttttaattactgatcttgttggagagtttgtaggtttttcttaaggtttggcatgatgatcgagcagcttaccttttcagtcacatctaaaaatttgctcacgcaagttccaatttctagtatcgtgcttaatatatattccctatgttccatttttatagcactttttttagtctgttctaaggtcatcttttaatgtctggaaaagctttaacttctaaacttcctttttacatttaattacatgttcttataaccacaaaaatgtcacatatttaagaccacaagttctagtggtacttttggtgtgtgtcaaaagtctttctttatttcttaaattccgtgtccagtcaaacaccgccatgtaaaaagaaatggagggagtaaatctttattacaaagagatcagaactacggtgccaaattactttactctaaaaagattggaagttttcaaatgacactttttttgcctgatttttacctccactgtgcagtttagcccgtcaatgcgcacacctttggttgaagacaagggagtctcttgaccatccactgggtgttgtttctcagtgtgatcatcttcttgttcaaagagaagtcttggaggaggcagcacgaaaggtatgttttttggctttaggcttcgcttggaaattagaaagcaaggatatgttaaaaatttgctttctattgcttcgtttatataatagagaaagcccttttttttgccccacaattttagttcaataagaaaataaataaaaaatctctttcctttctgatgtttctagctaacaaaacaatgcaaagaagctgatattccttgctttgtactcttttcttttctcttgttcttttggcccgtctcatcctttccctagttagcgtaaatcatttgggcccataaattgctgtgtatctgccaaaagagttgcagcttcatcccgtttcttttatttctatattctttggttaatcctcaggaactatactggtcatccttttctattgggtctatttagcttttccttttccttctcattttcccatttggttctttgctcaataggataaacatctccactttctcttaatttacccgagttgggactgagtacttgtgtgcatatttttttatggtttcttgatgtgatccagaatatatttatggaacattgactttcataacttgccagattttctttcacattctctttgtaacctatacatgtttctaaaggattatgtaaatttgcttgcacacccttttccggccatacaggtgccttcagagccgcggttgcttgttcttgaaattgggactgaggagttgcctccaaatgatgtatcgagtgcatgcaagcaagtatatatcttctttttcatgtgattttcatttttactacttgcaaatctctattactgaagtttatattgtaaatatggtaagggaagtgggaaaagagaaaccagggctacattttcttgccttaatttgttttgatgtcatccggtgtgagttctcaagcaattccgcttagttggtcgtattactgctctgttaaatctgtttttttgtgctggtcattgcagctcaaggatctggttgttcagttactggacaaacaaaggttgcctcatggggaagtacaaacgcatggcaccccacgaagattagtggtaggatttgtctcattatggttggtcccctttacatattctgttagtctggtttgctttgaaaagctgtacgaaatgtctacgagaaaggaggtagtaggaaaaggagtgcattatctttgaacattttatctagcattctcaataaacttttttgattgttctcagatccatgtaacttaaaaaaggaaaagattgagccgagctccaatacatgcaacttcttgttgaaacctttgccaaagcggttatatgttacatgagttgctcaataagaataaagccaatatcaaatcttgtattaatgctacaagagttcttaaaatagtttttttttgatgaagtaaggagatttcattaaaagcatccagcggatgcaggcaaaagattacaattgagagagatggtgtctgctcatatacacaaaaaaactattctatcactaaggatcagacacaatcaaaaaattgaacagaactagttacaggtgcctgatttagccaactaaacaaattcaataagcattttgctttgactacatggatcagagttgagatcccatcaaaacatctacggttcctttccttccagatgcaccaaaagatagcagcaggtaccattacccaattttttttgatggatttaccaactctccatgagcaccaacattcatatgcttccttgatgctgttaggcttgacccaggctagtccaaaaatagagaggaacatgttccaaatatcacatgctaaaggacagtgcaaaaagagatgtctaacactttcagaatccaaattgcacatgtagcacctattcaccattggtatactccttctgctgagattgtcttgagtgaggcatgcttcatttaaggcaacccaactgaaacaaatcactttaggaggcagttttgttctccaaattagtttccatggccaattgtttatcagatcattgttggagcataggtgtgcatatactttcttcattgtaaatttcccgtccccccattccagtttgtccttcagctggggtttgacagtaatctgtgctagtttggccagttattccattaggtcatttatctcccaatcttgaaaatctctcctgaattgagggtaccaagagctgttctgcgaacattgttctacagtggattcttgatctactgctagtaggtacaaatttggaaattcatcttttagtgccattgttcccagccacttgtctttccaaaccttgatgagtgttccacttcctaagttgagttttgagttaagttggaactcatcccataaaactttacaagagttcttaaaatagtacaaagccagtttcttccggatctgtttttatggaacgtctaatgtcttttaaagagtaagacaagtttcagaaattacaaacataagctccttttttttgaaaatagaatgtctggataggaaaatccgtgaactcacacaactggactttcattctttcctcccttagtttctatctttacgtgagcatcatctcgaagttccttcatgtctatgtattccacctcatccaacactgtgattcctgaggtccacacaattacatccttatcatcgtgatcatcgtcatcctctttatctttttctcctcatcaccacttcaattttcccttcttagagggcctcctgcaccttccatagttggaagacgttgccgatggccggtctttgcgacgttcatttagtccaacttggagttgactcagtgtcgctttccttgctctgtgccttgtgtatgtttcgaacatattgccggtccatgctcttactgtctcctagttaatccattttgtcatgattcactgggttaattatggagtctcggtaatctgataatcaatagtgtccaagatagtatcaggacaccctgattttctatgatgcccatatggatcagttgacttacctgaagcaggtcctccagtggtttcagatagtatcaggactcaaaatcaacctcggcaagtgtgagattttcccggtgggtgaggttgctaatattgatgctttgtcttatgttctcggatgtaaggtgggctccctctcctctacttacctgggtctcccattgggcgcgatactactgtttggaatccagtgattgaaagggttgaaaaaagattagcaggctgacagaaacggtatttgtcaaaaggcggtaaggaagtgcttattaaaagcactttatcgagtatgcccacctattacttgtccctgttgcaagcgccggtgagcatcacagaaaaactggagcgacttcaaaggaattttctttgggatgcggcggatggaactagaaagtttcatctagtgaattggcagacagtcacttccccaaagaagtggggtggacttggagtaaaagatcttagggtattcaatagagctttattggggaagtgactgtggagattcggggtagaagagcatgccctatagagggaggtcatagtagaaaagtatgattccacgggagggggttggaggaccaaggcaatcacatcacctttcgggtgtggcatgtggaggagcatcatgaagaatttggaagcattcagtggcatgggagatgggaggagaatcagcttttggaatcataagtggtgtggagaggatactctgagggtctccttccctcacgtcttcagagtttcaaaccagaaggaattgattgtccaacagattcgtaacgagcatggagggggtagtatgagacctctcatttagaaggaacatgcaagattgggagattgcggagctccaagatttgttgatactgctatatgggcaagacaggccccgaccatcttgtgattcttggagatggggtttgcgtggtgatggtttgtttaccgtaaagtccttttaccagagtatgttggtgagagaggaggccacttttccatactcctcgatctggattcctaaggcgcccacgaaggtgtgcttttttgcatggctagcggcgaggggaatgatcttgactgttgaaaatcttcgaaagagaggaattacacttgttagtgctacatgtgtaaaagctcaggggaagaagttgatcatcttttgttgcattgccctgtgtcctcggctttgtggagggcaatcctgaatctttttggtgttcaatgggtgatgccaagcgctgtaaaggagatgttatatagctgggtcggtttccgtagaagaagaaagcaaaaagcgtggaggttcgccccgttagctctcatgtggatagtttggggggagagaaataggagagcttttgaggggattgagtctcctttttcacatcttaagaatagtcttttatctttgatcgctttttggtgcgcactcatatagcccctacttgtataaaagattgggcgccttttgtagagaatcatgttctgatgtaaattctctactttttgatatacttcctgaatacgggagttctctcccttttgattaatacaatttaccttataaaaaaaatagtatccaagaccttctcgtattttttggtatagtttatgcaagggatgtaatgaacctaactatccatttccagcagtgccttgactgatttcttgctaaatgaatcgggttaataaaagtaattacaatgtttatagcacttctgggtcttttcaagtggcaccataggctttgtgctgaccttggagcatttatcttttccatgcattaacttagttcctcaaaattctcgctattcattggtttctcttcaccttatagatgctgataaagatcatttgcaggttagcgttgaggaactatttcctaagcaagtggaaaatgaggttgaggttcgtggacctcctgtttcaaaagcttttgataaggaaggaaatcctaccaaggtggagtgaattgaattttgtttattgttttatttagtttattccgtattacaatgtgccttaagaactatattggcatatgttgcttgtttgttagactttgatttaattttgagcagagctttaatcaagtttcttatttcgatgaatgcaagatcagtttgtgtttgctaattcatagtcgatattatcaactcatacaactttcaggctgctgaaggtttttgtcgcagaaataatgtccctttagactccatgtatagacgagctgaaggtacgttacatcagatgaacattctttcgatgtcagtgtttgttcatgtgaattctggtgttcatttagtctatcatatgctattcatagaaaatacttgcgcttaaatgtggaaaactgcttagatttgttttgtgacgtctgatctgctattcgttatctgtgtcaacctgaaaattaattactaaaaaatctgataactttctctgaattttctattccattttatctttttatttcaaagtttcagtgtctggttaaggatcttgtaccttcaaaaacctatggtaccttttcaatgtcttagcagatatttgttaaaatgtctgacaaaaggatctgttatttgaaggttgtcaacactaaaagcaaatattgggtcttggaatgtattcattgatattctatgacttgtgtcggcttgatcttagtgcctaagtgtgttaaccagaatccgccattttgattggtggcaatgcttttctaaattattttgcctgaatcttttttcactttctgctgatggacttgaagtttggaattatcattattgaccagaaaaattgataggagatgtatctccagttgacctcgaggctaatttgatggatttttcgatcttatatcggtaaagagtcattcacttataaaaataaaatttgaaatacatgaaaactactataagttgctacttttttccatttcagaatgaggatatattacattattttggtcaaatattgctcctttaacttgggaggtgaaaatgacaacaattccgagaaagaggcagcgccttttttttgtctttttttttctccccaattttgcatagatctaaagcgtattaatgatcccgattaggccttctaaatatgccactcatgtgtaaactatacatagccagaatcaacttatgcagagcttgttaatttacaagattgttgttgcattgctaatatactagtgtttttgtgtcaatagtttgcatgttacttgttagtgtaacaccgtttgtgctaacaatgtttgtgttttcaatgtgtatctctgattgcagggaaaacagaatatgtgtatgctcgtttggtggagccagcacggcttgcatttgaggtacactgagaaaataagtgttttgtgtatgttttcatcagaaagtaaaatttcccttttcagcaactagctaactttagtagggtgtgtgaccaaggctactgctacaaattgcagagttaaccattgagattccttgtgatgtttggctgtatttgataacgattgtatgaacaggataatggaaatgtgtatattacctttgttcaagtccacgtaagcgaattggctgcaaaatagttctgtcgcacatttaatgtttatgattggcgtcaagctccatcaaaatggtgtggcttcttttcttctgaagctttctctgtctatttgtgtgtcaatcctgcatttctctgtctataagcatcctgcatgcaaccaaagatatactgttactcaaaattcttctttcactttgatttgtccgaggatgaagctcaccctcctaaagaagttcactatttttatagtttatgctgaggcttcaagtgatttgcagtaacgcgaggtcataggactgagaattaccattttgaaatagctggaataagaggctgcaacactatgttccctcaagaagtgactggtgggtaggaagtgtatagatatctcatcatatgcttgttcatcatacgttagtgttttctgacgcagaggtgtctcaactactacatttcaagcacataatgctatggtttcaggtagtttcagatctaaagttcatctcaatacatgtgcgattattctagagggagaggtagagaacattgagcagcttttgcacattacttaattgtaagggtggatcagtcttaacaatgtacctgggtctaccaatggaaccacctataagaaacgtgtagcacattgtggcagtttgctggtcactggttgtcaagttccgggacagattaagagaaatgaccactgtaattggagaattcggtagtaaatcttgacaaagagctatttgttcaacttgggctggctttcgtccaaggacccaatcttatttcattttctattttctttttatttttataattttaaatatattttcaatgattccgaatgctgagttggcaaataagggtaaatatgttccaattttataatgagggcatgattgaccccacctattaacggagggttaagttagaccatttcacatagtggaagggcaaatctggaccttctcccttttcatttgtatctttaactgacacctgaaaaatttaaccttttctgtttggtactagttcaagttaatttttgcagtttcgtttatgccatcctcaccaatagtacataaaaccttaagccgttccagtggaaattatagccttttgcatatgcttattgtgtccctgaacaatctcttaaaagttgctacgtgcagttcttctgttgctctgtataaatttataatatactaacaagtatgttttaatttttatttttaattccttagtttttcttagatctcattgtttgagtcactatcgacaggttttgtctgaagagctacctgtcataatctccagcatatcattccccaagtctatgcgttggaactcggatgtatgtactatcactttgactaaccctttgtctttggaatatgcgtgagtcgtgaccaaatttgtgtttttctttttcagttggtttattataaagtgttttattgccttgtttgatccttaaaaaaaaggaatattatgcggcaaaccggtttctataaccagaataatttgtcttcttgttaaccttcctatcaagcttgcagggtggcaagggaaaaagatggcaagtagatattaggatgtaaagttgggttggaactaaactctaatgccagaaacactttggctgttaccatgagaaattgaggtttcaccagaaagttagtttcaaatgcatttagcagctatcttgtccctattgttgtcaaaaggaaaagaagcctttgttttcattcataagaaattttttgatagagaagcaggatatactgaagaggagtaattctgctcaggccaaataagagatacgccagataaaagaaatcctccagtcatgagcgggcaattattcatgaagaagacctatctctttacatcgcttgaatacttactctgtcatagcatatgttgctggaaaaaaaaatcaatcttggaatgttcagacgttttgctttatcctgatatgcaatatcacacctaattaagctaataagatattctgttccatttctttggggattgtggggggtgtgttttcttcattgtcctttcccttttaaaggaactttctccaattttcagcacgtatgtgtgttcttgtagatagagatccaatcatgtttcttttctgatttttcatatcctttcttctttttgaattgaagttagaggtttgtcataatctatttgtccacgatttttttgatgttaggaaaaaagactaatttatatgttttatggcattgaaatatggcaatagtaacatattattctggaaaaatctacataacttctgcttttcgtggttgtcatttggaatgcttcccgttcttcccccctttttctctctttccaataacaaaaggcaaaatacctaaacccccccccccccccctaacaaaaggcaaaatacctaccacccccctcccccctaacaaaaggcaaaatacctacccacccacccccccacccccccaaacttggcacggattattggtgacacccttgaactattcgtagtcctaattaccctcctgaaattagtaaaagaaaggaaagtacagtcaaccctgaatattaagtgtatatattatatggtgtcctttcaactttctctcttctcctttttagtattgcgacaaagtaatcaacttgggttatgtccatgggagcaaatctttttcattttctggtgctataattgctataattggcatttcttcaaaatgtattcataaatttatcttgaattctttcttcacagctcctaacttgttaaaatctataactataaaagaatgtataaattctatatgaatatagcgtgcattgagatattgttatgtaggttgcattcagcagacccatccgttggattttggcccttcatggagatgtagttcttccattcatttatgctggagttgtaaggcaagtttgagcacctgcttgcactttttttttttggttcaaaagaagttccattcctactttattccaaatgtgcctaacaggagggttgaggtttcagtaatttatcaactcctaaattatattggcattgatttatctcctcctattgcactcacctatcaccaaagggaggggggcaggtgggggaaaggcagctaattctctgtttgatgtcctctgtcaagaaagtctcgagaatttttgtcaagtgacttcagtaaaatgttaaatagaatgaaaaaagctctgttggatgtggttatttgaagggaaaatgaaagtttagtagaagaaactagtgagtgatctcagctttctttcaatatccgactattttagggcagtgcacccgcacttgcagggaagtctttcttgaagttgactttgtgatacacttgattgtctttttctttcttcctgtgaaacttccagtgtagatgtatccagtatttccttattttacaactaccataattttacattctcagcaggctgcagtaattttagctttgattttcatttttcaaattacttcagaatgcatcctgttggagttcaccagatttgttaatgaaattcaaaatcttgaatttgtgccacagcccttggtaattcaaaatacacaccgggggcacattttttcgagaaaaacttggactgcatatatttttgtgcatttatcagtagtattcccgattttatgtggtcagtgttcatttttagttttttactggttttatggcgtttggtttgtctcttactagttactacttatttgtttattttcctacagtggaaatgtatctcatggtctacgcaatactccatcagctacagttaaggtctgtgaacaaaattgtagacatttcgcttccgcctttctcaccatatttttatccttttgttgcatctgccatgtgttctctcttattacgattgaatatcaagggaatttatattgttatatgtgcaaaatatgcctagagtcattgaatttgagtatgcgactattatacaatattccgttgtattttataagatatcataggatattatgtctgaacattaggaagttatataacttattagaaaagaaatctttcttgtacattgttgatatccaacttaatacaactgctcttttcttttttctctattttcacgtggtgttagaaccattacgatcttgtgttttttcttgagaaggttagaaccgttacgtttttgttaaaggcataagtagcttttgccttcggcagtcagccttacaccgcctgcctagacagagtttttcgttcttttcatagtttcactggtctcgtctcttctggtggtcggttcggtgtcacagctcttttctgtttcttccacaatatttgactattttagaatgtctttagtgtttgaatattgtgtataggccagctttttaagtaaattggaatttggaaatactcctaatgaaattcctattttcatagaagatggagcaagaaagcctctttttggtatgttgaaaggcggttaccattcttaaagagatggtgaggccttgaggtgaaagatcttaaagtttatgataaggccctattgggaaagtggctatgaaaatttgagattgagaggcatgcttgttgaagggaggtgatagtgaaaatgtcacacttccatttgggaggtcgtagaattctgaatgaaatgctctataaaacacattataatacaggttagccaggacaagtaggcgtgagtacgggagcatggactagtcatagttatggcgtattatcccaagctttttattagtgaggaatctggcttctcacccatcagctggatccctagggttccaaaaaatatatgctttttaacatggttgacatccagggtagtggtccaatcagttgaaattttgatactctctaaccctctctgtctatctatacatccggtccattattatatctcctttaaaaaaaggatgaagtaaagaaacaatatgttaagtctttaatccatgtctaaatccttgaacaaagttacatgtgcaagagggggttagggaattctatacttgtccctcatcggttatgtaagagtttccactggggtttaatggttttggactacgccatttgttgccttaaggttttgggttggatgtttagattttttcatatggtattagagccaaacccatccctattcttggtttacccaacattaggctcccacgttatgttgtccccgcactagatgtccactcgtggacgtccaggggaggacgggtgaagtgtcctagattggttgagggaatgtgatgttgtatcctagatggtcttggatgatccttatctcatgagttgtcttttgaggttgagttaagcccaagacacattttcttaatagcgagattttcccactgttaattatgttaccatcaagaaaaaatatttaccaatgtagagactaattacttattatgtcttacatagcctaaaagactcctatattaaggctgtattgtgggccgggcctgggcctaaacgggctgagccaaacggtctcgggccttgatgggccgggctttggcggtcccgggccaaatagtcccggtcttcacggtcccaatgggtggaaccggcccacagtggtcctaagcccacatggtcccgggctaaatggaccgggcccacgggcctaaacgggcctaatgagcttttttgttccgggctattttttttttttaatttttttatctaaggcaatttcttgtaaactatatatgtatatactaatataaattgcttatatatagctatataaatatatatagtatgtatagtatgtatatataagggtgtattgtgtgtatatataattatatattgccttatataatatatagcttatatatatatattgccttatatatatgtatgtatatatatatatatacacactttatatgtattagatatatatatatatatatatatatatatatatatatatatatatatatatatatatatatatatatatatatatatatatatatatatatataaaattatagtttatatgtattagagatatatatagtgccttatatatatgtatgtatatatatatatatatacatagtttatatatattagatatatatatatagtttatttacactttgagatatatatagtgccttgtatatatatatatatatatatatatatatatatatgtattagagatatatatagtgccttgtatatatatatatgtattagatatatatatatatagtttgtatgtattagatatataatatatatactatatcaaatttaaacacaaaataaattgcaaagaaatattcaagggaatgtcttataatttttattattacgacattaacaaagaatgacaatatctattttagtcttcctcccccaatggaatgagcacaacaaggtactaataccaccattcaaaggaaaaaaaactaaggaagatatgccaaaatacaagttacatattagtctatgtattatctctaacaaatctcataaatccttcaaggtccggaggaatttctgttggtggtggtagaaaagaagcttgttcatcaccgcttccgggcgaagcagcatcctgcgcaagttccgctagtatttcttcataagcttcatctatctccggttgtgattctgcaagtccaaaatttcttctttctgaacggatccaatctctgaagagtactgatttttccaagctctccctcatagacgctctatgatcaccgatttgaagtctcgcctgactgaaagcgctctccgatgccactgttgaagcttgaacacttaaaatatctcaagccatccttgaaagaaccggatagtgtgtttgtttgtccttccaccattccaaaacatcgaaagagccgtcgggattctctgattcaagtccctgcgacaaataaacttgaagctcatttagttgtgaactatcaccaaaattatcaccttgagaacccctgaactccatccaagaacaaagggcttttaggcccgcagttcttttagatgattgcgaactagacgaagtaggagttggaacatttggcctagcatgatctaagacaagttgataagcattataaattgtttgagcatttattttaactgaggcttttgcatctccaagtatagcaaattcctcggctgaaagtgataaagcgttataaatttttgaataccaaaagtgaggacctcctaatttcattgtaggatttaacaatgcagcaacaccaaaaatagagggatagggaaaaaatattttttaaacttagctttcatagaattaatagcttcttgataaattactccaccctctgaaaattgagtaaataaatctacaagtgctgcaatataaactaaacagttagaaatagtaggataatattggccagataattcatttatagcaacatgaaattgttctaaaaagtctacaagcattttaacattactccaatcttgatttgtaaggtgctcatcatcatcatcaccatcacctacacgagcattatatgttgcgcttattgggttcttatattcatatgcaacaactaaactttcatacatgtaattccatctagtcggacaaggtttaggaaccaaacggctatttttaaactcccaaacggttggaaattgaagaccaacggctagattttaaaaatagccattggggcccgttaggcccggttgaaccggcccaggcccgcctgccggtcccgggcttaacggtcccggactcacgggctatttgggttggaccggcccgcttcgggcttatgcaccattagagactggcccatttgagaccagcccgtttggcccgcggtctcgggccgatcccgggatgggcccggcccacaatacaccttatcctatatatgtttttaataatcattcaattcaagttcttgtttcctttgtctctattttaaatattttattgaaattcatagcttcactttctaaggagaattactatactacttcctttacctttggaagcaaaatctctgatggattctctcaacaaaatactacagattttggatgcagaaacctatgcaaatgtaatgcaggatgctgggattcttgttgatgtcaaggtaattcaagttttgtatgaacttccatttgtatttcctatgcttgttgatgatttttcgaaatattcaacctttatcaaatatcagcaacgcaagaagacaattatggagcagtcaaatgatttagcaaaaagtatacatggccatattgtaatgaaaaatgatttgcttgatgaggtaacagatgaagtttcagactttttctattcaatcgtcagacgaatagtatttaagcattttcctggatgcttaggttgtaaatcttgttgaggcaccactacctgtacttggcgaatttgatgactccttcttagagcttccaaaggagcttcttataatggtaaactcgagtactctctggaactttaaattgttttgtcccttttgtcattttgtgattttattagggttgagcagaaaatactaatgcctctggtgatgggaataagaatttcgaaattctacttaagggcaatccctttttaacccatctctctctcaggatcagaaatttagatgctacagttctgggaagattatgtaatatttctgctagtgtaggctgaaatactataagagcttttctttaggattaaacactatatgtgtcaacactcaacagtcctttcttggaccaaaataataacatatccctacttctcgttctttcattcggactatccaaaaagtaatagcttaattcatatataactgcttaccggttgcagtgcagggaagaattacatggttccatgcatatctgttatcatcccctacctagtaaattgaggtgctagtaactgtcatcaagcatgccttgactgcagggtcattgagggtactggtttaagaatgacattctgtgtttgtcattttccttgctattgcatatggctatttttgagcatttctggagctcttcgtcctgttagagtcagtttatctaaaagctgtgtttcgcgtattgcaggtgatgcagaagcatcaaagatacttcgccatgacagatgagaacggtaaactgttgccgtacttcatcacggtgagaaatccttactatcttgtatctgtggaaaacagtggcatgcttagctgaacgtgagatgttaatttgtgtctgtaacttgatatggatttgatctttcaggttgcaaatggatcaattgatgacaaggtagtcagaaaaggaaatgaagctgtgctgaggttactatcctttagttgggctctttccctgaacattctaaagttttgatctaggtgctacatgcaggagtcgaagcaggctcaaataagatacttgcaccttttatgatttcactttgatcctgtatcagctttctttatgataactggtatgtgcttaaagatatgaactgcatatgcatctgtgcagagctcgatttgaagatgcaaaatttttctacgagatggacacaagtagaaaattttctgaatttcgtcctcaactgaaagggattcttttccatgtaagtcttagatttccatcttaacacttttcttttttttagataattgcagcttttgttggtctctctgatcagggaattcttatttattgttaaacatagatacaaggtttagtatttaattctttattctgtgaaaaggaagtcttgtagaattgtctataatatatcaaatcttaaattagtctttttgatggacataccagcactttcttggtgcaattactgaatctcacttattaaatgaatatacatatgaaactataatctcatatcgtatatctgactagtgctttgaacaattttgttatgagaccatagtctcacatggtatatctggctagtgattgaagcaaatttgttggttcttagcccttaatttctgctgatctagtttttgcaaaatgataatgttgtctatgcaggagaagctaggaactatgttagataaaatgtcacgagttcagaatttggttagtgaagttgggttgtctcttggaataggcgaagataaactaaaagtcatccaagatgcagcctcattagccaatgcagatcttgcaaccgcagttgttacagagtttacctctctctcagggacaatggggcgccactatgcacttagagatggctattcagaggaggtagttagaaccacatttttatggatattttcgtggcaagttgagacttcaattttcgattaatcctagtttttggtttttgattatcttctaattgtccacggtgtgggataatactgggtatgttgttgttgttgttaattatcttctaaggggtcgtttggttggaatatgccttatgccggtataagttatgctgggattgttgtttattcactgtttggtatgttgtattaagaatgccaattgcataatttctaagaataaggtataagttatactggtgctaattaccccaccctctataaggtataagttatcctggtgttaaaattaacaccgggataatttatacctggtttgctaaccaaatagaatattaaggtggtattaaatttttatcacccctataccttcttatacctcataccaaacgatccctaattgtatttgctaattgatcatatacatatgtgtttattctaaatgtacattaccttatgtctggtctgtggtttaatcgttatattagcaccactgcaaaaaaagtgtcttccaaagcactgaggaaatgaagttagtccgatctttttctcttttaacaggagtggttctcttggattttaaccttcacttagatcaaattccggtggaatcaatgtttaattcgtgttttagcagcaataatcaacatcagaagaggtttatttcaaagagaggaagttttgcagcaaatatgctgagaagattccagtgttgtcaaatgctcatttaaagcgtgcttaagccttgaagctcaggaaagctcagggagggtgcttcccctcgcttaagctgcaattcgatgtagtcaagtaactaaggcgtgcacttcactgcccataagttctatcttgaatcgaacagtctaaataacacaaactcggcaaataagtgtacttctttttaaggaaaacattatgaatgaattcattactttttctttaattacatatatatttttatcttttttccttcgttgtgccttttttgtacaaagcgcacacttaaattgtatttgcacttaaagccccagtagacctatagcgctttttagagcttttcgcctttgacaatacttgagggttcattgttctatccttttattttgaataagagaagaatttcttttaatatggacgagtacagagaagaggaccaggtatctgcaggctagaaaaaataaattaaggggaatacatagatgtgtctttcgccattggcttaatatgtttgcattcatgtgtatgcactcttgtaacagcatagtgatgtcagtttcatgcggcaaaggcaatgcaatatggattgttttcacagagagttgcggtctactttgtcaaatcacatgttacaggcttgatgcagaatattgctgagtgatttttgaatagattgcttaattactatttaataacattatcatgtaattaagtcccaatgatatacttggctgaggcaaaggttcactatttcaaagaattgcctgttgtttaactttgtatgtagattcttcactttgattaagaagctatgtttctcggactctctaaaagtgctgccgcacccgtgttgggtcctccaaaaatgcaataaattttgaggatccgacacatacccaacaacatttttgaagagtttgagtaacgtagttaagaagagtgtagattcgcacttttgtggtttatttcattattttggtgttacattgattctcttttgattataaaaatgtagccttttgtgaaagcccctagggctttcgtctagttgtaagagggcaacacgtgatgcgggggttaggcgcgcgtcaccgggtcgaactctactgagacaaaagcctgatatttaagtggagaagggtagtagggtggacccattatccaccgagttccaaactgtgtatcccttgccttccgggatttctcagttataataaagtaaacttttgttatttatttcattgttttggtgttattttcatgttcgttgactacattaaaagattcgctgtcttgtgctttacagattgcagaggcgttgtttgagatctcgcttccacgattttctggagatatgctcccaaaaactgaagttggggccgttttagctattactgacaggtatgactaatgttgatcacctttcagtttaagttttctagatggtcattaggattatgaaaagtatggttcatgtcactgcgtgtcacatgaattgcctctagcgttctaaacaaatatgggacatctttttttgcaaatatttttccagttgcttgagatcagtgtagaatgattcgtagttgagatgttgcacgtgttttgcattaaccttggggagaaatttgcaaatgcatcgaaaagtgtagtgtacttgcaatcttattctgatttgtagtccgtactctactaacctgcttgcctcaaattggttattcttagaaattagctaccactgatatcgtatgcaaggttgtttttatattgcaatacttctacgtgctttaactccaatgcacttaatatcctagtgacactatgataaatgtctttccctgaatctcattctcttgactgtgcagttcccaatttttatttcgtctctcatatagtgctatctctactgcaggctggatagccttgttggcttatttgctgctggctgtcagccaagctcaagtaatgatccatttggcctgcgaaggatctcatatggtcttgtatgtcttaatctttgaaaaactttgttcatttaaagaactgtaaaataatgcttgcgtttgttttattgcaggtgcaactcttggttgaaagtaacaaaaatatagacttaagacaggctttagaccttgctgctgcaatacagcccattgaagtagatgtcaggacaatcaatgatgtaagattgcaccctattcgtttattagtttgtagaattgcagcagtagccctacttggttctgttgaaataaaggaaaaattcactagccctatttggtcctgtatgctagaaaattaaatatgctatatactagtaatactaagttaatcctggtaaacttcaatgataaattggaagtctttcgtcctttatatgatgcaatcggtcctttgcttattctcacaaagtcaggagtcataatctgacaagatacatctttttcttttttccatttaaggtacaacaatttgtatcacgaagactagagcaatttctggtatgtctcattttcatgaacacctattattctgctgttgttatttgtttttctcgttttcttttctttttcttttcacagttagtattccttctattatgtccctgttttatctggagttggatttagctttgcctctagggttccagatcttagcacgtgaactagttctaagtttctttttgtccagtatttgaacatcatgggataattttgatctcttcagtgatcctttttatcatttatccatgtgacgaagagtatgatcatttccttattgacagtcttgagacctttccattccattacttatccatgtgaaaaagaccattccttatttccttattgacatgttctgcgtttcaattacagatggacaaaggtataagccctgaagtcgtaaggtctgttctttccgagcgtgcaagtcaaccttgtttggcaactaaatcggtgtacaaggtaactacctttctttccttttattgtgcactcatttgttttatgctttgctgatacttttggcctctttcatatcttaagaggcaacatttcttctattacatacggcaatttgaaaaaaattctatttatgtttatcaacaaaagtcagaatatcctctatccataaggtgcaaggagttcttctcttctccattcaatccgttatacattgtggaaaagacaattaagtaaataaaatatgctctctctaacagcttaagcttttagatgacatgatcacacacttcaacattggtaggcccactccattttaacctcgatttatcgttaccgatgttgggcccccatttatattgtcgacgctccaatttgcaggcctgggcgtgagggaggcgttgagtcccacatcggtgggtgtgggaggccatttgtctccttatatggccttggataattctcactcacgagctagcttttgggaatgagttagacctatctttaatatgatttcaaagcaggcagaggtcctgggttcgagtctcaccaccaccattttaaaaaatgaatttccacgtacttggccaatgaaaaaaatgaatgaagcctgcacatgagggcgcctgttgaagagacaattaagtaaataaagcgtgctctctctaacaatttaagtttttagatgagatggccacacacttcaacatacatgttgaaatttcattagcacatctaaaatataatagtagtttgattattttgtaaatgcactaatgagttttctttctcttcaaagctccttattgctcagttcatgtagtccacataactgctcgagggcagtgtccttttgaaaaattggacgcgttagagatacatctgaacgttcaggagtttgatgttcccatgatgcatctgcaatatgttatatctgcactagatgttcaactgttgtctccttccaaacacccctactctccccctgggctgccctctacaatagtacaatccgaaaaaattaaggatttctaattttatatgaacttactctttcgtactactccccaattgcaccatagttcgactttcaaagcaaagtttgtaattttgaacatgtcctattgtaccattaattgaaaaaaagaacatgttcattaggattctgtcactaattattctgaaaatctaatcatgataatagtgttttgtgtattttttgaattactcctatttaattatcaattctttaatttatctaaaagagtttatgcatatgtgcaatttggacctcaatatgttgtgttaagtcattgatttctacgtaaggtggcaagatgatatcttgagtagttttatatccagggccttggacaaagacgcatcagaatgccacataaattgggaggatgatgtgttctttttaaccctcttttcgtaaattttcctgcatgtactcatagtgaaagttacctcttcagctgtatttgaatatcgtgtaattgaaatataaagtattactctttatcaagaaacaagaaatataaaatataacccaggagctctgagctttaattcttcaaaatgtggccgagtgttggaaattgtttcattgcagttaaacatgtactttgtcttcgtttcgtgttgaatataaagtgtacaattggctctgattggagcaatgagtgagtattgtgatgttttaaactgtaattgatattcattgccatcatacgtagatggagtccttgtccaaaggagagcttttgcctaaggttgttgaagcatattctcgtccaacaagaattgttcgtgggaaggatgcaaatgtcgatgcggaggtgaatcttattctatgctcaacaaatttcgttgtatagtttaattgctattatactccattatacaagttttgcaacattctctgttgccattccattgattttcctgtatagaataactatgcatgtcaattgcacctgtaacgaaatggtgttccttatgcaaaaggcatttactgaggtgttatgtaggacagtagaagcttttctctatggctcaactataaataatttgtttctgatctgctctgctgtactagttaatacaattgttaatattgtcaagctccatggtcatctgacgatgtgtagctttggactcccattttagctggctgactattagtgttgttcgttcttatcaagtaaaacatattctcattgtaaattcaggtggatgatcaagcttttgaaacaaatgaagaaaaagctttgtggagcactttcttgtcactaagaagtaaaactcatccaggtattgcctctcctccagattaattgcatttcctaatatattcaaacaaatatagctgtctgttatccagattgattgcattgtaaatacattcaacatttagctagttgattgagtttttaccaacatatttgcaagtgaagcgtgcatgtatgactgttcatttacagacatggaagttgatgattttgttgaagcatcgtcagttcttatagaaccgctggaggattttttcaacgaggtctttgtaatggtggtaagatcctctgatttctttttacttcttagatttgaaaaacttaaatagttctgaagcattaaccaatttttataagcgcattggatagagtagtatcatctttgctttgcttagtttattcttttcagcatcctattgggggagggcttccttgcttggtgcatgcacccatctgcttatctttgttaacataactcctctctcaatcttaaaaaagtgtagtttgtccgtgattgtccagtgctggtacaagtatactgtatagctgtgcctccctaattcttcatattaattgttctgtatgcatcttgcaggaagacgaacggatcaggacaaaccggcttgctctgctgaagaaaatagcagatttgccaaggggaatagtagatttctcagttttaccgggattttga

SEQ ID NO: 29 - DNA, 177 bp, Nicotiana sp.
atggatgctttggagcgggaaatgactagactgcggacctccgtcaccgacttgggatcctgcatggatgttgtggctgaccgacaggtgaagtcggaaaagaaattcatgggttggttgagagcactgggttgcgcctgcaacgtgaacccagacacagtttcagatcaagagtga

SEQ ID NO: 30 - DNA, 342 bp, Nicotiana sp.
atgaaagtagcagagatgaggatgttgaggtggatgtgcgggcatacaaggatggataagattaggaatgaagatattcgagagaaggtgggcgtggcccccatggaggacaagatgcgggaagtaagactcagatggttcgggcacattcagaggaggagcactgatgcaccggtgaggaggtgtgagcgactggctgtggtgggcacgcggagaggtagatggcgacctaagaagtattggggagaggtgatcagacaggacatgactcgacttaggattactgaggacatgacccttgacagggaattatggaggtcgagcattaaggttgtaggttag

SEQ ID NO: 31 - DNA, 3624 bp, Nicotiana sp.
atggcggatttgaacccatttgatttgctgggtgatgatgacaacgatgacccatctaagctgattgccattcagcagcaaaaagttgataccgctaagaaaccctctgctccggcggcggcggctaagaagcagccggctaagctccccactaagcctcctcccacggctcaggctggtgagcgtcacctcagtttattatgttctcatattttgtatattacctaaaagtagagaaaggtattagtatttcgatcatgtttagtgtattgagttaagcagatattccatattgcgcagatagcgtgattaactttttggatgttgatttcaacgtctaatcaattaatatgacaccaacttggtgtattgcttatgcaatactaacattgatttatcaaaacggaagtagtcatgacgtacatagacctttaaatataacagtctatacgtgtgacaccatagtgattagaagtgctaaaagggactaggtttatttaaaatcacacgaggaattgtctagaagaaactccattctcttaggattgatgtgggctcaactaagagtatgagagaatcgaagcaaagtactcgcgcagatgataccagctatttaagattcatgcttagttgttgttgttgttcacacctacattaggtcgaggtaaggataagtgtgatagaatctctaattttccttcaattacttagcagtatcagcatgaaattgggttgaatacagtggaatatatagaggattcatgtcattaacccgaactattttgggattgaggtattgacccaaaaagaaaaggaactagtttgagaatgaggcataatttattgatataagaaagaaaatataatgagttaaatactccaattttaagagggaagcataagattttgtaatttggacctttatttattgaaggattggctgttgtgtcctatttctagtgtcacttcaaaagaatgagaaataatcccattcctgctgttattgattcctcttggtcttgaaatttcagttgttcatcatacgtacatacttttttatattccacacaagatgtctgacggtgaccagttctctgttattctatttccttattctcataatttttgctagtgggtccacttgaataatgatatggatgaattactttttgtttatatcttttgttatagtcattgcacttatggttcttttcctctttttcttttgcaagtattcagaatttacttattgcttctttgtttcaactgtgtagtcagggaggcaaaaacagaggttggacgtggaggaggtagaggtggtggacgtggttacagtcgtggtcgtggtggaggcgggtttaatagggaagcatccaacaatgagaatttttctcgaaacagagaattttctggtggtatagctgcacctgaagatgtggaaggaggaagaccctatgaaagacgtggcggttacggtggaccccatgcttttggtggtggtcgacgaggcggttttagtaatgaagaatttcctgagggagaccggcctcgtaggatatttgagcgccgtagtggtactggccgcgggtagacacacctttcttgtctgtgttaccatcaccttttgttgctgtatttgtaaagctttcttacttttccttcgctatacgagcagaggtgagataaagcgtgaaggagctggccgaggaaattggggaactcaagcagatgaagttactcagtgagttttaccttcctacatagtcctaaacagactagtgtgaacatcatggcacattctatctattgattatggtgttgatttgtttgtgttgtgtattataggattactgatgaagttgctaatgaaggcgagaaaaatctgaatgtggagaaaccctccgcagatggagaagcaggagacgacaagaaggaaaatccagctgctgaagctgaggacaaggaacctgaaaataaggtgaaccttttgtatcatactcaacacattattgataggaccttgacgatccctgtgttgctgccttgtttgttgacacatgtcctgctctgctctagaaacagatgcttaagagagcttgagcagtcagaatttaacaccttcctttttgatggcttcgtgctcaattggagtatgctaaatcaattgggtgtttagtatatgctatgacatgcacttcaccaacattgctgatgcagttgctctttaattaaaagaaggtttctgaattgacatggtttttgcttcatatattgtttcacttaatttcaattattttatctatatattgttgtttgtttttataatataaaaattataatgctcacctgtgctattagttattttttctgcagtactgtatatattaaattcttttcccttcgaacatacatgccttcgctgcagagtaggtgttttagttgcactttactttatgtatttcgcttcttacaatattgaccgtaaaggtagaagcagaggtttcatcagtagtagaagctttccaggtgttgttctagctgtggtagaactagtacttaatacatagtggagttgcaggcgatagttaataggtgttacatgtgaatgtaactcatgttccttgaatgaataggagatgacccttgaagagtacgagaaggtgctagaagaaaagcggcaggctttgcaggcacttaaaactgaggaaaggaaggtcgacatcaaagaatttgaatccatgcaacagctttcaaagaaatccagtgatgacatcttcatcaaattggtgaaattcttgagacattatgccctctactcatgcttgatgctagttatctataaagcatctcttgaaatacttctatgccatgatttttagggccccaaggataagagaagagagtctgctgagaaggaagagaaggcaaagaaggtacttattcggcatatgcgttctttcctgacaattgtttaaccagcaaatgcttttcatacactgctcaatagtgatttaccaagctttatgaacaatgcgtccagtctgttgcaattgttatatgaacaatgcttccaatctgttctagttgttattcttgctatacaccacagcagttatttctacttttctggatgctgttgcatgtgtgtcgatgaaaatggtatcatgtaacaacattgttgtagagggaatatttaagttgtatttcttctaaagtcgggccttggtttctttcagattttctggtaattgtttgacttgcgaacatatagtaattattgtagtaccatgctacaatttttacaataaaattccattgctcactcttatacatgtgcatggacaggctggagttgattgagatgagaggtgtcaaatcagcagaaatgagaatcatctaatctttttttcccttcttctctggctttaggcagtcagcattaatgagtttctgaagcctgctgagggtgagaggtattatgcacctggtggtcgaggtcgaggaggtcgtggccgtggttctagaggttatggtggaggttacggtggagccaacactaccagcaacgtggaagcccctctcattgaagatccgggtcacttccctacattgggtggcaagtga

SEQ ID NO: 32 - DNA, 3621 bp, Nicotiana sp.
atgaatccagaatagtaagttccgtcggcatattcctttgcttattttgcaatacttattggtgaagaattgaactatctcttcatattagtttctgtcattcaatttccttttctagttcttttcgtttcaatacttattcgtttaactgtggattttgtcaaaacatccttatctttatcgcagttgtggatttcacctataatccctaattcactaaaatcagcaatcgaacgtcgtttgagaagattaaaatcaacattaagcttaataacttattcctttttcaatcggtcccaaaaaatagaagttattttcaggaaatggtaaattggaaacttaaaaagtattaaaaatactagtcaccagttaaattcaaaactcaaaactgtatcttttatatttaaattagagattttaaatggtttttgaacttgatgaagaaggttcttgcttcatacaattcactcaattgcagctttttcagtaagtctatataattgcagttgttgattaacatttacaactactattttttttcttgccttgcatataccttattttcatacgcgcctttcttcataaagtgcgcacttcagttgtggtttgctgttaaattcctgtaggcacttggcacttcctattttttgtcattgacaacattgctttcatggttatctcagatcgtttgaaattccttggtgtaatatttctttcacatgcttgcacaaggtccaactagtaacctcctaagtcagttttttttgggtaaataggccgatatttgttggtcttcctttggtgtagagatgttctagataactaggattacgtgttcgtgatgcagcattaaatcatatcaagtgcaacctagaaaagagcatccaaacatgatctgtgttttttatgaagtaattgacttcaataatggcatcaagaagatgcaaaatatttactccaaacataatcaatgttggaacttgtaggctatatttgattgtagatgatagcatatggcaggtcaattatctcatgtctatcattttagcctatcaaatgaggtacaatccttagacaatctcttccgcaaattctatcatacatatcaatctaaccatacttagactgcatcatccaacagtgcatgatgatttctataatgtaaagactactttgtcttggtgtgttgataaatatgtgaaataatatttactaaaaagtatagtaagtttgaacatctagggaataatacgtaaatgtagaacttctgcccttccatatttttatagccaaatcaagtaggactaccaaatttaatcccaatgtgaccagtagatgttgctaaattacgcatatatagcaaggtaacaaacttctctcatattgatgttagcgcttgtttctattagtgatttagttttttcattccgggtagcgcttaagtatacaactttgcacatttgccagctaatggatgtatattataattatattggttgtgctttccggcagtgactacctgttcaagcttctgcttatcggtgattctggtgttgggaagtcatgtctccttttaagatttgctgtaagttttcaaatcttggaattgtctatactgacttttttctctagtcctgcttttacctgtctgaacgtacctactaaattcctgattgactaaacaaatggaggatttatggagcatcagccatggattctccatgtcttcatttctcagttccattctccacttggagtgaattatttgtcttgaataatccttaattttccagctagtagagtctactgaccctggtggagttgttgtattgctttttatgaaattatgaatcacctactcataaaaagctacatctgccatgatatttgagactcttcttttacacgaaatttatttttcacactttaatcatctggatgattagttatgaacttatttctggttgcgtcgctttcattgttagagattcttgatcgtgaactcagagattctcaacctcctgaaaagtttattagattatagttcaactcagagattctcaccctgctgaaaagtttatcagattatagttcaatgtggttaaaaaatttattctgcaaatgttggctgactattttatcgctttttaccatcaggatgacacatatcaggagagctacataagcacaattggagttgattttgtaagatgctttaattgtttatgagctactcaattttacatacagttggaatcttatgtgatctttttcagccagagcactcttacttttatgttatcactgatcttaccaactgttcaaatattttcatgtagaaaatccggacagtggagcaagatgggaagaccattaagcttcagattgtaagacttcacctgcacttctgcttcaggcctttcatattacagatattcgttgtgttgtgaacttttcatgaaatcaagatattgttgttttctattttgacactgtttagtgggatactgctggacaagagcgttttaggactatcactagcagctactatcgtggagcccatggcataatagtgagtagttgccttactttttataagaaattgtaaatagcaagtagttatctgtagagtctaatgccaactgctttctgtaccttttgacattttctttgcatggcctctatggtagattgtctatgatgtgacggatcaggagagcttcaataatgtgaagcagtggctgaatgaaattgatcgttatgctaccccaaatgttaacaagattcttgtcgggaacaagtctgaccttgcagctaatagagttgtgtcgtatgaaacggctaaggtgaatcatcttcgtgcagatatttaattatcctttgtccttaaatgtaaaacaaactgatctacttaaatttattcttaggcctttgctgatgaaattgggattccattcttggagaccagtgcgaaagatgctagtaacgtagaacaggctttcatggctatgacttctgctatcaagaataggtaaaagtgtatcctctttaaatagtgctcctcaatggtgtcttgtatagcctttccaagttgtggcctgatctttcatcagattcaattactaaaattttctgggagagggatacgtatatatttttatcacttccttttctgacattatggttggtacagaaaattgagagatatttcagatggtaaacataatcatcttacagttaggatcctatttgatgccttaaaatggatttaaacatggtcatggatcatttcgtgcaaccccctataacattttcacaagccaaaaaaaaaaaatctaaatgaaagatacagcaacttgtttggttctggcctcatcccttgtataaaatgtcctccaaataatcttttcatttacatttatgatttgagctggcatatgcgttgcttctctaaatttccataatttcattcttaacaagcaaaattccattatttcaattctcttttgctctccttattgcagtatggcaagccaaccagccacaagtactgccaagcctccaactgtaaatattcgtggacagcctgttgctcagaatagtggctgctgctcatcttga

SEQ ID NO: 33 - DNA, 321 bp, Nicotiana sp.
atgaatgacaaagttcctgacttcggtatggtaaacataccttcactcttgcagacttggtggagaaacctcccaccgagcaaccaaatcaacgaatggaaagatagagtcaccaaggctagtgagaagctagaatacccggagtacagcttgctggaattggaagggaaagtgaggaaaagagtcatcgactgtcaaaatgttgaggaaggcaaaggagaacgtctggcgatagcatttttactggaaaatctgcgtgagctggaggacttgatcaacaagaacattcaacctgaagaatgtccttctaggaccaagtag

SEQ ID NO: 34 - DNA, 351 bp, Nicotiana sp.
atggtgaaacaagctcttgcagcatggggggatttctctagtaagtctgaagatgaaactgatgttggtgatagttccataatggaagttgaaagcgaggaaaaggaatatgacctaacttttgctttgatggcccaatcagatgatgatgaagacaatgacaacaaagaggtaactttcaggtatgttcagaaaaatctgaaatcctacactcctaagaaacttatgtctttagctaatgtattgattgatacctatcataaccttgtagaggataaggatgatttgatcttagaacaaagggaagttgataaaaccatagatgatctggtagcgtgtgtagtgatctga

SEQ ID NO: 35 - DNA, 1558 bp, Nicotiana sp.
atggtgggaaaaatgagagatagctcagcttcaccaaatggttcctttactactgccatgacactaaatgaagaggggctaacctatgttcccaagcgttacattcttcccccatccttacgccccgagcgtaccctgtgtgacacatgcttgcccgttgtagatctctcctttctgcgacaccctcttcttcggcctcagataatccaggaagtacacctggcttgcaaggaactaggtttcttccaggtaccctacttgtcgtgttacatccatgtcacctgcaatcacgcactagaataagattgtcttgcctatttatttacttcagtatacataaagttcctcaagataggatccattgaatattatgcacacaccaagtaaaatgatgtcagatcatccgcatatagaaaaagcatttggaaatcaagaagcagaaataacttcatgtcacacacagggtagggttctaggcttcatctcctctgtcttctctcttccctttattttcaaatttgttaaaacaaatgtccaagaattcagctacttaggttgtctaacaggaagaaaatactttcaacctgaacgtaaaataacaacatgcatgtgataaatgactttgcaggtagttaaccatggaatcccactgtcagtcatgaaagatgccatagatgctgcaagcgaattcttcgatttaccaactgaagagaaaaagcatctcttgtcttcaaatgttcatgaacccataagatatggtactagtctaaatcatgtcaaagacaaagtacacttttggagagacttcctcaagcactacgctaatccaatctcaacttggattgacttgtggccatcaaatcccacatgttacaagtaagtctctcattttccttgcaatatgcttttgctgtcttatagatgcatattcttactgttcaagaacaatataattttttcaagtgcctaaagcagtttatcatgcagggagaaaatgggaaattacacaaaggcagcacaaaagttgcaagaagaactcatggaagtgatatttgagagcttaggactaaaccctagttacttacatgaagacattgcagaaggctctcaggtcatggccgttaattgctatccagcatgtcctgagccagatcttacactaggattgccaccacacacagattatggtatgctatccatcattcttcaaaattaccagggcttacaaatcatggaccgagatgaaaagtggcatgcagttccagtcattgaaggagctctcgttgttcagctgggagatcacatggaagtattgagcaatggcagatacaaaagtgttctccaccgagcagcagttaactcagaaaaaaagcgcatttcaattgccagccttcatagtctagctttaggtaaaacagttagacctgcaccagaccttgtcaacgaacaacatatcttgtcctacaaagaaggaagcttcagtgatttccttgacttcatttctcaaaaaaatatcatcgaaggaaagtacatagacaaactaaaaataaactcatga

SEQ ID NO: 36 - DNA, 312 bp, Nicotiana sp.
atggtcagaagaaatggagaaatactaaaaaggggtagctctagtaaactaaaaaactatgatctatgtcataagtgtggaaagcatggacacttcattagagactgtcctctcttgaagcaagaattctccaagaacaaccctaaaaaggcagttaagaggaacccggttccttttaaggacttcaaaagaaaaagatctgctgacaatgtgatgaaacatgatcttgcaacatggggacattcctctagtgagtctgaagatgaaactgatgctggtgatagttccatgatggcagctaaaggtgagtaa

SEQ ID NO: 37 - DNA, 1563 bp, Nicotiana sp.
atggaaaagagctcagcttcaccaaatgattcatttactagtgccatgacacttactgaagacggtctaaccaaagttcccaaacgttacattcttccgccatccttacgccccgatggaacccggtctaacacatgcctgccaattgtagatctatcctttctgcgacaccctcttcatcggcctcggataatcgaggaagtacacctggcttgcaaggaactaggtttcttccaggtacttctctcgtgtcatgtcacctgcaatcatgtactaaaatgatatagttttttatcctattttgttacatgtaaagttccttcgtgctgatatgatttaaggaagaacaatatacacacaccacgtaaataaaagatgttgtcagattccccacagagagacaaaagcatttggaaatcaagaaaaagaaacttcatgcagcatacatggtgcatttggtttctagacatatctcctcctcctcctcctcctcctctcgtccctttattttcagttgatcagttaaaagagatgtcctagattttagatacatagcggtttagcaggaaagagaataagacgtgcttcgctaattcaacctggacgtaaaataacagcatgcatgcaataaatgactctgcaggtagtcaaccatggaatcccattgtcagtcatgaaagatgccttagaagctgcgactgagttcttcgatttaccaaatgaaaagaaaatgcatctcttgtcttcaaatgttcatgatcccgtaaggtataataccagcctaaatgatgtcaaagacaaagtatccttttggagagacttcctcaagcactatgctaatccactctcaaattggattgatttgtggccatcaaatcccacatgttacaagtaagttttgcacccttatctgaaatgatttctgatagatatattttctcactgttcaagaataataaaactataggtacctaaagcagtttatcatgcagggagaaaatgggaaattacacgatcgcagcacaaaagttgcaagaagaactcatgggagtgatatttgagagcttaggactaaaccctagttacttacatgaagacattgcagaaggctcccaggtcatggccattaattgctatccagcatgtcctgagccagatcttacactaggcttgccaccacacacagattatgctttgctaacgatcattcttcaaaatcatcagggcttgcaaatcatggatcatgatggaaagtggcattcagttcctgtcattgaaggagccctcattgttcagctgggagatcacatggaagtattgagcaatggccgatacaaaggtgttctccaccgagcaacagttaactcagagaaaaagcgcctatccattgccagccttcttagtctagctctaggtaaaaaagttagacctgcaccagcacttgtcgatgaacaacatatcttgtcctacaaagaaggaggcttcagtgatttccttgacttcatttctggagaagatattgtggaagcaaagtacatagacaaattaaaaataaatccatga

SEQ ID NO: 38 - DNA, 666 bp, Nicotiana sp.; identical to SEQ ID NO: 3

SEQ ID NO: 39 - DNA, 409 bp, Nicotiana sp.; identical to SEQ ID NO: 4

SEQ ID NO: 40 - DNA, 513 bp, Nicotiana sp.; identical to SEQ ID NO: 5

SEQ ID NO: 41 - DNA, 547 bp, Nicotiana sp.; identical to SEQ ID NO: 6

SEQ ID NO: 42 - DNA, 225 bp, Nicotiana sp.; identical to SEQ ID NO: 7

SEQ ID NO: 43 - DNA, 1244 bp, Nicotiana sp.; identical to SEQ ID NO: 8

SEQ ID NO: 44 - DNA, 466 bp, Nicotiana sp.
atgccgttgtctgaactggagaaacgattgggcgtcaatgagttgtatgatgatgtacttggtgaagacacggtggaagactgtgttacaagcccaaatcccctcggtgtggccacaaaaagtcctcacactttatttgatggtgttgaacatcatgctgcaaacaatgctccgtcgacagatttgagtctacccaaagaactgcacctcgttcttccagaagatgttgtgctttccaagccagccatgacgagtaagatggaggttgccgcaagtcaagcaaaacgtctaaaaaccttcgagcctactccatggccgttgcatcttgatgctccaaactttaagccacaagagattatttcacgtattaaactttcttttgttaacacaatatggcataccttgtgtgaatggatcgaagagttctctcttgattctctggatagcttcacaaagttggaggaaa

SEQ ID NO: 45 - DNA, 506 bp, Nicotiana sp.; identical to SEQ ID NO: 10

SEQ ID NO: 46 - DNA, 289 bp, Nicotiana sp.; identical to SEQ ID NO: 11

SEQ ID NO: 47 - DNA, 852 bp, Nicotiana sp.; identical to SEQ ID NO: 12

SEQ ID NO: 48 - DNA, 720 bp, Nicotiana sp.; identical to SEQ ID NO: 13

SEQ ID NO: 49 - DNA, 396 bp, Nicotiana sp.
atgggggacgtttgcggcagagatataagagatccgaataggagaggcgcgagactgtggctaggaacttatgagactccggaggatgcagcattagcttatgaccaagccgcttttgagatccgcggctcgaaagcacggctcaattttccgcacttaattggctcgaacatgactaagccggctagggttacagcgaggtttcgtatgcgctcaccggagccatcgtcttcagcttcttcagaaaatacgacaaggaaaatgaagatagatgtgataaactccatagctaaaaaatacaagaaagttaaaaataacattcaacccgattcctccacaactcttcaagccgcaaccatctccgtatctttcactcattttgatccaaatccgccg

SEQ ID NO: 50 - DNA, 219 bp, Nicotiana sp.
atggtctcaagggaaagaacaggtcccacggatgaagacactcaggtgaccactttagctgaaaaatctgcaccaagcatacgccgagtgaaaattatgcgtgagcttggtttgatggctccttctggccggtcttcatctcatcctaaggaacgtcttcctccaattcagagaatagttgtttgtggtctatctgctgctagatccgttatgaagtag

SEQ ID NO: 51 - DNA, 1011 bp, Nicotiana sp.
atgtcttcaccaaaccctaaccctaggagagttcccattgttgataccttccccaattcccccattagacataaaagaggaggtaggcttcgtagcttagggtctactcgtggtggtagttcgtatatacattctcctagttctggtccttcttctagaactagaggttccctttctcacaaatcttcttctagtggtaaagaaccttctaaaccattacgtgagcctttagtagaggagatagtccctacagaactatctttttaccatgatagggaatctcttaaaaatcatgtttctgctttagatcgtggtgatacttaccccactcaaattacaaaagttttgactcttgtagttcgcaaagattgccattggaggttcaaaccagttattgacccagtcattcttgaatttttccgtttctttaatgtctgtttgggtcaaattggcccaatcatatggaggactgttggatgtttgaggcatttaaccaatatggctgacgtttcctttactttccctcacctgattcatctttactcccctaggcttttccgtaatagcgtttttactctagtggccaggagtaagagggttttggtgagccctgaagatgacaaggatcgtggatggtatgcccggtttgttgctgcccccagtgttggcttagtgggtaaggataacgttcccttctataagaagtggaattttgcaccaaccatgggagttgtggaggatattccaaatttccgtgattgggtagataaattgctgaagaccgcaccaatagatggtaggtcttggagaacactttctaaccattacggttggaaagtaaagactcatggatttgctattcgaggagttactgttgaagcagttgcgacctctcgtgtctcttcgggaacccgtactccttcggggacccgtatatcttcagaaagagcccgggaaatagtcttgggttcttctgcgaaaaggaaagctgttgaaagaggaaaattctga

SEQ ID NO: 52 - DNA, 684 bp, Nicotiana sp.; identical to SEQ ID NO: 17

SEQ ID NO: 53 - DNA, 564 bp, Nicotiana sp.; identical to SEQ ID NO: 18

SEQ ID NO: 54 - DNA, 627 bp, Nicotiana sp.; identical to SEQ ID NO: 19

SEQ ID NO: 55 - DNA, 780 bp, Nicotiana sp.
atggatatcgaacaaaagcaagcggagcacatcgactactttgtgaaacaaacatcagcgctcaagggttctgcccttaacaacgttattagtgaagccacttcgcatccctcacttttcgctttctccgagattctttctgttcccaacgttgttgagcttgaaggaactgaaaattcaatataccttgatttgctccgtttgtttgctcatggaacgtggagtgattacaaaagtattgctggccgtcttcctcagttggtgcctgaccaagttctcaagttgaagcagcttactgtgcttacgctagctgagacaagcaaggagcttccatatgatcaacttatgcaggagttggatgtcacaaatgtgcgtgaacttgaagattttctcataaatgagtgcatgtatgtgggcatagttagaggaaagcttgatcagttgaaaagatgctttgaggtacaatttgctgcagggagggatctcagacctggtcaattggggaatatgctacaaacattaactgactggttgactacatcagacaatcttcttatctcaattcaagagaaaatcaaatgggcagatacaatgagtgaatctgacaggaagcaccggaaggaagttgaggaaagggttgacgaagtgaagaagtcactctctttgaaggccgatgttgacttcagagggcatgaggagatctactctgaatctggtggagtgatggattatgaggaggaccgaggtcgaccgaagaggagacgacaccctattggttaa

SEQ ID NO: 56 - DNA, 396 bp, Nicotiana sp.; identical to SEQ ID NO: 21

SEQ ID NO: 57 - DNA, 1026 bp, Nicotiana sp.
atggtgaaaccacttgccgattcgcgcagcaacagagccgccgttcaggccaccaacgacgacgcttccgccagcaaactgtcatgcgtgaaaaagggatacatgaaagatgattatgtcaatctgtttgttaaaaaacccctgaggcgatctcccattattaatcgtggttattttgctcgctgggctgctcttcggaagatgctctatcaatttcttgattgcaacccaaatgctgatggaagtggcaatattaagaagcagatattgtcgcttggagctggcttcgacacaatgttttttcagctgcaggatgaaggaaaagcacctcatctttacgtggaactggatttcattgaggtgacaagcaagaaggcagctcttattgaaacctatagtcagttaagggataaagttggtgaaatagcatcaatctcatcagaaaagggagaagtccatagtgatcattacaaattgcttcctgtagatttgcgcaacatagacaatttaaatgatgttatagcccgtgcaaatttagaccccagtttgccaacatttataatcgcagaatgcgttctgatatatttggatcctgattcgagccgtacaattgttggatgggcttcaagaaccttttccacggcaatatttttcttgtatgaacagatccacccagacgatgcttttggccagcaaatgattcgtaacttggagagccgaggctgtggactactaggaatttatgctacaccaactttacaagagaaagaaaatcttttccttgatcaaggatggcagaaagcagtagcttgggacatgctacgagtttatagtgattttattgaagctcaagaaagacgcaggattgaaagattggaaatatttgacgaatttgaagagtggtatatgatgcaggagcactattgtgttacatatgcaatcaacgatgctatgtgtctgttcaaggaatttggtttccccaatacacagcctatgacagacacctccattgcaacatccacatga

SEQ ID NO: 58 - DNA, 2559 bp, Nicotiana sp.
atgggttgcacggcgtcgaagctagataacgaggacactgtccggaggtgtaaagaacgccggcgattgatgaaagaagctgtttacgctcgtcatcatttagcttcagctcattccgattactgccgttcactccgtatcaccggttctgctctttccaccttcgccgccggtgaacctctttccgtttccgatcatacccccgccgtcctcctccgtacaccctctactactaccaccaccattaaaaccccagctccaccacctcctgttcgtatcccatccccctcaccttcactccacccaccaccaccgccgccggcattttctccgtctccgtcaccgacgatagcttcatcaaagctacctcacatactttcttcctcctctgtttcctcccaccacaaccaccaccaccgtcagcctcagccgttacaacaacggaaaaaacccgtaaaacttccacacattctttcgggatcaagcttgagttcatacaatgaggaggattatacgtacgatgcgaaagcgaattcgacgtattcgagtactccttcacaaacttcctctgtttggaactgggaaaacttttaccctccttcccctcctagctcagattactttgaacgcctccgtaaagtggacacaatggatgctgacgatgagcatgatgatgataaagcttcaaactttacatcttattcacactactctcagcatcagcatcctactactgaccaatcatcacttagtgggaaatcgcacaagcaaaagtttgattttttcgatagtcatagtgttgatgatgagaagttgactaatgggtctgttaggaatcacaaaatggtgggtgaaaacaagagaggtcaccatttgaataataatagcaagtgggaggatagtgaagctgagagagaagaggtacagtgcagtgaatgggaccatgatcattatagtactacgagttcatcttctgatgatgatgaagaggaagaaaaggatgagataagatctgggtttgggccaacccggtctaattttgggtcaatgaagagtgaggaagcttctaagattggtgatgtcaatttgaggatgaagagttattcagggaggaaatcggataaggtatcgtcggaggatggagggtcgtcttcgatgagttgggggaatgggaataatgggaaagtggtggaggagatggtatctgataataggagtatagtggtgaggcacaaggatctagctgagattgttgctgccattagggactactttgataaagctgcttctgctggtgaccaggtctctgagatgttggagactggccgagctcagcttgatcgcagctttaagcagttaaagaaaacagtgtatcattccagtggagtatttagtaccataagctccacttggtcttcaaaacctccactggccgtcaagtatcgttttgaacctagttccattgatgaaccaggttcccaaaagagtctttgttccaccttggagcgactcttggcatgggaaaagaaactatatcaggaagtgaaggcaagggaaggagttaaaattgagcatgaaaagaagttggcaacattacagagtcaagaatgcagaggtgatgaggaagccaagttggacaaaaccaaggcctcaataaagaggttgcagtcgctgatggtggtcacatcgcaggctgtttcgactacgtcctctgccattattggtctaagagactctgaccttgtcccacagcttgttgaactttgtcatggattcatgtacatgtggagatccatgaaccagttccatgaagttcagaatgacattgtgcagcaggtgcgaggtctcatcaatagagcaactaaaggtctatcaacgtctgacctacacaggcaggcgacacgtgatcttgagtctgctgtatctgcatggcactcgagtttttgtcgcctcataaaatttcaaagggactttatccgctcccttcatggttggttcaagctcactcttgtatctgtcaatattgagccaactaattgcaacagagaaccttcagattcatttatgttttgcgatgaatggaagctagcccttgaccgtattcctgacactgttgcatcagaagctatcaaaagcttcataaacgttgtccattcgatatttgtgaaacaaacggaggagttgaagatcaaaaaacgaactgaatctgcatcaaaggagcttgagaaaaaggcttcgagtgttaggagcattgagaggaagtattacaactcttactccatggttggcattggacttcctgagatgggacctgataatggtagtgttttagatacacgagaccctcttgctgagaaaaaggctgagcttgcagctagccaacggcgtgtggaagatgagatgctgaagcactccaaggcagtggacgtaaccagagcgatgactctcaacaacattcagacagggttgccgggagttttccaggccatgaccagcttttcttccttgatgacagaggcccttgaggctgtatgcactcattcttatgctattaagtag

SEQ ID NO: 59 - DNA, 2115 bp, Nicotiana sp.
atggaaaggatacatgaagtaaaacaaccaccgaggcaattccctttagaggctaaggtgacacatgccttttcaacttccaggaaggagatcggtgttaaatgcaatgtgcaggacttccgagattttgacttgtctgttctgagacaaacatggaaaggaaagacctcgtatcaggaggaagaggaactcatgatagatgctggttcagtcaagcgcagtgatgattcacttgaagacagtggctctacttcatttcatggagcgagtcatcctccggaacctgttgatacagacctaatgagaccagtgtacgtacccattggtcagaaaaaagcagatgggaaatgcttagtgaaaagcatgtctttgaagggtcctttcctagatgatctttcaatccgggttcctaatgtgaaaccgagcccatctcttctttcacctgcagagagcttggttgaagagccaaatgatctgagtgtaatctcctctccgtttacaattcctcgtccatctcaaaacacagaagcaagtctgcctcctgactccgaagagaaagaatgtatttgggatgcatcgctgcctccaagtggcaatgtaagcccacttagtagcattgatagtactggtgtggtgagatctatgagcattgtcaacagttgcacaagcacgtataggagtgatgtgatcatgagcgatggcatgcttagtgtggacagaaactatgagagcacaaaagggagcattcgtggggattcacttgaaagcggtaaaactagccttagcagagcaagtgacagcagtgggcttagtgatgatagtaattggagtaacattactggcagtgccaataagcctcacaaaggaaatgatcctagatggaaggctattctcgcgattcgggcacgtgatggtattttaggaatgagtcactttaggttactcaaaagacttggttgtggagacattggcagtgtttatctttctgagcttagcgggactcgctgctattttgcaatgaaagtgatggataaggcttcacttgcgagcaggaagaaactgactcgtgctcagacagaaagagaaatcctgcagttattagaccatccattcttgccaaccttgtacactcattttgagaccgatcgcttctcatgtttggtcatggaatattgtcctggaggagatttacatactctacgacagcgacaacctgggaagcatttttcggaatatgctgcaaggttttatgcagcagaagttctactggcgcttgaatatctacacatgcttggtgttgtgtacagagacttaaaacctgaaaatgttcttgtgcgtgacgatggccacattatgctttcagattttgacctatccctaagatgtgcagtttcacccacgctcataaggacatcgtctggcgatccttctaaaaaaggagccgcattctgtgtgcagccagcatgtattgagcccacatctgtatgcattcaaccagcatgcttccttccccgtatatttaatcaaaaaagcaagaaaagatcacctaagcctcgagccgagactgggcctccagctaatgcactgcctgagctagtcgcagaacctacttcggcacgctctatgtcatttgttgggactcatgaatacttggcccccgagattatcaagggagaaggccacggcagtgcagttgattggtggacatttggtattttcctgcatgaactactatatggtaagaccccattcaagggatcaggaaacagggcaactcttttcaatgtagtaggccaacagctcaggtttccagagtctcctgcaaccagttatgccagccgtgatctgatacgtggcttgcttgttaaagagcctcaaaaccgacttggggtgaaaagaggagcaactgagatcaagcagcatcctttctttgaaggcgttaattgggctctgatacgttgcagtacgccacccgaagtgccaagacccattgaggcggagcttcctgcaaagtttgggcaagtgaaccctcttggggttggcaatacgagtaaaagagtggtgggaacagatgcaaaacctgggggtaaatatcttgactttgagttcttttag

SEQ ID NO: 60 - DNA, 1914 bp, Nicotiana sp.
atggctgccgccgtgaccgagaaaattatgtcgccgtcgcctccgccctcgcaacacatgcatctgtcgccttccacttcccggcgtggccttgacgccgcctccgatactgatgctctcgatcgccgcccttcccttgatctttcctctgcttcttcccctagcccaacacgattatctgatgctcagaatcagctgtttgtgaagagtgaagagtatcgacaactgttccgtttaccgcccgatgaagtcctggttcaagattttaactgtgcgctgcaagagagttttctacttcagggtcatatgtacctctttggccattatatttgcttttattccaacctcttcggctttgagacaaagaaaataatacattttcatgagatcacgtcagtacgaagagctaaagctgcggccatattcccgacagcaatagaaatagtagccggagaaaagaagtacttttttacatctttcctgtcccgagatgaagcttttaagcttatcaatgatggttggctacaacacaatggtgcagcggaagagtctacagatctggagccaaaatctgatctaaacagtcaagatagtggaataccagaaggaacagatagtttcaggcaggctatggaaggggtagaatccctcgaaaggaataaggatgatacagtacaggaagactcaaagcccttggccaatggcgaatttgaaattgtatcaaagcctttaggattgcagcgcaatgtggaagaaaaagcagttattgttcaaagtactgattgctcctcttctgggaggtcctcagctttgaagcaggaggattcagatgcacctcgggtccctgaatgctttacacttgttgcagaggccaagtttccggttacggttgagaagttctttgaactcttcatttcagatgacggtattgcttttcaggagtcattccgtagaaaatgtggtgataaagattttaagtgcacacagtggcgtcctcatgaagaacttgggcactctcgtaattggtcgtttcagcatcctattaaattctatttaggtgcaaaatttggtggctgccatgaggtacagaactatcgtttttatagaaacagtcacctggtgattgagacatcacaagaagttagtgatgttccttttgcagattattttcgagtgcagggtttttgggatgtggagaaggatcacgatgaaccagtaggaggctgcagtttgaaggtgtacgtaaatgtggccttttcaaagaaaaccatgtttagagggaagatagtgcagtctactgttgatgaatgtcgagacgtgtatgcaatatggattgcccttgcacatgaactgttgaagcaaaagaagttagagaaggaagaagccggtggtcatgctgctaatgtggtaacaagtgctcagcagaaagaaagttctgaacatgtggaaatattagacggggcaagtgatgaagttaggtcacaaacactgccactcaaccagctagctgctgattccctgcggggtagttgtagcagtaccgtctctgttacttccttgtgtagaaatttcatggttaagtgttcatcatctttcaaatctcaaagccaggtttccattcttatagtgatcaccattgctgtgatcctgctcttaatgcagatgagcatactcgtgttattaggtagacctcagcacgtccacgtgatacctcaaggggactgcacaggtagcatgtatcgactgggagataggggtatagacacactagcctttctggataaacagattagtcatctcaaagaggagatggttatggtcgaaacactgctcggcaaaatgcagcaggagcatacacttctaaacacgaaattgaaagagtttgagcgcctacggaagcaccagaaaggataa

SEQ ID NO: 61 - DNA, 1029 bp, Nicotiana sp.
atggcggaagaagtcgtgggagaagtagaagcagtagaatcagtttacggcgatgattgtttactccttcaaacttatcctccttcttttcatctccatatcagacctcgtacggctgatgactcttctcaacagtttgtggaagcaatcatcggaatccaggctggtccaaagtatcccgacgagcctcctgctattagaattgttgattccaagggccttgatgaacaaaggcataaacaattgataagttgtctttcagcaagggcttgtgaactctcctcgtgtctaatgcttgtagcactttgcgaggaagcagtggagcagctttccagcatgaatcaccctgatggggagtgtccattgtgcttgtacccattagttgatgaagatgcaggaagctctgcgccatttatgaaactgatgtcttgttttcattgctttcattgtgagtgcatcatcagatggtggaattggcttcaactattaaaagaatctgatgcccctacggactctggttctgcttcgtcttctaggaacagggatcaggatgaagaagatgtggggaagtgcccggtttgtcgcaagtcttttctagcgaaggacattgagcacgtgctagacttcgtgaagactcagcatgctgtgacttccagtggatctgaagtcaacaatgaagacaagattctttcctcggactcggaaaaactaagaagaaagaaatttgatgctattctgaaactccagcaagagaagggtggcttaattgaaataaaaaagcatgaagtgttgcggccaggtatttatcttccacaacctgctgcattaccctcaactgcacccaccgaagaggcaaatgagcaaaaagacagagatctggcagccaaccccagaccaaattctagtgcttcctcaaacaaacctagtaccagtagagcgagaaactccggcacaaagaaaagcaggggacacagttcaagaaaacaagcgactcagtgggttaagaaagaaaatagtaatacagcatga

SEQ ID NO: 62 - DNA, 1248 bp, Nicotiana sp.; identical to SEQ ID NO: 27

SEQ ID NO: 63 - DNA, 3204 bp, Nicotiana sp.
atggcgattcttgcactcccattagtcacttccattctcaaacctcacaagactcacttctcctttctcctaaccaccactaagcctcttcctatcatttttcacaggcgttttctctctaaatcttccactgtctctgcactctccacttcttcttcttctacttcttctgtgtctcacaatacagaacatcaaaagaaaccatctgttccaactttccaacaagccattcaaaggctccaggagtattggggttctgtaggatgtgccgtgatgcaatgcagcaacactgaggttggcgctgggactatgaatcctctaacatacttaagggttcttggaccagaaccatggaatgttgcgtatgtggagcctagtattcgtccagacgatagtcggtatggggaaaatccaaataggcttcaaaggcatactcaatttcaggtgattttgaagcctgatccaggaaattcgcaggacttgttcatccgtagcttgtcagctttaggtattgatgtcaatgcacatgatattcgctttgttgaggacaactgggagagccctgtgcttggtgcctggggattgggctgggaggtgtggatggatgggatggaaatcacacaattcacctacttccagcaggcgggaagtatacagttgatgccagtatcggttgaaatcacttatgggcttgaacgtatccttatgtcacttcagggtgttgatcattttaaaaagattcagtatgcagatggcattacatatggagagctttttctggaaaatgagaaggaaatgagtgcgtattatctggagcatgctagtgttgaccatatacaaaaacattttgatctctttgaagcagaagctcgccgtttgcttgatttaggccttgcaatacctgcgtatgatcagcttttgaaaacttctcatgctttcaatgttttagattcgagaggctttgttggggtgacagaacgtgctcgttattttgggcgtatgcgtagtttagcccgtcaatgcgcacacctttggttgaagacaagggagtctcttgaccatccactgggtgttgtttctcagtgtgatcatcttcttgttcaaagagaagtcttggaggaggcagcacgaaaggtgccttcagagccgcggttgcttgttcttgaaattgggactgaggagttgcctccaaatgatgtatcgagtgcatgcaagcaactcaaggatctggttgttcagttactggacaaacaaaggttgcctcatggggaagtacaaacgcatggcaccccacgaagattagtggttagcgttgaggaactatttcctaagcaagtggaaaatgaggttgaggttcgtggacctcctgtttcaaaagcttttgataaggaaggaaatcctaccaaggctgctgaaggtttttgtcgcagaaataatgtccctttagactccatgtatagacgagctgaagggaaaacagaatatgtgtatgctcgtttggtggagccagcacggcttgcatttgaggttttgtctgaagagctacctgtcataatctccagcatatcattccccaagtctatgcgttggaactcggatgttgcattcagcagacccatccgttggattttggcccttcatggagatgtagttcttccattcatttatgctggagttgtaagtggaaatgtatctcatggtctacgcaatactccatcagctacagttaagattttggatgcagaaacctatgcaaatgtaatgcaggatgctgggattcttgttgatgtcaagcaacgcaagaagacaattatggagcagtcaaatgatttagcaaaaagtatacatggccatattgtaatgaaaaatgatttgcttgatgaggttgtaaatcttgttgaggcaccactacctgtacttggcgaatttgatgactccttcttagagcttccaaaggagcttcttataatggtgatgcagaagcatcaaagatacttcgccatgacagatgagaacggtaaactgttgccgtacttcatcacggttgcaaatggatcaattgatgacaaggtagtcagaaaaggaaatgaagctgtgctgagagctcgatttgaagatgcaaaatttttctacgagatggacacaagtagaaaattttctgaatttcgtcctcaactgaaagggattcttttccatgagaagctaggaactatgttagataaaatgtcacgagttcagaatttggttagtgaagttgggttgtctcttggaataggcgaagataaactaaaagtcatccaagatgcagcctcattagccaatgcagatcttgcaaccgcagttgttacagagtttacctctctctcagggacaatggggcgccactatgcacttagagatggctattcagaggagattgcagaggcgttgtttgagatctcgcttccacgattttctggagatatgctcccaaaaactgaagttggggccgttttagctattactgacaggctggatagccttgttggcttatttgctgctggctgtcagccaagctcaagtaatgatccatttggcctgcgaaggatctcatatggtcttgtgcaactcttggttgaaagtaacaaaaatatagacttaagacaggctttagaccttgctgctgcaatacagcccattgaagtagatgtcaggacaatcaatgatgtacaacaatttgtatcacgaagactagagcaatttctgatggacaaaggtataagccctgaagtcgtaaggtctgttctttccgagcgtgcaagtcaaccttgtttggcaactaaatcggtgtacaagatggagtccttgtccaaaggagagcttttgcctaaggttgttgaagcatattctcgtccaacaagaattgttcgtgggaaggatgcaaatgtcgatgcggaggtggatgatcaagcttttgaaacaaatgaagaaaaagctttgtggagcactttcttgtcactaagaagtaaaactcatccagacatggaagttgatgattttgttgaagcatcgtcagttcttatagaaccgctggaggattttttcaacgaggtctttgtaatggtggaagacgaacggatcaggacaaaccggcttgctctgctgaagaaaatagcagatttgccaaggggaatagtagatttctcagttttaccgggattttga

SEQ ID NO: 64 - DNA, 177 bp, Nicotiana sp.; identical to SEQ ID NO: 29

SEQ ID NO: 65 - DNA, 342 bp, Nicotiana sp.; identical to SEQ ID NO: 30

SEQ ID NO: 66 - DNA, 1092 bp, Nicotiana sp.
atggcggatttgaacccatttgatttgctgggtgatgatgacaacgatgacccatctaagctgattgccattcagcagcaaaaagttgataccgctaagaaaccctctgctccggcggcggcggctaagaagcagccggctaagctccccactaagcctcctcccacggctcaggctgtcagggaggcaaaaacagaggttggacgtggaggaggtagaggtggtggacgtggttacagtcgtggtcgtggtggaggcgggtttaatagggaagcatccaacaatgagaatttttctcgaaacagagaattttctggtggtatagctgcacctgaagatgtggaaggaggaagaccctatgaaagacgtggcggttacggtggaccccatgcttttggtggtggtcgacgaggcggttttagtaatgaagaatttcctgagggagaccggcctcgtaggatatttgagcgccgtagtggtactggccgcggaggtgagataaagcgtgaaggagctggccgaggaaattggggaactcaagcagatgaagttactcagattactgatgaagttgctaatgaaggcgagaaaaatctgaatgtggagaaaccctccgcagatggagaagcaggagacgacaagaaggaaaatccagctgctgaagctgaggacaaggaacctgaaaataaggagatgacccttgaagagtacgagaaggtgctagaagaaaagcggcaggctttgcaggcacttaaaactgaggaaaggaaggtcgacatcaaagaatttgaatccatgcaacagctttcaaagaaatccagtgatgacatcttcatcaaattgggccccaaggataagagaagagagtctgctgagaaggaagagaaggcaaagaaggcagtcagcattaatgagtttctgaagcctgctgagggtgagaggtattatgcacctggtggtcgaggtcgaggaggtcgtggccgtggttctagaggttatggtggaggttacggtggagccaacactaccagcaacgtggaagcccctctcattgaagatccgggtcacttccctacattgggtggcaagtga

SEQ ID NO: 67 - DNA, 612 bp, Nicotiana sp.
atgaatccagaatatgactacctgttcaagcttctgcttatcggtgattctggtgttgggaagtcatgtctccttttaagatttgctgatgacacatatcaggagagctacataagcacaattggagttgattttaaaatccggacagtggagcaagatgggaagaccattaagcttcagatttgggatactgctggacaagagcgttttaggactatcactagcagctactatcgtggagcccatggcataataattgtctatgatgtgacggatcaggagagcttcaataatgtgaagcagtggctgaatgaaattgatcgttatgctaccccaaatgttaacaagattcttgtcgggaacaagtctgaccttgcagctaatagagttgtgtcgtatgaaacggctaaggcctttgctgatgaaattgggattccattcttggagaccagtgcgaaagatgctagtaacgtagaacaggctttcatggctatgacttctgctatcaagaatagtatggcaagccaaccagccacaagtactgccaagcctccaactgtaaatattcgtggacagcctgttgctcagaatagtggctgctgctcatcttga

SEQ ID NO: 68 - DNA, 321 bp, Nicotiana sp.; identical to SEQ ID NO: 33

SEQ ID NO: 69 - DNA, 351 bp, Nicotiana sp.; identical to SEQ ID NO: 34

SEQ ID NO: 70 - DNA, 1068 bp, Nicotiana sp.
atggtgggaaaaatgagagatagctcagcttcaccaaatggttcctttactactgccatgacactaaatgaagaggggctaacctatgttcccaagcgttacattcttcccccatccttacgccccgagcgtaccctgtgtgacacatgcttgcccgttgtagatctctcctttctgcgacaccctcttcttcggcctcagataatccaggaagtacacctggcttgcaaggaactaggtttcttccaggtagttaaccatggaatcccactgtcagtcatgaaagatgccatagatgctgcaagcgaattcttcgatttaccaactgaagagaaaaagcatctcttgtcttcaaatgttcatgaacccataagatatggtactagtctaaatcatgtcaaagacaaagtacacttttggagagacttcctcaagcactacgctaatccaatctcaacttggattgacttgtggccatcaaatcccacatgttacaaggagaaaatgggaaattacacaaaggcagcacaaaagttgcaagaagaactcatggaagtgatatttgagagcttaggactaaaccctagttacttacatgaagacattgcagaaggctctcaggtcatggccgttaattgctatccagcatgtcctgagccagatcttacactaggattgccaccacacacagattatggtatgctatccatcattcttcaaaattaccagggcttacaaatcatggaccgagatgaaaagtggcatgcagttccagtcattgaaggagctctcgttgttcagctgggagatcacatggaagtattgagcaatggcagatacaaaagtgttctccaccgagcagcagttaactcagaaaaaaagcgcatttcaattgccagccttcatagtctagctttaggtaaaacagttagacctgcaccagaccttgtcaacgaacaacatatcttgtcctacaaagaaggaagcttcagtgatttccttgacttcatttctcaaaaaaatatcatcgaaggaaagtacatagacaaactaaaaataaactcatga

SEQ ID NO: 71 - DNA, 312 bp, Nicotiana sp.; identical to SEQ ID NO: 36

SEQ ID NO: 72 - DNA, 1056 bp, Nicotiana sp.
atggaaaagagctcagcttcaccaaatgattcatttactagtgccatgacacttactgaagacggtctaaccaaagttcccaaacgttacattcttccgccatccttacgccccgatggaacccggtctaacacatgcctgccaattgtagatctatcctttctgcgacaccctcttcatcggcctcggataatcgaggaagtacacctggcttgcaaggaactaggtttcttccaggtagtcaaccatggaatcccattgtcagtcatgaaagatgccttagaagctgcgactgagttcttcgatttaccaaatgaaaagaaaatgcatctcttgtcttcaaatgttcatgatcccgtaaggtataataccagcctaaatgatgtcaaagacaaagtatccttttggagagacttcctcaagcactatgctaatccactctcaaattggattgatttgtggccatcaaatcccacatgttacaaggagaaaatgggaaattacacgatcgcagcacaaaagttgcaagaagaactcatgggagtgatatttgagagcttaggactaaaccctagttacttacatgaagacattgcagaaggctcccaggtcatggccattaattgctatccagcatgtcctgagccagatcttacactaggcttgccaccacacacagattatgctttgctaacgatcattcttcaaaatcatcagggcttgcaaatcatggatcatgatggaaagtggcattcagttcctgtcattgaaggagccctcattgttcagctgggagatcacatggaagtattgagcaatggccgatacaaaggtgttctccaccgagcaacagttaactcagagaaaaagcgcctatccattgccagccttcttagtctagctctaggtaaaaaagttagacctgcaccagcacttgtcgatgaacaacatatcttgtcctacaaagaaggaggcttcagtgatttccttgacttcatttctggagaagatattgtggaagcaaagtacatagacaaattaaaaataaatccatga

SEQ ID NO: 73 - protein, 221 aa, Nicotiana sp.
MQGISLEFDQQNFLDTMQHLFNDPDFPQIFSELNSFNNTIQTPRNPGSENTIFAQNMVQRNQEKYADDHIVPLQKTSSENDKEPSSDQVPLEKKKYKGVRRRPWGKYAAEIRDPERKGARLWLGTYETPEDAALAYDRTAFKLRGSRAVLNFPHLIESNVTEINRVRPRRRSRSPDIELSSDQHDGPISKRRNVDLINSLATANLDSQIIVERCLTSSFFA

SEQ ID NO: 74 - protein, 135 aa, Nicotiana sp.
KLLYALGSPKPHKSAFSSYSKMTGLKLNFSMTNRQEPSSAKTLKRHEPLWMVIQDEANQKLEDNLRVAISEEAKEDDLIESCPEEAATTGDFTSNKTEKKKVTQEITLRQLPIRAAKKKGVATSKSTKSNRYDNK

SEQ ID NO: 75 - protein, 170 aa, Nicotiana sp.
MHCTTSATVDDEECLDSFNIFSTFSNTQTSSRNIDELQFYFQKQKEPCTKEFSPLGWWHENGKQFPVLFAMARDVLNVPISTVASDSAFSQARQQLRDTCHSLGSNALEVLVYFRDWIRSERRNQGREDVDSLEDEELGDILIYGIPSEFNTPEEGHSVHIDYEELTKAM

SEQ ID NO: 76 - protein, 182 aa, Nicotiana sp.
MSNPEENLGTPLNSSSSTRPSVSPKPRLRRVKMLARMVVSSGALRKALNERLKASQVKERQAPNSDSSSESESYQSAAEGEGHGSSDFEKIQESPSEVSSSMIENLEIRFVLVGPIRDVEVPEKHRSGGKKNFEKEKDREGACGEDMGIEKIIVPAICGVEHERVEESGMKSRGSGSGEDAK

SEQ ID NO: 77 - protein, 75 aa, Nicotiana sp.
MRFIDHDTPYPHLEIISDKQSPRAQVLTLKVHPPVIGAFPLARKPLDASLDLAEWSTRETKDALDRFSGKATNMK

SEQ ID NO: 78 - protein, 414 aa, Nicotiana sp.
VYDAIFASLFTYDYNENVLRAFCELWRSSTNTISTSIGELSISLWDLREIGGLPVHGSFYDEVIPSAKELTQEDDQGKPFLPRSCLHLFSAFYKLMKDHVHKVSIRDWVEFCFRGPSRYAKPPQKSSRNRTTRPKLNHNPSGNIDASFLPRTDEENDPFIELGVEESLRAETYLAAFLACWLCKFVFPNKKIDYICASVFKIASLMAHVEKFSLAVPVLASIYHGLNEVSTSQDLGACKALFPIHYVYGWIGAYFDTYYRVKRPQRGPQMCKVSGEKMDKHFDLSNARELFQQVSARQLHHLAMLQGRELHLTDRDEQSNSWSDFFISLRSSFITLRHDDIHIVESYSLHRFSRQFGFCQDVPGNLIERPYNGSLRMLVQFWDSCVRLGGSSKVIVPTCPSEEGPLMTREYADW

SEQ ID NO: 79 - protein, 155 aa, Nicotiana sp.
MPLSELEKRLGVNELYDDVLGEDTVEDCVTSPNPLGVATKSPHTLFDGVEHHAANNAPSTDLSLPKELHLVLPEDVVLSKPAMTSKMEVAASQAKRLKTFEPTPWPLHLDAPNFKPQEIISRIKLSFVNTIWHTLCEWIEEFSLDSLDSFTKLEE

SEQ ID NO: 80 - protein, 168 aa, Nicotiana sp.
VPGNLIERPYNGSLRMLVQFWDSCVRLGGSSKVIVPTRPLEEGPLMTREYVDWWSARRVNSSRQSTHIILKVPRKDDIPLSSKDDQRQKNTHERSSKPKLRSKDPSPSTKVLPKSTPSMGRGNHVDKGAKHVLLTSKTTTATVEVTNNPCKRKAPATSPNTNVAKTTN

SEQ ID NO: 81 - protein, 96 aa, Nicotiana sp.
IDYIRASVFKIASLMAHGEKFSLAVPVLASIYHGLKKVSTSQDLGACKALFPIHYVYGWIGAYFDTYYCVKRPQRGPKMCKVSGKKMAKHFDLSNA

SEQ ID NO: 82 - protein, 284 aa, Nicotiana sp.
MRFIDHDAPYPHLEIISNKQSPRAQVLTLKVHPPVICAFPLARKPLDASLDLAEWSTRETKDALDRFSGKATNMKVLLLKSSTHQKAASASPPYCDYDGRLATWSVPPSAFGEVRYTSKYWEWVEDVLACNKLTLDGIKVYDAIFASLFTYDYNENVLRAFCELWRPSTNTISTSIGELSISLWDLRAIGGLPVHGSFYDEVIPSAKELTQEDDQGKPFLPRSCLHLFSAFYKLMKDDVHEVSIRDWVEFWFRGPSRYAKPPQKSSRNRTTRPKLNHNPSGNID

SEQ ID NO: 83 - protein, 239 aa, Nicotiana sp.
MAMEMNPADETLFFSDSHLLESIKQHLLDDSDFSEIFSSMNSSNEILPNSPSSSFSSFDFDCSFLNWDENSEETLIPTDQNPSHESHEKYSESEEKTQGPGVAREKNAPRDWTRYIGVKRRPWGTFSAETRDPSRKGEGARLWLGTYETAEDAALAYDQAAFKIRGSRARLNFPHLIGSNMPKPARVTARRSRTRSPEPSSSSSTSSSENVPRKRNIDVINSIAKAKFLCHSLNLQRLA

SEQ ID NO: 84 - protein, 132 aa, Nicotiana sp.
MGDVCGRDIRDPNRRGARLWLGTYETPEDAALAYDQAAFEIRGSKARLNFPHLIGSNMTKPARVTARFRMRSPEPSSSASSENTTRKMKIDVINSIAKKYKKVKNNIQPDSSTTLQAATISVSFTHFDPNPP

SEQ ID NO: 85 - protein, 72 aa, Nicotiana sp.
MVSRERTGPTDEDTQVTTLAEKSAPSIRRVKIMRELGLMAPSGRSSSHPKERLPPIQRIVVCGLSAARSVMK

SEQ ID NO: 86 - protein, 336 aa, Nicotiana sp.
MSSPNPNPRRVPIVDTFPNSPIRHKRGGRLRSLGSTRGGSSYIHSPSSGPSSRTRGSLSHKSSSSGKEPSKPLREPLVEEIVPTELSFYHDRESLKNHVSALDRGDTYPTQITKVLTLVVRKDCHWRFKPVIDPVILEFFRFFNVCLGQIGPIIWRTVGCLRHLTNMADVSFTFPHLIHLYSPRLFRNSVFTLVARSKRVLVSPEDDKDRGWYARFVAAPSVGLVGKDNVPFYKKWNFAPTMGVVEDIPNFRDWVDKLLKTAPIDGRSWRTLSNHYGWKVKTHGFAIRGVTVEAVATSRVSSGTRTPSGTRISSERAREIVLGSSAKRKAVERGKF

SEQ ID NO: 87 - protein, 227 aa, Nicotiana sp.
MNPANATFSFSEFDFLESIENHLLNYDSDFSGFFSTMSSSNALPNSPSSSFGSSPSAESSLDTSLWDENFEEIIPHLEEKSESEEETKGHVVAREKNATQDWRRYIGVKRRPWGTFSAEIRDPERRGARLWLGTYETPEDAALAYDQAAFKIRGSRARLNFPHLIGSNMPKPARVTARRSRRRSPEPSSSSCTSSSENGTRKRKIDVINSIAKAKLVCHGWNLQMLL

SEQ ID NO: 88 - protein, 187 aa, Nicotiana sp.
MNSADLSLLESIQHHLLNDSNIPEIFSAMDSNSPSSSFSNSPSTENNFYYGELTPLINPTLVGATEKSHEFEETNNKETVAAKVANAPQDWKRYRGVRRRPWGKFAAEIRDPNKKNARLWLGTYETPEDAALAYDQAAFKIRGSKARLNFPHLVGSGMPEPARVNPRRRSHSPESSSENGTPRKLFV

SEQ ID NO: 89 - protein, 208 aa, Nicotiana sp.
MYEQTTISDSDLSVLENIKFHLLNDNDFSQIYSTFDQCFSNAEIINSPDSSFGSSPTEEISWGDMLTSVNTTWQRVDNLEYKEETKKNHVVARGVHAPQDWNRYRGVRRRPWGKFAAEIRNPDRKGARLWLGTYETPEDAALAYDQAAYKIRGSKARLNFPHLIGSNISEPVRVAPRRRCLSPEISSSSFSLSFVKNVPLKKRKLAEN

SEQ ID NO: 90 - protein, 259 aa, Nicotiana sp.
MDIEQKQAEHIDYFVKQTSALKGSALNNVISEATSHPSLFAFSEILSVPNVVELEGTENSIYLDLLRLFAHGTWSDYKSIAGRLPQLVPDQVLKLKQLTVLTLAETSKELPYDQLMQELDVTNVRELEDFLINECMYVGIVRGKLDQLKRCFEVQFAAGRDLRPGQLGNMLQTLTDWLTTSDNLLISIQEKIKWADTMSESDRKHRKEVEERVDEVKKSLSLKADVDFRGHEEIYSESGGVMDYEEDRGRPKRRRHPIG

SEQ ID NO: 91 - protein, 131 aa, Nicotiana sp.
MTPDEKYFRCKFCTQHISGTINKLKKHLADTHKGIEPCPKVPDEVAEECKKALLKLQNVKIMRKATSEEMRVVATGSGNMDGESGSSPTMSNLPPKARGLLDDFVSAQARQATLNSKWKKRGKKRSLSANW

SEQ ID NO: 92 - protein, 341 aa, Nicotiana sp.
MVKPLADSRSNRAAVQATNDDASASKLSCVKKGYMKDDYVNLFVKKPLRRSPIINRGYFARWAALRKMLYQFLDCNPNADGSGNIKKQILSLGAGFDTMFFQLQDEGKAPHLYVELDFIEVTSKKAALIETYSQLRDKVGEIASISSEKGEVHSDHYKLLPVDLRNIDNLNDVIARANLDPSLPTFIIAECVLIYLDPDSSRTIVGWASRTFSTAIFFLYEQIHPDDAFGQQMIRNLESRGCGLLGIYATPTLQEKENLFLDQGWQKAVAWDMLRVYSDFIEAQERRRIERLEIFDEFEEWYMMQEHYCVTYAINDAMCLFKEFGFPNTQPMTDTSIATST

SEQ ID NO: 93 - protein, 852 aa, Nicotiana sp.
MGCTASKLDNEDTVRRCKERRRLMKEAVYARHHLASAHSDYCRSLRITGSALSTFAAGEPLSVSDHTPAVLLRTPSTTTTTIKTPAPPPPVRIPSPSPSLHPPPPPPAFSPSPSPTIASSKLPHILSSSSVSSHHNHHHRQPQPLQQRKKPVKLPHILSGSSLSSYNEEDYTYDAKANSTYSSTPSQTSSVWNWENFYPPSPPSSDYFERLRKVDTMDADDEHDDDKASNFTSYSHYSQHQHPTTDQSSLSGKSHKQKFDFFDSHSVDDEKLTNGSVRNHKMVGENKRGHHLNNNSKWEDSEAEREEVQCSEWDHDHYSTTSSSSDDDEEEEKDEIRSGFGPTRSNFGSMKSEEASKIGDVNLRMKSYSGRKSDKVSSEDGGSSSMSWGNGNNGKVVEEMVSDNRSIVVRHKDLAEIVAAIRDYFDKAASAGDQVSEMLETGRAQLDRSFKQLKKTVYHSSGVFSTISSTWSSKPPLAVKYRFEPSSIDEPGSQKSLCSTLERLLAWEKKLYQEVKAREGVKIEHEKKLATLQSQECRGDEEAKLDKTKASIKRLQSLMVVTSQAVSTTSSAIIGLRDSDLVPQLVELCHGFMYMWRSMNQFHEVQNDIVQQVRGLINRATKGLSTSDLHRQATRDLESAVSAWHSSFCRLIKFQRDFIRSLHGWFKLTLVSVNIEPTNCNREPSDSFMFCDEWKLALDRIPDTVASEAIKSFINVVHSIFVKQTEELKIKKRTESASKELEKKASSVRSIERKYYNSYSMVGIGLPEMGPDNGSVLDTRDPLAEKKAELAASQRRVEDEMLKHSKAVDVTRAMTLNNIQTGLPGVFQAMTSFSSLMTEALEAVCTHSYAIK

SEQ ID NO: 94 - protein, 704 aa, Nicotiana sp.
MERIHEVKQPPRQFPLEAKVTHAFSTSRKEIGVKCNVQDFRDFDLSVLRQTWKGKTSYQEEEELMIDAGSVKRSDDSLEDSGSTSFHGASHPPEPVDTDLMRPVYVPIGQKKADGKCLVKSMSLKGPFLDDLSIRVPNVKPSPSLLSPAESLVEEPNDLSVISSPFTIPRPSQNTEASLPPDSEEKECIWDASLPPSGNVSPLSSIDSTGVVRSMSIVNSCTSTYRSDVIMSDGMLSVDRNYESTKGSIRGDSLESGKTSLSRASDSSGLSDDSNWSNITGSANKPHKGNDPRWKAILAIRARDGILGMSHFRLLKRLGCGDIGSVYLSELSGTRCYFAMKVMDKASLASRKKLTRAQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRTSSGDPSKKGAAFCVQPACIEPTSVCIQPACFLPRIFNQKSKKRSPKPRAETGPPANALPELVAEPTSARSMSFVGTHEYLAPEIIKGEGHGSAVDWWTFGIFLHELLYGKTPFKGSGNRATLFNVVGQQLRFPESPATSYASRDLIRGLLVKEPQNRLGVKRGATEIKQHPFFEGVNWALIRCSTPPEVPRPIEAELPAKFGQVNPLGVGNTSKRVVGTDAKPGGKYLDFEFF

SEQ ID NO: 95 - protein, 637 aa, Nicotiana sp.
MAAAVTEKIMSPSPPPSQHMHLSPSTSRRGLDAASDTDALDRRPSLDLSSASSPSPTRLSDAQNQLFVKSEEYRQLFRLPPDEVLVQDFNCALQESFLLQGHMYLFGHYICFYSNLFGFETKKIIHFHEITSVRRAKAAAIFPTAIEIVAGEKKYFFTSFLSRDEAFKLINDGWLQHNGAAEESTDLEPKSDLNSQDSGIPEGTDSFRQAMEGVESLERNKDDTVQEDSKPLANGEFEIVSKPLGLQRNVEEKAVIVQSTDCSSSGRSSALKQEDSDAPRVPECFTLVAEAKFPVTVEKFFELFISDDGIAFQESFRRKCGDKDFKCTQWRPHEELGHSRNWSFQHPIKFYLGAKFGGCHEVQNYRFYRNSHLVIETSQEVSDVPFADYFRVQGFWDVEKDHDEPVGGCSLKVYVNVAFSKKTMFRGKIVQSTVDECRDVYAIWIALAHELLKQKKLEKEEAGGHAANVVTSAQQKESSEHVEILDGASDEVRSQTLPLNQLAADSLRGSCSSTVSVTSLCRNFMVKCSSSFKSQSQVSILIVITIAVILLLMQMSILVLLGRPQHVHVIPQGDCTGSMYRLGDRGIDTLAFLDKQISHLKEEMVMVETLLGKMQQEHTLLNTKLKEFERLRKHQKG

SEQ ID NO: 96 - protein, 342 aa, Nicotiana sp.
MAEEVVGEVEAVESVYGDDCLLLQTYPPSFHLHIRPRTADDSSQQFVEAIIGIQAGPKYPDEPPAIRIVDSKGLDEQRHKQLISCLSARACELSSCLMLVALCEEAVEQLSSMNHPDGECPLCLYPLVDEDAGSSAPFMKLMSCFHCFHCECIIRWWNWLQLLKESDAPTDSGSASSSRNRDQDEEDVGKCPVCRKSFLAKDIEHVLDFVKTQHAVTSSGSEVNNEDKILSSDSEKLRRKKFDAILKLQQEKGGLIEIKKHEVLRPGIYLPQPAALPSTAPTEEANEQKDRDLAANPRPNSSASSNKPSTSRARNSGTKKSRGHSSRKQATQWVKKENSNTA

SEQ ID NO: 97 - protein, 415 aa, Nicotiana sp.
MHFGLALPNTNWQCNSKISYAPSSRLNLSIARSIKISNSGHNYLVVDDKVKLGERWMEFQGIKNWDGLLDPLDDDLREEILRYGEFVEAAYCCFDFDMLSATYATCRYPTCTMLTHCGLGQSGYKVIKNLHATCAVQMPRWTERFPNLVSPRSSWIGYVAVCDDVDEIARLGRRDVVIAFRGTATCSEWLENLRATLTCLPDDMAPENSEPMVQSGLLSLYTSKNEGNPSLQDTIREEIGSILNTYSNESLSITVTGHSLGAALATLTAYDITTKFSDLPMVTVVSFGGPRVGNKSFRCQLEKNGIKVLRIVNSDDPITKVPGFVIDDVESQGAATLARLTSWLGKYMEDTQWVYAEVGKELKLSSKGNNVAKCHDLKTYLHLVNNFVSSSCPLGATAKKVVSKRKQRERKAVVV

SEQ ID NO: 98 - protein, 1067 aa, Nicotiana sp.
MAILALPLVTSILKPHKTHFSFLLTTTKPLPIIFHRRFLSKSSTVSALSTSSSSTSSVSHNTEHQKKPSVPTFQQAIQRLQEYWGSVGCAVMQCSNTEVGAGTMNPLTYLRVLGPEPWNVAYVEPSIRPDDSRYGENPNRLQRHTQFQVILKPDPGNSQDLFIRSLSALGIDVNAHDIRFVEDNWESPVLGAWGLGWEVWMDGMEITQFTYFQQAGSIQLMPVSVEITYGLERILMSLQGVDHFKKIQYADGITYGELFLENEKEMSAYYLEHASVDHIQKHFDLFEAEARRLLDLGLAIPAYDQLLKTSHAFNVLDSRGFVGVTERARYFGRMRSLARQCAHLWLKTRESLDHPLGVVSQCDHLLVQREVLEEAARKVPSEPRLLVLEIGTEELPPNDVSSACKQLKDLVVQLLDKQRLPHGEVQTHGTPRRLVVSVEELFPKQVENEVEVRGPPVSKAFDKEGNPTKAAEGFCRRNNVPLDSMYRRAEGKTEYVYARLVEPARLAFEVLSEELPVIISSISFPKSMRWNSDVAFSRPIRWILALHGDVVLPFIYAGVVSGNVSHGLRNTPSATVKILDAETYANVMQDAGILVDVKQRKKTIMEQSNDLAKSIHGHIVMKNDLLDEVVNLVEAPLPVLGEFDDSFLELPKELLIMVMQKHQRYFAMTDENGKLLPYFITVANGSIDDKVVRKGNEAVLRARFEDAKFFYEMDTSRKFSEFRPQLKGILFHEKLGTMLDKMSRVQNLVSEVGLSLGIGEDKLKVIQDAASLANADLATAVVTEFTSLSGTMGRHYALRDGYSEEIAEALFEISLPRFSGDMLPKTEVGAVLAITDRLDSLVGLFAAGCQPSSSNDPFGLRRISYGLVQLLVESNKNIDLRQALDLAAAIQPIEVDVRTINDVQQFVSRRLEQFLMDKGISPEVVRSVLSERASQPCLATKSVYKMESLSKGELLPKVVEAYSRPTRIVRGKDANVDAEVDDQAFETNEEKALWSTFLSLRSKTHPDMEVDDFVEASSVLIEPLEDFFNEVFVMVEDERIRTNRLALLKKIADLPRGIVDFSVLPGF

SEQ ID NO: 99 - protein, 58 aa, Nicotiana sp.
MDALEREMTRLRTSVTDLGSCMDVVADRQVKSEKKFMGWLRALGCACNVNPDTVSDQE

SEQ ID NO: 100 - protein, 113 aa, Nicotiana sp.
MKVAEMRMLRWMCGHTRMDKIRNEDIREKVGVAPMEDKMREVRLRWFGHIQRRSTDAPVRRCERLAVVGTRRGRWRPKKYWGEVIRQDMTRLRITEDMTLDRELWRSSIKVVG

SEQ ID NO: 101 - protein, 363 aa, Nicotiana sp.
MADLNPFDLLGDDDNDDPSKLIAIQQQKVDTAKKPSAPAAAAKKQPAKLPTKPPPTAQAVREAKTEVGRGGGRGGGRGYSRGRGGGGFNREASNNENFSRNREFSGGIAAPEDVEGGRPYERRGGYGGPHAFGGGRRGGFSNEEFPEGDRPRRIFERRSGTGRGGEIKREGAGRGNWGTQADEVTQITDEVANEGEKNLNVEKPSADGEAGDDKKENPAAEAEDKEPENKEMTLEEYEKVLEEKRQALQALKTEERKVDIKEFESMQQLSKKSSDDIFIKLGPKDKRRESAEKEEKAKKAVSINEFLKPAEGERYYAPGGRGRGGRGRGSRGYGGGYGGANTTSNVEAPLIEDPGHFPTLGGK

SEQ ID NO: 102 - protein, 203 aa, Nicotiana sp.
MNPEYDYLFKLLLIGDSGVGKSCLLLRFADDTYQESYISTIGVDFKIRTVEQDGKTIKLQIWDTAGQERFRTITSSYYRGAHGIIIVYDVTDQESFNNVKQWLNEIDRYATPNVNKILVGNKSDLAANRVVSYETAKAFADEIGIPFLETSAKDASNVEQAFMAMTSAIKNSMASQPATSTAKPPTVNIRGQPVAQNSGCCSS

SEQ ID NO: 103 - protein, 106 aa, Nicotiana sp.
MNDKVPDFGMVNIPSLLQTWWRNLPPSNQINEWKDRVTKASEKLEYPEYSLLELEGKVRKRVIDCQNVEEGKGERLAIAFLLENLRELEDLINKNIQPEECPSRTK

SEQ ID NO: 104 - protein, 116 aa, Nicotiana sp.
MVKQALAAWGDFSSKSEDETDVGDSSIMEVESEEKEYDLTFALMAQSDDDEDNDNKEVTFRYVQKNLKSYTPKKLMSLANVLIDTYHNLVEDKDDLILEQREVDKTIDDLVACVVI

SEQ ID NO: 105 - protein, 355 aa, Nicotiana sp.
MVGKMRDSSASPNGSFTTAMTLNEEGLTYVPKRYILPPSLRPERTLCDTCLPVVDLSFLRHPLLRPQIIQEVHLACKELGFFQVVNHGIPLSVMKDAIDAASEFFDLPTEEKKHLLSSNVHEPIRYGTSLNHVKDKVHFWRDFLKHYANPISTWIDLWPSNPTCYKEKMGNYTKAAQKLQEELMEVIFESLGLNPSYLHEDIAEGSQVMAVNCYPACPEPDLTLGLPPHTDYGMLSIILQNYQGLQIMDRDEKWHAVPVIEGALVVQLGDHMEVLSNGRYKSVLHRAAVNSEKKRISIASLHSLALGKTVRPAPDLVNEQHILSYKEGSFSDFLDFISQKNIIEGKYIDKLKINS

SEQ ID NO: 106 - protein, 103 aa, Nicotiana sp.
MVRRNGEILKRGSSSKLKNYDLCHKCGKHGHFIRDCPLLKQEFSKNNPKKAVKRNPVPFKDFKRKRSADNVMKHDLATWGHSSSESEDETDAGDSSMMAAKGE

SEQ ID NO: 107 - protein, 351 aa, Nicotiana sp.
MEKSSASPNDSFTSAMTLTEDGLTKVPKRYILPPSLRPDGTRSNTCLPIVDLSFLRHPLHRPRIIEEVHLACKELGFFQVVNHGIPLSVMKDALEAATEFFDLPNEKKMHLLSSNVHDPVRYNTSLNDVKDKVSFWRDFLKHYANPLSNWIDLWPSNPTCYKEKMGNYTIAAQKLQEELMGVIFESLGLNPSYLHEDIAEGSQVMAINCYPACPEPDLTLGLPPHTDYALLTIILQNHQGLQIMDHDGKWHSVPVIEGALIVQLGDHMEVLSNGRYKGVLHRATVNSEKKRLSIASLLSLALGKKVRPAPALVDEQHILSYKEGGFSDFLDFISGEDIVEAKYIDKLKINP

SEQ ID NO: 108 - DNA, 20 bp, Artificial Sequence
  source: /note="Description of Artificial Sequence: Synthetic oligonucleotide"
atgcagggaatatcattaga

SEQ ID NO: 109 - DNA, 20 bp, Artificial Sequence
  source: /note="Description of Artificial Sequence: Synthetic oligonucleotide"
atggcaatggaaatgaatcc

SEQ ID NO: 110 - DNA, 20 bp, Artificial Sequence
  source: /note="Description of Artificial Sequence: Synthetic oligonucleotide"
atgggggacgtttgcggcag

SEQ ID NO: 111 - DNA, 20 bp, Artificial Sequence
  source: /note="Description of Artificial Sequence: Synthetic oligonucleotide"
atgaattcagctgatctttc

SEQ ID NO: 112 - DNA, 20 bp, Artificial Sequence
  source: /note="Description of Artificial Sequence: Synthetic oligonucleotide"
atgtacgaacaaacaaccat

SEQ ID NO: 113 - DNA, 20 bp, Artificial Sequence
  source: /note="Description of Artificial Sequence: Synthetic oligonucleotide"
atgaacccagctaatgcaac

SEQ ID NO: 114 - DNA, 20 bp, Artificial Sequence
  source: /note="Description of Artificial Sequence: Synthetic oligonucleotide"
tctaatgatattccctgcat

SEQ ID NO: 115 - DNA, 20 bp, Artificial Sequence
  source: /note="Description of Artificial Sequence: Synthetic oligonucleotide"
ggattcatttccattgccat

SEQ ID NO: 116 - DNA, 20 bp, Artificial Sequence
  source: /note="Description of Artificial Sequence: Synthetic oligonucleotide"
ctgccgcaaacgtcccccat

SEQ ID NO: 117 - DNA, 20 bp, Artificial Sequence
  source: /note="Description of Artificial Sequence: Synthetic oligonucleotide"
gaaagatcagctgaattcat

SEQ ID NO: 118 - DNA, 20 bp, Artificial Sequence
  source: /note="Description of Artificial Sequence: Synthetic oligonucleotide"
atggttgtttgttcgtacat

SEQ ID NO: 119 - DNA, 20 bp, Artificial Sequence
  source: /note="Description of Artificial Sequence: Synthetic oligonucleotide"
gttgcattagctgggttcat

SEQ ID NO: 120 - DNA, 24 bp, Artificial Sequence
  source: /note="Description of Artificial Sequence: Synthetic oligonucleotide"
tgcagggaatatcattagagtttg

SEQ ID NO: 121 - DNA, 24 bp, Artificial Sequence
  source: /note="Description of Artificial Sequence: Synthetic oligonucleotide"
agagtcggagaaaaacaaggtttc

SEQ ID NO: 122 - DNA, 24 bp, Artificial Sequence
  source: /note="Description of Artificial Sequence: Synthetic oligonucleotide"
aagagaggtatccaagctactttc

SEQ ID NO: 123 - DNA, 24 bp, Artificial Sequence
  source: /note="Description of Artificial Sequence: Synthetic oligonucleotide"
tttctggaatattagaatcattta

SEQ ID NO: 124 - DNA, 24 bp, Artificial Sequence
  source: /note="Description of Artificial Sequence: Synthetic oligonucleotide"
taacatatcgccccagctaatttc

SEQ ID NO: 125 - DNA, 71 bp, Nicotiana sp.
  modified_base (36)..(36): a, c, t, g or not present
  source: /note="See specification as filed for detailed description of substitutions and preferred embodiments"
ccagatgcccctaaaaagtggtttgactgtttcttnaaggaaaaacactccacagttgcaaaggtacatta

SEQ ID NO: 126 - DNA, 71 bp, Nicotiana sp.
  modified_base (36)..(36): a, c, t, g or not present
  source: /note="See specification as filed for detailed description of substitutions and preferred embodiments"
accgcacttgcagtttggtttccgtaggtgcggcgnagcagaagcgtctaacaggccacaaaaaagaaatt

SEQ ID NO: 127 - DNA, 71 bp, Nicotiana sp.
  modified_base (36)..(36): a, c, t, g or not present
  source: /note="See specification as filed for detailed description of substitutions and preferred embodiments"
tcgagaggcatagacatgtttacttcatttcccctngaggactggttctgcataataatcgggttaagtgt

SEQ ID NO: 128 - DNA, 71 bp, Nicotiana sp.
  modified_base (36)..(36): a, c, t, g or not present
  source: /note="See specification as filed for detailed description of substitutions and preferred embodiments"
aatttaagaaggaaataattggtagtaacagagggnatccaggtctcaaagagaaatatcacatattaaaa

SEQ ID NO: 129 - DNA, 71 bp, Nicotiana sp.
  modified_base (36)..(36): a, c, t, g or not present
  source: /note="See specification as filed for detailed description of substitutions and preferred embodiments"
acactcgaaataacatacggtttgtgcgggattttnggggaggagttgcaggggttcaaactggttttctt

SEQ ID NO: 130 - DNA, 71 bp, Nicotiana sp.
  modified_base (36)..(36): a, c, t, g or not present
  source: /note="See specification as filed for detailed description of substitutions and preferred embodiments"
catcctcccaggccctttcagtcagctcttcaggtntctcacgatgcttcatgtagctgtggtccgtagat

SEQ ID NO: 131 - DNA, 71 bp, Nicotiana sp.
  modified_base (36)..(36): a, c, t, g or not present
  source: /note="See specification as filed for detailed description of substitutions and preferred embodiments"
tctaactccaaaaggataacttttctcccaagtcanattttatccaagtgtgttaaggtttttactaggta

SEQ ID NO: 132 - DNA, 71 bp, Nicotiana sp.
  modified_base (36)..(36): a, c, t, g or not present
  source: /note="See specification as filed for detailed description of substitutions and preferred embodiments"
tacattcctttgacatccaacttggtgtttagtagngaaattttgacttatcaaagaaacatcgtgtagtc

SEQ ID NO: 133 - DNA, 71 bp, Nicotiana sp.
  modified_base (36)..(36): a, c, t, g or not present
  source: /note="See specification as filed for detailed description of substitutions and preferred embodiments"
aagtatttgtaagatattatgaggtgtcagataggnatatgatgtaattgggtgtcgcccttgaagaccgc

SEQ ID NO: 134 - DNA, 71 bp, Nicotiana sp.
  modified_base (36)..(36): a, c, t, g or not present
  source: /note="See specification as filed for detailed description of substitutions and preferred embodiments"
attgaaacgtaccgtgccctatcggattcaaatggngactcttgggtttcgtgctcggggaatttatgtct

SEQ ID NO: 135 - DNA, 71 bp, Nicotiana sp.
  modified_base (36)..(36): a, c, t, g or not present
  source: /note="See specification as filed for detailed description of substitutions and preferred embodiments"
attcatcttcaagcatcatataaaaattggcaattntcaattctgtaaaaatggttgttcagttagacata

SEQ ID NO: 136 - DNA, 71 bp, Nicotiana sp.
  modified_base (36)..(36): a, c, t, g or not present
  source: /note="See specification as filed for detailed description of substitutions and preferred embodiments"
gatagtaaaagtgatatgcctctaaagcacatgttngtacaagccgaccagaagaagtaatcgtcaattac

SEQ ID NO: 137 - DNA, 71 bp, Nicotiana sp.
  modified_base (36)..(36): a, c, t, g or not present
  source: /note="See specification as filed for detailed description of substitutions and preferred embodiments"
catgttgaaatttcattagcacatctaaaatataanagtagtttgattattttgtaaatgcactaatgagt

SEQ ID NO: 138 - DNA, 71 bp, Nicotiana sp.
  modified_base (36)..(36): a, c, t, g or not present
  source: /note="See specification as filed for detailed description of substitutions and preferred embodiments"
accaggcttaacagaaagcttcactcgatctattcngttttggttagaattcgttaggtttcgtgaaggaa

SEQ ID NO: 139 - DNA, 71 bp, Nicotiana sp.
  modified_base (36)..(36): a, c, t, g or not present
  source: /note="See specification as filed for detailed description of substitutions and preferred embodiments"
aacatgctaattctattaacagtaaccccatacccncatggattactgacgtgctaattctattaacaata

SEQ ID NO: 140 - DNA, 71 bp, Nicotiana sp.
  modified_base (36)..(36): a, c, t, g or not present
  source: /note="See specification as filed for detailed description of substitutions and preferred embodiments"
tataccacactgctagacaaggtaactccgaaaganggggagcttactgataaagctaaactcgggcaaca

SEQ ID NO: 141 - DNA, 71 bp, Nicotiana sp.
  modified_base (36)..(36): a, c, t, g or not present
  source: /note="See specification as filed for detailed description of substitutions and preferred embodiments"
ctgaactggcacgaattatcgaggattgaactaacntgaatatctgctcactgaactcacatcaatacctg

SEQ ID NO: 142 - DNA, 71 bp, Nicotiana sp.
  modified_base (36)..(36): a, c, t, g or not present
  source: /note="See specification as filed for detailed description of substitutions and preferred embodiments"
gcaatcgagttgcaagctttaaatggtgaaaggaantttttggtgagtggtcatcgagtcaagcactatta

SEQ ID NO: 143 - DNA, 71 bp, Nicotiana sp.
  modified_base (36)..(36): a, c, t, g or not present
  source: /note="See specification as filed for detailed description of substitutions and preferred embodiments"
ccctagctagggtacttctgaaccctcccgaaaatnggggcctcttatcctactgaatctactctctaccc

SEQ ID NO: 144 - DNA, 71 bp, Nicotiana sp.
  modified_base (36)..(36): a, c, t, g or not present
  source: /note="See specification as filed for detailed description of substitutions and preferred embodiments"
ctcaaaagctcgaccaaatctacccgacttcgcatntgtggcatgcaaggttaagccccaagccttcaagt

SEQ ID NO: 145 - DNA, 71 bp, Nicotiana sp.
  modified_base (36)..(36): a, c, t, g or not present
  source: /note="See specification as filed for detailed description of substitutions and preferred embodiments"
catgaacaacttcatgactcaaacctagatcaacancgtgcttcagcctcttgcaccatctatgaatgtca

SEQ ID NO: 146 - DNA, 384 bp, Nicotiana sp.
acctagaagggccgcctgccagaattaaatttcagcaattatcgctctcagaatctggagttgcaatcagattcatccactctaactcgtgttctgtacgtttggacttttctttttgagtgaaatgagatttgtgatattttggtttctgaaattcttgaacttttttctttcttgttgtttatttttgttttctttttgaaggtgaatttcctgcaaaagagtctagtaacgttgatattactccatatgaggttaaaatgtaattttgctacttaccttttcccttaatcactttggtgataattttttttaaaaaaattcagatcttggatacatcagattttgaaggttgtgagatcaattaatgtgaaggaatcctga

SEQ ID NO: 147 - DNA, 203 bp, Nicotiana sp.
acctagaagggccgcctgccagaattaaatttcagcaattatcgctctcagaatctggagttgcaatcagattcatccactctaactcgtgttctgtgaatttcctgcaaaagagtctagtaacgttgatattactccatatgagatcttggatacatcagattttgaaggttgtgagatcaattaatgtgaaggaatcctga

SEQ ID NO: 148 - protein, 66 aa, Nicotiana sp.
LEGPPARIKFQQLSLSESGVAIRFIHSNSCSVNFLQKSLVTLILLHMRSWIHQILKVVRSINVKES

SEQ ID NO: 149 - DNA, 447 bp, Nicotiana sp.
atggcgacctctatattatcaagactgcctgcgaattggccaaagacaggggcttgcaagacagtacctgcagatcatgcccctattgagaagcagaagcataccaggaagaaagggcagaagaagcaggaatggataccaaagcaaccagtacaaccaaaggagactgaaccaacagctgtgatcccaaaagtggtcaaccaagtcgatcaaccatcctcttctacaattgaggatgaacagggtcaaatccactctaaagacagagggaaagcaaagatggatcaacttcgaaagccttcacaaactgaggttatggaaaggatattgactcaaaacaggtttggtgctcttagaattcagccagaagtaaccactaatacagtgggagggacatccactccaatagtacagaacccccatgattttcggatcatggaacattag

SEQ ID NO: 150 - DNA, 447 bp, Nicotiana sp.; identical to SEQ ID NO: 149

SEQ ID NO: 151 - protein, 148 aa, Nicotiana sp.
MATSILSRLPANWPKTGACKTVPADHAPIEKQKHTRKKGQKKQEWIPKQPVQPKETEPTAVIPKVVNQVDQPSSSTIEDEQGQIHSKDRGKAKMDQLRKPSQTEVMERILTQNRFGALRIQPEVTTNTVGGTSTPIVQNPHDFRIMEH

SEQ ID NO: 152 - DNA, 2349 bp, Artificial Sequence
  source: /note="Description of Artificial Sequence: Synthetic polynucleotide"
gatgagaggacgttgtagggaaagctgacagaaaaggctgcacagcttttgaaacccccccgaggtcgtcttcttcgaacctccccccccccctccccgttttttttcatttttctgcttcagcaacataacccaaaaaccaacaaaccccataaccctcttcactcacacccttcaccagcaccgccggtcgctaccaaacccgcaggaaaatccggcaacacccaataacgaaaaaggcaataaacgttgaccgcagttgcctgaaactcgtcggaaaaacgagctccagcagctcgtcagatttacgagctccagacgcaacctctgaaaccaacgacacacaacaaccaactcttccatagctgccaagctccatcaccagctcaaacgagaaaacaaccacgacacacgtacacgctgaaaacagtgaggagttcaaaagctcgtttaacacttttccggcgagtctcgagtttttctggtcgagttttgatgactattctgctggttccttgtctaggttgaatccatcttggagttcgtttgcgagatccgtacagctccatatattgaagtgtagggttcgtcgaggtccctggtgcaagctttccgtttagtcgttgagtcggagattcgagtttgccgctgaggtcgtcatcgagtttttcggtcagtaaaggtcctgctagaatcgctgacgtatgtttcggttgggcgctagtcagttgttggctttccgttcaaggtccgttgggatccttctcactattttagattcttctgtactagaagacttcagtttttttaattaaaaggtcagttccttccttcacggcattattccattttcaaatagctttgatggactttgctggtgcaccgctgcttcatttttgttgatgcttgttttagaataacgtatatcattagtagtgtatgccttaactgttgatgtttggttgtttgtgtgaattaactttcgttgtgtggaaccaggataagtatacgccttaacaataatttgagacgtaggtttaatgtttaaaacacgtaagagtgataaatagactataagagataacgacgagactattctgtttggattaaatcacattagtttggatttgtgtcatagtttaattatgtatcggtataataggtagaaatgaccatttctgataaattgataacataaaaaataaacacgtagttgctttaggtgcgttattttaataatctacctttctaaactcgggtgtgcatttatgtgacccaaatctaaatctcaacaatgttagatagaatatgtcgagagtcgcgggtgcatttatgtaacgtggttcgaaacgtgttttaataacgttgtaattttctttaaaaattaaataaagcggttataaaatttaaaattgaatcataggctaaaatgtgtttaaaatcagataattaagccgaatataacagttgagcgaccgtgctagaaccacggaactcgggaatacctaacaccttcttccgggttaacagaattccttacccggatttctgtgttcgcggactttaatacagagtcaacctttcctcgattagggattttaaactggtgacttgagacaccataaattatcccaagtggcgactctaaatcttttaataaataaatctttcgattgtcctttaattgaaaaaactcccttatacatccctcttccggggggtgtaggaaaaaggaggtgtgacagctctggtgactctgatggggaacgaacccagaatctctggtttagggttcaaaattcgagcttagatgaattgttatatttggttttatctgttatctgattttatcacatgtttgggcctaatgtgctaaatgttgcttttaccgctttgatattatctgaactgtatataaactgctacgaaactcttctcttctcatcttcgggatgtgctcgctagtcaagactccctattctgttagtgtcataccttgaaataagaaagaggctcggacaagttactaagtcggatggccttttggttcccggtacgtagccccatcctcggctcaagttgtccgctggggtacacaagtctagaacaactgcccaggttttgaacctagaataactcagtttcatgccggatccctagtaggaacgcttgtttccatcatgtgcacttgacttaggggactcaacacaggggttgggtccgtctaggacaggtataccccagaaaataaaagatcatcctgatgcatcttatgtgctacatgttgcatttattcaagggtaaaagggtcatttggcggaccaatattagttgagggcgaatgaaaat

SEQ ID NO: 153 - DNA, 672 bp, Nicotiana sp.
atgaattcagcagatgtaaccttctctttctctgattttaatctccttgaatccattaagcaacatcttttaaatgattcagatttttctgaaactctgtcgcctatgagttcaagtaacggattgcctaacagtcctagctcaggttttggcagctccctttcagcagaaaatagcttcgaaatctccctttcggaccaaaactttgaggaaacaataccaaatctcgaagaaaagtctgagtccgaggaggaaatgaaggggaatgtggtggcgcgtgagaataacgcgccggaagattggaggcggtacataggagtgaaacggcggccatgggggacgttttcagcggagatgagagaccccgataggaggggggcaagactgtggttaggaacttacgagaccgcagaggatgcagcgttggcgtacgatcaagccgctttcaaaatccgcggctcgagagctcggctcaattttcctcacttaatcggttcaaacatgcctaagccggctagagttacagcgaggcgtagtcgtacgcgctcacccgagccattgtcttcttcgtccacctcatcatcagtaaatgtaccaagaaaaaggaaaatagatgtgatcaattccatagccaaggtttgtcatggttggaacctccacatgttactataa

SEQ ID NO: 154 - DNA, 654 bp, Nicotiana sp.
atgaatccccttgataatgcaaccttctttttctctgaccttgattttcttgactctattgagcaccatcttctgaatgattccgatttttccaacagtttttcgccgattagctcgagcagtgtcgcaactcctaatagtcctagctcatgtttttgcagctgccttttggatgaaaacattgaagaaacaacaactctcgaatctcaatccgagcccgaggagccaacgcaaggcttaaaggcggcgcgtgcggaaaacacgaagcaaaattggaggcggtacataggagtgagacggcgggcttggggaaagtttgcggcggagataagggacccggagagaagaggcgcgagattgtggctaggaacttatgagactcctgaagatgcagcattggcgtatgatcaagccgctttcaaaatccgcggttcgagagctcggctcaattttcctcacttaattggctcaaacatgcctgagccggctagagtaaaagggagacgtcataattcacgctcactggagccatcgtcttcttcatccaccacatcatcggaaaatggaagaaggaaaagaaatatagaggtcataaattctatagccaaagccaaattggttggtcatatacgcgatctagagatgtcactataa

SEQ ID NO: 155 - DNA, 4419 bp, Nicotiana sp.
atggaacctgcagtgttttggcatacatgcttagcaatttgtatcttcttttctggtttcatggtgtcatgtcatcaaacagataagcttattctccaagaaaactcaaaccaagttacattgtcaagcaatttcttgtttggaacggcctcttcatattaccaggttcttctcacagttctttccctttttccccgatattcttgttttaaccgctcttctttttttgtccgcagtatgaaggagcttatctgagtgatgggaaaggcctcagcaactgggacgtttttacccatgaagctggtgagctttcaaaatgccaatttctttcaatgtttgcaacatttactgtgtttttaggctaccaaatcaagcagcacctgccaccagtcaccagctccccgcacaccccacaaatagagaaaaaggaattcatgtaatttattatttttgtcttgttgcaggtcatattaaggaaggaagcaatggagatgttgctgttgatcactaccatcgttatttggtgatctagttgatgctcagtcttttttttttaaaaaaaaagaagcttcaaaaattaattaatttctacaaattaacacagaacccactgccccttagtcagggattactggcttcttaggcatttccgaaggccaacattttcttggatgtttatctagatatcttacctacttcattgaatatttcctttctttcttgaatcatatgttgcttgttttacctttttgttctcttcttagactaagaatgtctttccatatattttaatctttctctttccaaaaattatttaccaaaaaaaaaaaaaagcatgaatttatgtgtttgattaatatcttttttctttctctatatatttttttggttctttccttataaggttgtgtgtgtcacacggcttctttccttgcaagactgatgctcaattcgaactatatataagattgttgtttcaaatactataaggtcctatataaaattgatcttctgattgtatgattgataatttataattttcacgtactagattaaagaagggaaaaggttcagatttttccttgtactattttaaatagtcaatatttattcccgttatactttctttataaattaaagagttaaagaagtaaataaatttgcgctcatccctaacggttatctataatggcacctgacctcttaactaaaatgccacataagagttcatgccaccttttatttataatattttctaagataaataagccacttaaatctgttcagcctagtatttatttcttttttcatttgactatttgaccaggaaattttcatttcgtcgtacaattatttcctaccttccgccccacccacctactcccaacccttttcaatttttcccgattcttttcctttacctttccattgcagacgtcaccttcaccaaaataaaaatttcgtcttcttttccattcaagtccttcaatatgtcaacaatggtattcttgaaatataaccagccaaactcaacaagcaatagatatagttctgtttcaagctcaatgagtcattgtcaatcagttctcacacttcaaaacaccacaaatcctaaatctcacaatttaattttcataccaaacttcaaagattacaatgatggtgatgtattaattttttctgcttcaaaaaaaacttgtttggagttgttattagagctaaaaatcaaattcttcttctcatttgaagaatttgtggtgaaatttttgaaacccactatgttctttgggtgctgaaatttttgaaacccaattcgatttgttgaagtgtggctgttttgagcttaaaatcgtgaatcaaacactgatttgagtgaaaaatgaacttgaaaattcgaagttggaaaatgactcaagaacctgaaatttcttgcttgattcttacagaaatgaagtagcaaaacaaatattggagcttaaaatgggaagaataacactggtgttcaaaaaattaaaaaaaaaatatcaccattgaagggtttataagagagctctagaacataagatttaagtactctgattcgttgaaccggcttcacccaaacaaaggctgcggatcagccgtaaagagggttcaattaagaaccacggtcacaggttcaagcctccattaaagcaacaaactaatatattttaccctgctgttaaacgtccattgttcagttaatttgcttatgttttctatttgtcttgtttttcatacttctatttatattttttgtttaggtcgaataaaatttatttaattaactctacttcaataatttaaatttttctactaaatgaattttcgttctctcttacataggttttgctaaaaacataagaatgctttgccgaaattattataatttgtttacgtaatttagtatattttatctttttagtttagtggatcatctcttctcctctaatcgcttgtatcaaaattttagtttataactctttttttcaactttatatatatatatattgtactaagaagaaaatttgtaatttttttaaagaaacattccccaactttgttttttaaaaaaatagcatgaatttaaaatgacttcattttggctcttgagagtacgtggaaaaaaaaaaaagcaatgagcaaattttgtttataggagcggattatacaattggctaccttgtttttgcctgaactcacttgtacaaaatcctaggtccgccattagtagggacggcaaaaagtgaatgaaaaaagaacgataagcttgaaaaagagagaattatatatatatatatatatatatatatatatatatatatatatatatatgcctgcagaccagttgatatgaatctaaagtgagggacgttgagattaattagatggtttttgctaaataatttttgcttactgaaactcactcaaaacgttttcatggtattatgaaatataatactgctcacacaacaataaactagataggaggtacttatgattgaacaatttgtggctttattaggagatcaaacttaatttgttcatgcataagaaaagtgaacagcctaattgtgctggacagaaggcatacatgcatatgcatgttgacacaaaagggcgaaaaaagttagattcttctttgtaattaggatttaaaactcacattggtttcattttatgggccaaaactgatcagcatcatatgaaagcagataagaacatgtgcatttgttgttaatttcaaagctgcttagactaatgccgtgtattagcaataatataaacgcgtaaatcatgaaatggaagagttttgatctgtttggtattaaaatgtaaacaggaggacatcaaactcatggcagatataggggtgaatagctatcgtttctctatctcatgggcaagaattctgcctagtaagttataactatcactgctctctttccttcatcttaagcaaataaggcagcctgatgcactaagctcctgctatgcgcgggtccggggaagggcatgaccataagagtctattgtatgcagccttacctagcatttctgcaagaggctatttccacggctcgaactcgtaacctcctggtcacatatagacaactttaccggctacggcaatgctccccttcctcatcttaaaaaaataatctcctaattgtcgtttacaatgagaatctctttttcttttttttttggttggttataattttattcagaggggatatttggagaagttaatattgccggaattgagttctacagtaagctcattgatgcactcctacagaaaggtcaattctgcttctcttgctagcagttttatgctttagataatccaaaatgtagaaaagaagtaaaattttgagctcagacgaattcgttatttgctatggcttcagggatccaaccgtttgtcacattaacacattttgacataccacaagaacttcaggacagatatggtggttggctaagttcacaaatacggtaagtgtcacaacacaattttataggagcccaatgctttaaactatgtatcaagtgaaacaactgaacatctatccatgacatgaacatgcattctacatatcttaaaacatttacaagagcatgcattctacgttataaacatttctaaacattttctacgtatatcttaggaaatatgtatttttcaaaaaaaaaaatgccttaaagggacatacatctcaacttacatctacctcacactccaaatacttaaatgacgtcaagcacgtccaattaaatcaaccaacatgttagtttgtatcaaaccatatcaatacttgttataacaatttctaacttactccatttaggttcacaattggttacaagccatccatatcccattccatttga

SEQ ID NO: 156 - DNA, 2029 bp, Nicotiana sp.
atgtcaaggtatatattaactcattattagagtcattaattaactcgatttttaacttctttgccacactatatcactgacaactacttctaactagcggagtactataaatacgctcacacgtctcaatgaactcataacttgtggacctcatgctcgctttaatcacatcgttaagattttatttagtccaaagaattgtccatatcttacgggactttaatttaccataagtagttgggcccctcttatacttaaagctagttgtagattctatcaaaatccaaaatgatgaacaagttacattcgtgttgcatgggttttgtctcagggatgatttcagctatttcgcaaacatatgcttcaaatacttcggagatagagttaaatactgggtaacgatgaatgaggctaactttatggccatagctggctatagagatgggacttaccctccaactcgatgctctggtatatttgggaattgtagtgctggggattcagaaagggaacccttcattgcagctcacaatatgatcctatctcatgcaaatgctgtcagcatttaccgcaccagatatcaggttttttcgacggctctttcccttttctccattatcatgtcaattctcaacatggcatgatctgggacgcaactttttcaaacagtaattactcttctagtgcaatgctattgttggtctttatgttgttcggactcttcgaaaataataccgtgtgcgtgccggatcctccaaaagtagtgtatctttgaaaaattcgacacgggtgcagccgcattttggagagtccgcgcaacatagattgacttgtctatagaaaggaaagggaacactaggtaaagcaagatatcatcacgagtctgtaactatttttggtgaagtaaaataggaaaattgtatatttctgctgcttttcagaaaagtcaaggaggcatgattggcattactatgggttttgaatggtttgaaccgttaagcaattcctcagaagacatagctgcaactcatagagctcgatcattctatgacagttggtaagccttctatatactaatatttatgcatcggaaagagagtaaaagaatattttttactaactacccacatgcaggtttttagaccctattatattaggaagatatcctaaagaaatggtacaaattttgggatctaatcttccggaattatcaatgaatgatttgagcaagttgagttatggcctagatttcattggaatcaatcattattcggctgtctatatcaaagattgcttatattctgcctgtgaacatggaaactcttggtcagagggttcttattttaggactacacaaagagacggcatctacattggtgaaccagtatgtttccttaaatcacatcagtattcttatctttaatctttttctgcaaattattacttgcactttctacactgctaaattaattttttaaggattttttttaataaatcagggggaagtggactggcaatttgtgtacccacaagggattgaaaaagttgtgatgtatttgaaggacaaattcaacaatactccaatgtttatcactgaaaatggtaagaaaaatattacactttcttgtcctttagactgagatacatttcatcaactaattacttgagcaagatgcaatttgatccaccggcggatacaactgctaatataactggcaatgttgcaggctttgctgggaacagttcttctatagaggatgccttgaacgatgttcgtagagtgaaatacttgcatagcaacttaaattcattggcaaatgccatcaggaaaggtgcagatgtaaggggatactttgtttggtcccttcttgacaactttgagtggctagatggatatagcataagatttggactttactatgtcaactatactaatctccagagaactccaaaattatcagccaccaagtatcaagagctcatgtataactttcacatagagcttgaaacacatactgccctgaaatag

SEQ ID NO: 157 - DNA, 921 bp, Artificial Sequence
  source: /note="Description of Artificial Sequence: Synthetic polynucleotide"
aggacgttgtagggaaagctgacagaaaaggctgcacagcttttgaaacccccccgaggtcgtcttcttcgaacctccccccccccctccccgttttttttcatttttctgcttcagcaacataacccaaaaaccaacaaaccccataaccctcttcactcacacccttcaccagcaccgccggtcgctaccaaacccgcaggaaaatccggcaacacccaataacgaaaaaggcaataaacgttgaccgcagttgcctgaaactcgtcggaaaaacgagctccagcagctcgtcagatttacgagctccagacgcaacctctgaaaccaacgacacacaacaaccaactcttccatagctgccaagctccatcaccagctcaaacgagaaaacaaccacgacacacgtacacgctgaaaacagttgaatccatcttggagttcgtttgcgagatccgtacagctccatatattgaagtgtagggttcgtcgaggtccctggtgcaagctttccgtttagtcgttgagtcggagattcgagtttgccgctgaggtcgtcatcgagtttttcggtcagtaaaggtcctgctagaatcgctgacgtatgtttcggttgggcgctagtcagttgttggctttccgttcaaggtgtggatctacttactggagtttgagcatgacagataccccaggatcactgcattcaggagccgctcgaggagccattttatgtttttgagtcaattgtttttgttttattttctagtcctgcatagtagtatttagtcttttaggtgatgttagggtttgtattgtctagttaagtttgcatagtcttttgttattgtatttcttattttgcatttggaaatgtgttacaagtcaaaaatcaaaaaaaaaattgcgtttttatattttcgt

SEQ ID NO: 158 - DNA, 672 bp, Nicotiana sp.; identical to SEQ ID NO: 153

SEQ ID NO: 159 - DNA, 654 bp, Nicotiana sp.; identical to SEQ ID NO: 154

SEQ ID NO: 160 - DNA, 573 bp, Nicotiana sp.
atggaacctgcagtgttttggcatacatgcttagcaatttgtatcttcttttctggtttcatggtgtcatgtcatcaaacagataagcttattctccaagaaaactcaaaccaagttacattgtcaagcaatttcttgtttggaacggcctcttcatattaccagtatgaaggagcttatctgagtgatgggaaaggcctcagcaactgggacgtttttacccatgaagctggtcatattaaggaaggaagcaatggagatgttgctgttgatcactaccatcgttatttggaggacatcaaactcatggcagatataggggtgaatagctatcgtttctctatctcatgggcaagaattctgcctaaggggatatttggagaagttaatattgccggaattgagttctacagtaagctcattgatgcactcctacagaaagggatccaaccgtttgtcacattaacacattttgacataccacaagaacttcaggacagatatggtggttggctaagttcacaaatacggttcacaattggttacaagccatccatatcccattccatttga

SEQ ID NO: 161 - DNA, 1032 bp, Nicotiana sp.
atgtcaagggatgatttcagctatttcgcaaacatatgcttcaaatacttcggagatagagttaaatactgggtaacgatgaatgaggctaactttatggccatagctggctatagagatgggacttaccctccaactcgatgctctggtatatttgggaattgtagtgctggggattcagaaagggaacccttcattgcagctcacaatatgatcctatctcatgcaaatgctgtcagcatttaccgcaccagatatcagaaaagtcaaggaggcatgattggcattactatgggttttgaatggtttgaaccgttaagcaattcctcagaagacatagctgcaactcatagagctcgatcattctatgacagttggtttttagaccctattatattaggaagatatcctaaagaaatggtacaaattttgggatctaatcttccggaattatcaatgaatgatttgagcaagttgagttatggcctagatttcattggaatcaatcattattcggctgtctatatcaaagattgcttatattctgcctgtgaacatggaaactcttggtcagagggttcttattttaggactacacaaagagacggcatctacattggtgaaccaggggaagtggactggcaatttgtgtacccacaagggattgaaaaagttgtgatgtatttgaaggacaaattcaacaatactccaatgtttatcactgaaaatggctttgctgggaacagttcttctatagaggatgccttgaacgatgttcgtagagtgaaatacttgcatagcaacttaaattcattggcaaatgccatcaggaaaggtgcagatgtaaggggatactttgtttggtcccttcttgacaactttgagtggctagatggatatagcataagatttggactttactatgtcaactatactaatctccagagaactccaaaattatcagccaccaagtatcaagagctcatgtataactttcacatagagcttgaaacacatactgccctgaaatag

SEQ ID NO: 162 - DNA, 189 bp, Artificial Sequence
  source: /note="Description of Artificial Sequence: Synthetic polynucleotide"
acgaaaatataaaaacgcaattttttttttgatttttgacttgtaacacatttccaaatgcaaaataagaaatacaataacaaaagactatgcaaacttaactagacaatacaaaccctaacatcacctaaaagactaaatactactatgcaggactagaaaataaaacaaaaacaattgactcaaaaa

SEQ ID NO: 163 - DNA, 233 bp, Artificial Sequence
  source: /note="Description of Artificial Sequence: Synthetic polynucleotide"
caaaagctcgtttaacacttttccggcgagtctcgagtttttctggtcgagttttgatgactattctgctggttccttgtctaggttgaatccatcttggagttcgtttgcgagatccgtacagctccatatattgaagtgtagggttcgtcgaggtccctggtgcaagctttccgtttagtcgttgagtcggagattcgagtttgccgctgaggtcgtcatcgagtttttcg

SEQ ID NO: 164 - DNA, 180 bp, Artificial Sequence
  source: /note="Description of Artificial Sequence: Synthetic polynucleotide"
gcgtgtacgtgtgtcgtggttgttttctcgtttgagctggtgatggagcttggcagctatggaagagttggttgttgtgtgtcgttggtttcagaggttgcgtctggagctcgtaaatctgacgagctgctggagctcgtttttccgacgagtttcaggcaactgcggtcaacgtttatt

SEQ ID NO: 165 - DNA, 319 bp, Artificial Sequence
  source: /note="Description of Artificial Sequence: Synthetic polynucleotide"
tattaaaacacgtttcgaaccacgttacataaatgcacccgcgactctcgacatattctatctaacattgttgagatttagatttgggtcacataaatgcacacccgagtttagaaaggtagattattaaaataacgcacctaaagcaactacgtgtttattttttatgttatcaatttatcagaaatggtcatttctacctattataccgatacataattaaactatgacacaaatccaaactaatgtgatttaatccaaacagaatagtctcgtcgttatctcttatagtctatttatcactcttacgtgttttaaa

SEQ ID NO: 166 - DNA, 161 bp, Artificial Sequence
  source: /note="Description of Artificial Sequence: Synthetic polynucleotide"
ttctggggtatacctgtcctagacggacccaacccctgtgttgagtcccctaagtcaagtgcacatgatggaaacaagcgttcctactagggatccggcatgaaactgagttattctaggttcaaaacctgggcagttgttctagacttgtgtaccccagc

SEQ ID NO: 167 - DNA, 148 bp, Artificial Sequence
  source: /note="Description of Artificial Sequence: Synthetic polynucleotide"
ctggtgatggagcttggcagctatggaagagttggttgttgtgtgtcgttggtttcagaggttgcgtctggagctcgtaaatctgacgagctgctggagctcgtttttccgacgagtttcaggcaactgcggtcaacgtttattgcct

SEQ ID NO: 168 - DNA, 124 bp, Artificial Sequence
  source: /note="Description of Artificial Sequence: Synthetic polynucleotide"
gctgaagcagaaaaatgaaaaaaaacggggagggggggggggaggttcgaagaagacgacctcgggggggtttcaaaagctgtgcagccttttctgtcagctttccctacaacgtcctctcatc

SEQ ID NO: 169 - DNA, 136 bp, Artificial Sequence
  source: /note="Description of Artificial Sequence: Synthetic polynucleotide"
ctatggaagagttggttgttgtgtgtcgttggtttcagaggttgcgtctggagctcgtaaatctgacgagctgctggagctcgtttttccgacgagtttcaggcaactgcggtcaacgtttattgcctttttcgtt

SEQ ID NO: 170 - DNA, 187 bp, Artificial Sequence
  source: /note="Description of Artificial Sequence: Synthetic polynucleotide"
gttgctttaggtgcgttattttaataatctacctttctaaactcgggtgtgcatttatgtgacccaaatctaaatctcaacaatgttagatagaatatgtcgagagtcgcgggtgcatttatgtaacgtggttcgaaacgtgttttaataacgttgtaattttctttaaaaattaaataaagcggtt

SEQ ID NO: 171 - DNA, 171 bp, Artificial Sequence
  source: /note="Description of Artificial Sequence: Synthetic polynucleotide"
agtttggatttgtgtcatagtttaattatgtatcggtataataggtagaaatgaccatttctgataaattgataacataaaaaataaacacgtagttgctttaggtgcgttattttaataatctacctttctaaactcgggtgtgcatttatgtgacccaaatctaaatct

SEQ ID NO: 172 - DNA, 138 bp, Artificial Sequence
  source: /note="Description of Artificial Sequence: Synthetic polynucleotide"
actcaacacaggggttgggtccgtctaggacaggtataccccagaaaataaaagatcatcctgatgcatcttatgtgctacatgttgcatttattcaagggtaaaagggtcatttggcggaccaatattagttgaggg

SEQ ID NO: 173 - DNA, 147 bp, Artificial Sequence
  source: /note="Description of Artificial Sequence: Synthetic polynucleotide"
tgagacaccataaattatcccaagtggcgactctaaatcttttaataaataaatctttcgattgtcctttaattgaaaaaactcccttatacatccctcttccggggggtgtaggaaaaaggaggtgtgacagctctggtgactctg

SEQ ID NO: 174 - DNA, 90 bp, Artificial Sequence
  source: /note="Description of Artificial Sequence: Synthetic oligonucleotide"
agcgaccgtgctagaaccacggaactcgggaatacctaacaccttcttccgggttaacagaattccttacccggatttctgtgttcgcgg

SEQ ID NO: 175 - DNA, 52 bp, Artificial Sequence
  source: /note="Description of Artificial Sequence: Synthetic oligonucleotide"
cacttgacttaggggactcaacacaggggttgggtccgtctaggacaggtat

SEQ ID NO: 176 - DNA, 89 bp, Artificial Sequence
  source: /note="Description of Artificial Sequence: Synthetic oligonucleotide"
aagatttagagtcgccacttgggataatttatggtgtctcaagtcaccagtttaaaatccctaatcgaggaaaggttgactctgtatta

SEQ ID NO: 177 - DNA, 71 bp, Artificial Sequence
  source: /note="Description of Artificial Sequence: Synthetic oligonucleotide"
ttgcccgtatccaatctgcccgaactacgcatacctgattctcgtctttcgggacgtgatacataggcaac

SEQ ID NO: 178 - DNA, 51 bp, Artificial Sequence
  source: /note="Description of Artificial Sequence: Synthetic oligonucleotide"
cgaacacagaaatccgggtaaggaattctgttaacccggaagaaggtgtta

SEQ ID NO: 179 - DNA, 65 bp, Artificial Sequence
  source: /note="Description of Artificial Sequence: Synthetic oligonucleotide"
ttgcaggatcttagccaaattttgcacttctaaccaccttttggccaaataagtcattttgcaaa

SEQ ID NO: 180 - protein, 223 aa, Nicotiana sp.
MNSADVTFSFSDFNLLESIKQHLLNDSDFSETLSPMSSSNGLPNSPSSGFGSSLSAENSFEISLSDQNFEETIPNLEEKSESEEEMKGNVVARENNAPEDWRRYIGVKRRPWGTFSAEMRDPDRRGARLWLGTYETAEDAALAYDQAAFKIRGSRARLNFPHLIGSNMPKPARVTARRSRTRSPEPLSSSSTSSSVNVPRKRKIDVINSIAKVCHGWNLHMLL

SEQ ID NO: 181 - protein, 217 aa, Nicotiana sp.
MNPLDNATFFFSDLDFLDSIEHHLLNDSDFSNSFSPISSSSVATPNSPSSCFCSCLLDENIEETTTLESQSEPEEPTQGLKAARAENTKQNWRRYIGVRRRAWGKFAAEIRDPERRGARLWLGTYETPEDAALAYDQAAFKIRGSRARLNFPHLIGSNMPEPARVKGRRHNSRSLEPSSSSSTTSSENGRRKRNIEVINSIAKAKLVGHIRDLEMSL

SEQ ID NO: 182 - protein, 190 aa, Nicotiana sp.
MEPAVFWHTCLAICIFFSGFMVSCHQTDKLILQENSNQVTLSSNFLFGTASSYYQYEGAYLSDGKGLSNWDVFTHEAGHIKEGSNGDVAVDHYHRYLEDIKLMADIGVNSYRFSISWARILPKGIFGEVNIAGIEFYSKLIDALLQKGIQPFVTLTHFDIPQELQDRYGGWLSSQIRFTIGYKPSISHSI

SEQ ID NO: 183 - protein, 343 aa, Nicotiana sp.
MSRDDFSYFANICFKYFGDRVKYWVTMNEANFMAIAGYRDGTYPPTRCSGIFGNCSAGDSEREPFIAAHNMILSHANAVSIYRTRYQKSQGGMIGITMGFEWFEPLSNSSEDIAATHRARSFYDSWFLDPIILGRYPKEMVQILGSNLPELSMNDLSKLSYGLDFIGINHYSAVYIKDCLYSACEHGNSWSEGSYFRTTQRDGIYIGEPGEVDWQFVYPQGIEKVVMYLKDKFNNTPMFITENGFAGNSSSIEDALNDVRRVKYLHSNLNSLANAIRKGADVRGYFVWSLLDNFEWLDGYSIRFGLYYVNYTNLQRTPKLSATKYQELMYNFHIELETHTALK

SEQ ID NO: 184 - DNA, 726 bp, Nicotiana sp.
atggattcttcttcttgttcttctcattttttctaccctatgaattctgatctttcttctgattcttcttgggaatggtccaatttaaactcaactaattctcttccttttaaccttaacgattccgaagaaatgcttctttttggtgttcttactaacgcagctcaagaaacaacgtcagaaacagttacctcgtaccatgttaaggaagaggaagttagttcaaaatctaaggttgtaaacgaaattgaagaaaaaccggccaaggagaagtcgtttcgcggcgttagaaggcggccgtgggggaaattcgcggcggagataagggattctactaggaatggtgttagggtatggttagggacatttgatagtccagaggcagctgctttagcttatgatcaagccgctttttcaatgcggggtacttcagcaatcttgaattttcctgtggaaactgtccagcagtcgctacgtgacatgaaatgccacgtagatgaggactgttctcctgtagtggcgctaaaaaagcgccactcaatgaggaagaggagcttgaattccaagaagagtagtaatagtaatagtaaagttgtgagggaagtaaaaatggagaaggtaaatgttgtagtgtttgaagatttgggtgctgattatttggaacaacttttgagtagtagttcaagtgatcaaagtagttgtaatgaagcttttctaccatggtaa

SEQ ID NO: 185 - DNA, 1923 bp, Nicotiana sp.
atggaagagttctttcaaattcaatcttcacaaaccaataatggagaggttttatggtttgaaaatgaagcttttttgatgaatcaaagtgcttttgcgagtttcagaaaccaatccattgaaggatttggagtttctggctatggaaatgtatcggcgaatcatcggaacatgaacaagaggatgatggagtttttgaaaaagagttggattcctaaaattggagaagtgaaaatggaaagagagaaagtgcataaacatatgattaaagagaggattagaagagaaaagcagaagcagagttatttggatttgcataaattgctcccaatgggaaccaaggttagtacatttccatacctacagctcacgggttcgagttgtggaagcagtcataatacttgtattagggtagactgtttacatcacatctttggggttcggccctttcccggaccgaattgtcctttaaaattttttggtcttgtaatatatatattacatatatcttggttccaatattttaatttcttccttttattcaagcatctaatattttgggaagcctaccataagagttttaatgctccctaactcaattccagtgctcaaaccggagacctctgtgtatttctcttcttgaagttgtagttctaattagtaatttttgctgaaaaataaaaaaggaaagcccgatacacgaagcatctcgtgttcacgcaggattcgggaagggccgtacccaagggagtgtgacgtaggaagtctaactcgatgcaagcatattttattgtaatttgttcaaatttttgtttgaggatcaagttgacaagttctcaaaattacattgggctggattaattcttttttttttacacaaaaaattagaattttagttattaataaactaaattataactggttctttttttcatataagatggaaaagtacattttaaaatatgatgaacatgtgattgcagggtgagaagaatgctatagtccaaacagcagcaagcagaattcaagagctgcaaaaatacaaggaaagtttaaagaagagaaatgatgaacttcagatgattttagcagagagtaaaaaggaggaatttgagaaggctaaaatcaaagtaaaaattaattatcccatttatgggatagattcaatgctagaggttctcaagtgtttgaagaactgtggaaccaaagcaaatgccatacaatcaagtttttctcagcaagaattctcctccattctagaaatagaaactaaggttagtgaccattaatttgagtgatagcttaatataaaagtgtttatcttacatattagaggtatatcctttaattcttgtcaaatcttattgcaaataactttgtagtagagaaccttaggcttttttgtggagctacattattcgaattcgaacttagtcagattagtaagtttcggatatcatatatttacaaggaaaaaataactttagaagaggaagtttgtgatactcatggatggagttaccgttcaacttacgagatcagcagaattcgctagctttggtctagaatatgtatttgttttaagatatctatttaatatgtttaaataattatatgaaattcagtaagctactttttcttgaatttagaacgcataaactcaacattatgactatgtgtcttatgatactctcctactaccttgcgctagttccacccactcttgtttcttttccatatcttttaaatgttggttaagttgtctctttcattgatttaatcatgtggctaattatggtcaatttctgatagatcggagcagcagaggtggaaaaagcagtgcaaaatactctatttgaaactgaaaggaactttcgtgcacaccagttgccaatgacttggttaacttcagccacagaatga

SEQ ID NO: 186 - DNA, 2560 bp, Nicotiana sp.
atgagtgattcgatgataaagaaagggccgtggaaagcggaagaagatgaggtgttgagaaagcatgtgaagaaatgtgggccaagagattggagctccattcgatccaaaggccttttacagcgtactggcaagtcttgtcgtcttcgttgggtcaataaacttcgccccaacttgaaaaagttagtacatcttttcattctacagtattgctttcaattgtcgtcactcttctttgtactcatcatttgttgggttgccaaatttctgttgtaagtgaagtattttcattgtgggaatttcttgttgcattgcttgcaaaactgagtttttggttgagggttttttgtttttgctcttctttttgttgttaaagttgcaattttgttgagattttgtggagtttcagttctatgttgaagcatttcatcgtggggttcccattgttggggttgggaagagttggaattacttaatgcattgcttgtagaaagggttttcggttatgggttctttgttctgctatttttgtcttactataattgccaaaaaaattgtttctttttctgcttttatttttcatagaatttaacaatttgctgagactttgtggaaattgtgttcaagtattttgcatggtggggtttgttgtttttactgtaatattttgtgaagttatgcaatttgctttttttactctgctcttcccgtaaattcgattaaattgttgacatttgatggagaattcaaaaggtgagatttactgccatagcactgatgactctgctatgcgcatcagatgtttgtttatatgcttcgtgttagcattgtgtttctgtcaaactggattttttttttgtttttactatatttctttatgaagatatgccgtttgctttttactctcttcttcttgtaaattcgcttaaattgttgaacttggacggagaattcaaaatgtgagatttgctgctatagcagtgatgatgttgcaatgcgtatcagatgtttgattatatgcttagtgttagcatctgcttctgtcaaactggaaatgtatttgatgaaatgaaggtgatacctcttttgttaattattcattttcttttctttttgaatgagtagtggagtgaagttttcagcagaggaggagaggactgtgattgaacttcaggaacaatttgggaacaaatgggctacaattgcaacctatttgcctggacgaactgacaatgatgtcaagaatttttggagtagccggcagaagaaattggctagaattatgcggacctcagtaccacagcctagtaagccccagaagagtaacaacagggaacctcctgctcttcaaaaacttccttcagtagaggtaattctatattcttctcatccctatactgctctctggtttatcctctagtgttgtcaaattttaccggacttatttaaatgaatcttctgttatatcggtttagctgagacattgagacatttttgactggtatttttctcaagatctggtaaaatgggcatttgaaaacttatggacattgtatctctcagcttcctcacttgtggtcagtctgtgacagtttagtcaaaacttctcagatagaaagaaacattgttaagataagtaaaaaagctctaattgtagttgtcttactcttaaccagtcaataaggtcaggggccgatctatagctaaaattacggggcacgtgaacccatggtccttccgccaaactaagtattttatgtacgtacttcctagaattggtctaatattatgtggaggcacccatgctccataaagttttaatggtgcatttggttcaatatttaattatttactaaaagaaaaggggatcaattcccacttaacacatttttttctcctttcttcggtagtgcacccacattctaaaaatcctagatccgcctctgaataaggttgcatgtttatgccttttcactgaatagttatccccacaatttgtcattttcagcttgtggattggattatctctttctttttattgaattttcagggaccaaaattgagctcattggcagaggaaaggtctttgtccatgtcccagtattgcccatcatcctatatgaataaccctgatacaatcaacatggtccaatggccagagttagtgaattcaacttcacttcctttcgagccagatttgcttcaacctgagttcattcctaatgagaaaagaacctgcttcgggtcacagattacactcccctttcctcagattccgctgcaagctgactttggtcacccactggaaagtcaaatattacccatgaaacttgaggaatctgacttcttagattttttcgggcagctcagtgcttcagacataggagatgtgcaagtccctcttgtaccagcatcatggtcaggaccagagaaaagctctgagattattactatgaagagagaaattgacgtcccccttacaccagatagcttcatcgatgacttccctatggatatgtttgatcatatcgatccactgccaagtccattcaattggtga

SEQ ID NO: 187 - DNA, 726 bp, Nicotiana sp.; identical to SEQ ID NO: 184

SEQ ID NO: 188 - DNA, 744 bp, Nicotiana sp.
atggaagagttctttcaaattcaatcttcacaaaccaataatggagaggttttatggtttgaaaatgaagcttttttgatgaatcaaagtgcttttgcgagtttcagaaaccaatccattgaaggatttggagtttctggctatggaaatgtatcggcgaatcatcggaacatgaacaagaggatgatggagtttttgaaaaagagttggattcctaaaattggagaagtgaaaatggaaagagagaaagtgcataaacatatgattaaagagaggattagaagagaaaagcagaagcagagttatttggatttgcataaattgctcccaatgggaaccaagggtgagaagaatgctatagtccaaacagcagcaagcagaattcaagagctgcaaaaatacaaggaaagtttaaagaagagaaatgatgaacttcagatgattttagcagagagtaaaaaggaggaatttgagaaggctaaaatcaaagtaaaaattaattatcccatttatgggatagattcaatgctagaggttctcaagtgtttgaagaactgtggaaccaaagcaaatgccatacaatcaagtttttctcagcaagaattctcctccattctagaaatagaaactaagatcggagcagcagaggtggaaaaagcagtgcaaaatactctatttgaaactgaaaggaactttcgtgcacaccagttgccaatgacttggttaacttcagccacagaatga

SEQ ID NO: 189 - DNA, 936 bp, Nicotiana sp.
atgagtgattcgatgataaagaaagggccgtggaaagcggaagaagatgaggtgttgagaaagcatgtgaagaaatgtgggccaagagattggagctccattcgatccaaaggccttttacagcgtactggcaagtcttgtcgtcttcgttgggtcaataaacttcgccccaacttgaaaaatggagtgaagttttcagcagaggaggagaggactgtgattgaacttcaggaacaatttgggaacaaatgggctacaattgcaacctatttgcctggacgaactgacaatgatgtcaagaatttttggagtagccggcagaagaaattggctagaattatgcggacctcagtaccacagcctagtaagccccagaagagtaacaacagggaacctcctgctcttcaaaaacttccttcagtagagggaccaaaattgagctcattggcagaggaaaggtctttgtccatgtcccagtattgcccatcatcctatatgaataaccctgatacaatcaacatggtccaatggccagagttagtgaattcaacttcacttcctttcgagccagatttgcttcaacctgagttcattcctaatgagaaaagaacctgcttcgggtcacagattacactcccctttcctcagattccgctgcaagctgactttggtcacccactggaaagtcaaatattacccatgaaacttgaggaatctgacttcttagattttttcgggcagctcagtgcttcagacataggagatgtgcaagtccctcttgtaccagcatcatggtcaggaccagagaaaagctctgagattattactatgaagagagaaattgacgtcccccttacaccagatagcttcatcgatgacttccctatggatatgtttgatcatatcgatccactgccaagtccattcaattggtga

SEQ ID NO: 190 - protein, 241 aa, Nicotiana sp.
MDSSSCSSHFFYPMNSDLSSDSSWEWSNLNSTNSLPFNLNDSEEMLLFGVLTNAAQETTSETVTSYHVKEEEVSSKSKVVNEIEEKPAKEKSFRGVRRRPWGKFAAEIRDSTRNGVRVWLGTFDSPEAAALAYDQAAFSMRGTSAILNFPVETVQQSLRDMKCHVDEDCSPVVALKKRHSMRKRSLNSKKSSNSNSKVVREVKMEKVNVVVFEDLGADYLEQLLSSSSSDQSSCNEAFLPW

SEQ ID NO: 191 - protein, 247 aa, Nicotiana sp.
MEEFFQIQSSQTNNGEVLWFENEAFLMNQSAFASFRNQSIEGFGVSGYGNVSANHRNMNKRMMEFLKKSWIPKIGEVKMEREKVHKHMIKERIRREKQKQSYLDLHKLLPMGTKGEKNAIVQTAASRIQELQKYKESLKKRNDELQMILAESKKEEFEKAKIKVKINYPIYGIDSMLEVLKCLKNCGTKANAIQSSFSQQEFSSILEIETKIGAAEVEKAVQNTLFETERNFRAHQLPMTWLTSATE

SEQ ID NO: 192 - protein, 311 aa, Nicotiana sp.
MSDSMIKKGPWKAEEDEVLRKHVKKCGPRDWSSIRSKGLLQRTGKSCRLRWVNKLRPNLKNGVKFSAEEERTVIELQEQFGNKWATIATYLPGRTDNDVKNFWSSRQKKLARIMRTSVPQPSKPQKSNNREPPALQKLPSVEGPKLSSLAEERSLSMSQYCPSSYMNNPDTINMVQWPELVNSTSLPFEPDLLQPEFIPNEKRTCFGSQITLPFPQIPLQADFGHPLESQILPMKLEESDFLDFFGQLSASDIGDVQVPLVPASWSGPEKSSEIITMKREIDVPLTPDSFIDDFPMDMFDHIDPLPSPFNW

SEQ ID NO: 193 - DNA, 141 bp, Nicotiana sp.
  modified_base (71)..(71): a, c, t, g, unknown or other
tgaaaagggagatactgctcctacttcattacaaccgtgccataaccaaggaagtaagtcgcgtggtgtanacgatccaccaaactggaggagatacagaggcgtgaggcggcgcccgtggggaaagttcgcggcagagat

SEQ ID NO: 194 - DNA, 141 bp, Nicotiana sp.
  modified_base (71)..(71): a, c, t, g, unknown or other
tttattaacttgagttcagcttaaattaactcataagctaatatgtttgtagtccaacctattaatctctngatagattgggcaagttgaatggatttaagctcaaattaccaccccggtatatagcataaaaaaatgagt

SEQ ID NO: 195 - DNA, 141 bp, Nicotiana sp.
  modified_base (71)..(71): a, c, t, g, unknown or other
gacttacatcctcccccgcttaggatcattcgtcatcgaatgagggtaaaatctaccattatcatccactntggcccaactattacttcatacaccagtggtaccaaattttaactaactccctaaattttcaaaattttt

SEQ ID NO: 196 - DNA, 141 bp, Nicotiana sp.
  modified_base (71)..(71): a, c, t, g, unknown or other
aataatatgtctgaccagcacgataagcagccctaccaaaatctaatgaacccatagattatacattgganaccaggcaatattctcatgaaagaaaaagaagaagaaaaaaaaagctgctggacgacgacttgtaaatgt

SEQ ID NO: 197 - DNA, 141 bp, Nicotiana sp.
  modified_base (71)..(71): a, c, t, g, unknown or other
tgttatttcccatttgtaataaactatgtaatgactcttagtatgtgtttttaataaatgtctttattacnaaaaaaaaaaaaaggatgcagctaaagaaacctgagagtaattgaggggtaaatttcacaaatggtcata

SEQ ID NO: 198 - DNA, 141 bp, Nicotiana sp.
  modified_base (71)..(71): a, c, t, g, unknown or other
ctctgaatcacatgctaccttctctaagagggggattttgtttatcatttttgtgccgataaaattggccnaaaaaaggaagggaaataagaatcccaaagataaaaaaaatttacaaagtaaagaagggagagaaggaaa

SEQ ID NO: 199 - DNA, 141 bp, Nicotiana sp.
  modified_base (71)..(71): a, c, t, g, unknown or other
atttcagatgggatacttactggttacatattgtttatgtactcatactacacttctgtacttaattatanagtgaggcaggtacatcttgctaccagtctggtgcgcgcccctaacttatagttcgagacttccacggtg

SEQ ID NO: 200 - DNA, 141 bp, Nicotiana sp.
  modified_base (71)..(71): a, c, t, g, unknown or other
ttttcaggctttctttgatgttgtgtactgcaagttgtataataacacgccaaacaaagtagggtttgganaaaaaaaaataagaattctaaaaaaaagtagcttttgaagttaagttgaaaaattatatttggaatttga

SEQ ID NO: 201 - DNA, 141 bp, Nicotiana sp.
  modified_base (71)..(71): a, c, t, g, unknown or other
tgaagagggttatggggtttgttggtttttgggttatgttgctgaagcagaaaaatgaaaaaaaacggggnggggggggggaggttcgaagaagacgacctcgggggggtttcaaaagctgtgcagccttttctgtcagct

SEQ ID NO: 202 - DNA, 840 bp, Nicotiana sp.
atggaagatcatcatcttcatcttgaattctccatttatagttcttcttcttcttcttcttcttctataacttcctcctcatttgcaaattcttctaatggcttaaattctccttcaaccaccacttcttctacttcatcatcttctttccatgagaacattaatgcaaaaaccccatcaaatggctatacttgcaaatccaagaaaagctcaaaaatagttcaagatttcaccaaaaatgggaatggtcatgggaatggggagaacaagaaaaaaagaaagaatcaaggtgatgaaaagcatccaacttttagaggagttcgtaagaggaattggggtaaatgggtgtccgaaattagacaaccaaggaaaaaatcaagaatatggctagggacttatccaacggctgaaatggcggctcgagctcatgatgtcgcagctttagccattaaaggtaactcggcttatcttaatttccctcatttagccgatcaactcccacgaccagcctccacttcccctaaggacatccaagcagcagccgctaatgcggccactagtacgtttctcgagaaaaattccgtcagagatgaagttgagtcccaaattaaactgcacagttcacattcatcgatgaatttagccttagagaacacacaagaattgctaaattctccatcgatagaccacgatgacacattttttgatctacctgatcttaccatcgatcaagtggaccaaaatgaccgttatcaatacccaatctcaacgtggcagctggctggagccgatagcggaatatttcggctcgaggagccatttttgtgggagtgctattag

SEQ ID NO: 203 - DNA, 1047 bp, Nicotiana sp.
gtgcacagatacatacaatattaggatatttgagcttcctggaaattcctaataagatataactaatgacgactatatatacacaaaaccttaatttctcaatacttgatcaactccagtgagatagctgaggaacaggaaatcccagaaaataattttcctagtatttgtcatgcagcctggaatttcatcagaaatatttgacctaagcaatattctaagctacgattccatggaacatttctgtgaagattcttcctttccagaaatgagctcattcaataatattattggttcttcccaaaatattaaccctagcagcagcacaaatgaccaaaaaagcaatgaaaagggagatactgctcctacttcattacaaccgtgccataaccaaggaagtaagtcgcgtggtgtacacgatccaccaaactggaggagatacagaggcgtgaggcggcgcccgtggggaaagttcgcggcagagataagggatcctataaggaaaggcgctaggctttagctcgggacctatgagacgtgtgaggatgcagcattggcttatgatcgatcagcgtataaactacgaggggcacgagccttattgaatttccctcatttgattggctctaatgtattggagcttaatagagtgaaaccgaagaagcttttacactctcttgagctgtcctctccgtcccaaacaaccagcgagtgtactactccaagtccaatgaagagaaatgttgagttaataaacaacctagccaaagtcaatttgaatagtcatagtttgagttggggactttggactaatagtacttttgggttataaaaattagggtctcccaaactcgaaggcaataattagaatttaaagttaatagcttctgagctgatcaccaaacacattcccaaaaaaaaaagaagatcaacatgcatgaggagtagttatatgtagcaaggaattacatggcgtgtaataagtattgtattacgacctcaaatttttgctaatgcttttggtaagtggataagctattgtttacc

SEQ ID NO: 204 - DNA, 840 bp, Nicotiana sp.; identical to SEQ ID NO: 202

SEQ ID NO: 205 - DNA, 348 bp, Nicotiana sp.
atgcagcctggaatttcatcagaaatatttgacctaagcaatattctaagctacgattccatggaacatttctgtgaagattcttcctttccagaaatgagctcattcaataatattattggttcttcccaaaatattaaccctagcagcagcacaaatgaccaaaaaagcaatgaaaagggagatactgctcctacttcattacaaccgtgccataaccaaggaagtaagtcgcgtggtgtacacgatccaccaaactggaggagatacagaggcgtgaggcggcgcccgtggggaaagttcgcggcagagataagggatcctataaggaaaggcgctaggctttag

SEQ ID NO: 206 - protein, 279 aa, Nicotiana sp.
MEDHHLHLEFSIYSSSSSSSSSITSSSFANSSNGLNSPSTTTSSTSSSSFHENINAKTPSNGYTCKSKKSSKIVQDFTKNGNGHGNGENKKKRKNQGDEKHPTFRGVRKRNWGKWVSEIRQPRKKSRIWLGTYPTAEMAARAHDVAALAIKGNSAYLNFPHLADQLPRPASTSPKDIQAAAANAATSTFLEKNSVRDEVESQIKLHSSHSSMNLALENTQELLNSPSIDHDDTFFDLPDLTIDQVDQNDRYQYPISTWQLAGADSGIFRLEEPFLWECY

SEQ ID NO: 207 - protein, 115 aa, Nicotiana sp.
MQPGISSEIFDLSNILSYDSMEHFCEDSSFPEMSSFNNIIGSSQNINPSSSTNDQKSNEKGDTAPTSLQPCHNQGSKSRGVHDPPNWRRYRGVRRRPWGKFAAEIRDPIRKGARL

SEQ ID NO: 208 - DNA, 699 bp, Nicotiana sp.
atggaaatgaatctagctgacgaaaccttgtttttctctgagtctcatctccttgaatcgataaagcaacatcttcttgatgattcagatttttctgaaattttttcgccgatgagttcaagcaacgaaatattgcctaacagtcctagctcaagttttagcagcttcgactgcagcttcctcaattgggatgaaaactttgaggaaacattaataccaactgatcaaaatccttcacatgagaagtgctccgagtccgaggagcaaacccagggcccagcggtggtgcgtgagaaaaacgcgccgcgagattggacgcggtatataggagtgaaacggcggccgtgggggacgttttcggcggagacaagagacccaagtaggaaaggtgaaggtgcaaggctgtggttaggaacttacgagaccgcagaggatgcagcgttggcttacgatcaagccgctttcaaaatccgcggctcgagagctcggctcaattttccccacttaattggctcaaacatgcctaagccggctagagtaacagcgaggcgtagtcgtacgcgctcacccgagccatcctcttcttcatccacttcatcatcagaaaatgtgccaagaaaaaggaatatagatgtgataaattccatagccaaagccaaattcctttgtcatagcttaaatttacagagattagcttaa

SEQ ID NO: 209 - DNA, 1173 bp, Nicotiana sp.
ttttcagaaatgaacgtgactgcagttctagagatatatcatttctttaattgatgaagatcagtacattatttaatttatcatcaaacattattagaataatgaaaataaaaaagcagaacatacacgtgcttaaaattgcaccttcacggaaattccaaaaagaaaataaaggtaatgcagagtctagagctacaatttgaagggcaagcgtataaatagtcgtacgcaataagccctagtaagaacaagttcaagaaactattcatccaaaacctaattagggcaaaagaaaagaaaatgaatccagctgataatgcaaccttctctttctctgacgttgattttcttgactctattgagcaccatcttctgaatgattccgatttttctaacagtttttcgccgatgagttcgagcaatgtcgcaactcctaatagtcctagctcaagttttggcagctgccttttggatgaaaacattgaagaaacaacaattctcgaatctcaatccgagcccgaggagggtggaaaggcagcgcgtgaggaaaacacgaagcaatattggaggaggtacataggagtgagacggcggccgtggggaaaatttgcggcggagataagggacccggagagaagaggcgcgagattgtggctaggaacttatcagactcctgaagatgcagcattggcgtatgatcaagccgcttttaaaatccgcggctcgagagctcggcttaattttcctcacttaattggctcaaacaatatgcctgagccgactagagtaacagggatacgtcataattcacgctcacttgagccatcttctacttcatccaccacatcatcggaaaatgggactaaggaaaagaaatatagaggtcataaattctatagccaaagccaaattggttggtcatatccgcgacctagagatattaatataactattcgaaaggaagagttttcagttctttttccaaatgcagcaacattactgcataaataacttactgttcaatcatgttattttcattagtatgttcgttatttatgttttgtatgtagtaattaatgctcattaaattaaatgagcgtaattttttcaaagacaatatgcataatgcagagaaggaatacccgatcgaataagcaaagttctaagaaaccg

SEQ ID NO: 210 - DNA, 576 bp, Nicotiana sp.
atgagttcaaataacgcatcgcctagtagtcctatctcaagttttggcagctccccttcagcagaaaataacttgaacacctccctttgggatgaaaactttgaggacacaatacaaaatctcgaagaaaagtccgagtctgaggaggaaagaaaggggcttgtggtggcgcgtgagaaaaacgcgccgcaagattggaggcggtacataggagtgagacggcgaccgtggggaaagtttgcggcggagataagggaccctgagagaagaggtgcgagattgtggctaggaacttatgagaccccagaagatgcagcattggcttacgatcaagccgctttcaaaatccgcggctcgagagctcagctcaattttcctcacttaattggatcaaacatgcctaagccggctagagtaacagcgaggcgtggtcttacgcgctcacccaagccatcgtcgtcttcatcaacttcatcatcagaaaatgtgacaagaaaaaggaaaatagatgtgataaattccatagccaaagccaaatcggtttgtcatgtttggaacctccagttgttactataa

SEQ ID NO: 211 - DNA, 1177 bp, Nicotiana sp.
gtaaagaattagagttaatattttcagcttcttagagaacatatacctaattaattaagcagcatatgttttcataaaaagacgttttttaaacagcggatatccaaatataaatcttttaacaagtttctaaaagacatttttgcataattttcttagaaagttctctagaaactcttgatcagacggtttcttagaactttgcttattcgatcgggtattccttctctgcattatgcatagtgtctttgagaaaattatgctaatttaacgagcattaattactacgtagaaaacataaataacgaacgtacgaatgaaaataacatgattgaacagtaattatttatgcggtaatgttactgcatttgaaaaaagaactgaaaactcttccttccgaatagttatagtaacatgtgtagattgcggatatgaccaaccgatttggctttggcaatagaatttattacatctatatttcttttccttgtcccattttccgataatggggtggaggaagaagacgatggctccagtgagcatgaattgtgacaactcccttttactctagccggctcaggcatgtttgagccaattaagtgaggaaaattgagccgagctctcgaaccgcggattttgaaagcggcttgatcgtaagccaacgctgcatcctctggggtctcataagttcctagccacagtctggcacctctcctgtcggggtcccttatttccgccgcaaactttccccacggccgccatctcactcctatgtaccgcctccaatcttgcttcgtgtttctctcacgcgccgcctttccgccctgcgtttgctcctcggtctcggattgagattcgagagttgttgtttcttcaatgttttcatccaaaaggcagctgccaaaacttgaactacgactattaggagttgcgacgttgctcgaactcatcggcgaaaaactgttcgaaaaatcggaattaatcagaagatggtggtcaatagagtcaagaaaatcaaggtcagagaaagagaaggttgcattatcagctggattcatttctttttgttgccctaattaggttttggatgaatagtttcttgaacttgttcttactaggacttattgcgtacgtctatttatacgcttgcccttcaaattgtagctctagactctgc

SEQ ID NO: 212 - DNA, 1108 bp, Nicotiana sp.
tgttgtgggttgaatttcctagtgggcttagtttttttttttaaattttttttcttcaatttttttctttatcagtttactccgtggaaaggaatatctctaccaatttggatggagctgctagtttttttttttttttgctgctaattattttgcttggaaggcatagctcccgatttcaggagctttaggtgattattctaaattctaatacaaaaaaatagaatacccttaattaattccttccaaatacagttatagcagcatttgtaggttccagctatgacgaataaattttgctttggctatggaatttatcaaatctattttcctttttcttgtccccttttctgatgatgaggtgcatgaagaagacgatggctcgggtgagcgcgtacggctacgtctcgctgtaactctagccggcttaggcatgtttgatccaattaagtgaggaaaattgagccgagctctcgagctgcggattttgaaagcggcttgatcgtaagccaatgctgcgtcctctggggtctcgtaagttcctagccataatctcgcgcctcttctctccgggtcccttatctccgccgaaaacgtcccccacggccgccgtttaactcctatgtaccgtctccaatcttgtgtcgtggttttctcacgcgccaccacatgcccctttgtttcctcctcggactcggacttttcttcaagttggagatttggtattgtttcctcaaagttttcatcccaaagagaggtatccaagctattttctgccgaagggaagctgccaaaacttgagctaggactattaggcaatgcgttacttgaactcatcggcgaaagaatttcagaaaaatcggaatcataattcagaagatggttttctattgattgaaggaaatcaagctcagagaaagagaaggttgcattattgggattcatttacttttctatagatatttggatgagtagtttctttcactttcacttactagggtttattaattctggatgaatagaattgttgatatcctacgtctatttatatgcttggcctatgattggagctctagtccctacctttattttttgtaaggaatttctg

SEQ ID NO: 213 - DNA, 683 bp, Nicotiana sp.
gaatccataaagcaacatcttctaaatgattcagatttttctgaaattctttcgccaatgagttcaagtaacgcattgcctaacagtcctagctcaagttttggcatctccccttcagcagaaaatagcttcgaaacctccttttgggatgaaaactttgaggaaacaataccaaatctcgaagaaaagtgcgagtccgaggaggaaacgaaggggaatgtggaggcgcgtgagaagaacgcgccgcaagattggaggcggtacatagtagtgaaacggcggccatgggggacgttttcagcggagatgagagaccccgataggagaggggcaagactgtggttaggaacttatgagactcctgaggatgcagcattggctccgctttcaaaatccgcggctcgagagctcggctcaattttcctcacttaattggctcaaacatgcctaagccggccagagttacagcgaggcgtagtcgtacacgctcacccgagccatcgtcttcgtcgtccacctcatcatcagtaaatgtaacaagaaaaaggaaaataaatgtgataaattccatagccaaagctaaatcggtttgtcatggttggaacctccagatgttaatataactatatttggaagggtatatatttagtgttttagtattagaataacgtttttaaattttt

SEQ ID NO: 214 - DNA, 1124 bp, Nicotiana sp.
atgcataacataaatgtgcttaaaatggcaccttcacggaaattccttacaaaaaataaaggtagggactagagctccaatcataggccaagcatataaatagacgtaggatatcaacaattctattcatccagaattaataaaccctagtaagtgaaagtgaaagaaactactcatccaaatatctatagaaaagtaaatgaatcccgctaatgcaaccttctctttctctgagcttgatttccttcaatcaatagaaaaccatcttctgaattatgattccgatttttctgaaattttttcgccgatgagttcaagtaacgcattgcctaatagtcctagctcaagttttggcagcttcccttcagcagaaaatagcttggatacctctctttgggatgaaaactttgaggaaacaatacaaaatctcgaagaaaagtccgagtccgaggaggaaacaaaggggcatgtcgtggcgcgtgagaaaaacgcgacacaagattggagacggtacataggagttaaacggcggccgtgggggacgttttcggcggagataagggacccggagagaagaggcgcgagattatggctaggaacttacgagaccccagaggacgcagcattggcttacgatcaagccgctttcaaaatccgcggctcgagagctcggctcaattttcctcacttaattggatcaaacattcctaagccggctagagttacagcgagacgtagccgtacgcgctcaccccagccatcgtcttcttcatgtacctcatcatcagaaaatgggacaagaaaaaggaaaatagatttgataaattccatagccaaagcaaaatttattcgtcatagctggaacctacaaatgttgctataactgtatttaatttggaaggaattaattaaggttattctatgtctttgtattagaatttagaataattccctaaagctcctgaagaacgaaacttgtaaacatctctctgtctccgtatcatgttctaatttaacatgaaattacatgagcgcatcataaatataactaaatctgttcgatatatcaggataataatttttcattaattagtatatttctatcaacgacaatatgcttagta

SEQ ID NO: 215 - DNA, 699 bp, Nicotiana sp.; identical to SEQ ID NO: 208

SEQ ID NO: 216 - DNA, 603 bp, Nicotiana sp.
atgagttcgagcaatgtcgcaactcctaatagtcctagctcaagttttggcagctgccttttggatgaaaacattgaagaaacaacaattctcgaatctcaatccgagcccgaggagggtggaaaggcagcgcgtgaggaaaacacgaagcaatattggaggaggtacataggagtgagacggcggccgtggggaaaatttgcggcggagataagggacccggagagaagaggcgcgagattgtggctaggaacttatcagactcctgaagatgcagcattggcgtatgatcaagccgcttttaaaatccgcggctcgagagctcggcttaattttcctcacttaattggctcaaacaatatgcctgagccgactagagtaacagggatacgtcataattcacgctcacttgagccatcttctacttcatccaccacatcatcggaaaatgggactaaggaaaagaaatatagaggtcataaattctatagccaaagccaaattggttggtcatatccgcgacctagagatattaatataactattcgaaaggaagagttttcagttctttttccaaatgcagcaacattactgcataaataa

SEQ ID NO: 217 - DNA, 576 bp, Nicotiana sp.; identical to SEQ ID NO: 210

SEQ ID NO: 218 - DNA, 654 bp, Nicotiana sp.
atgaatccagctgataatgcaaccttctctttctctgaccttgattttcttgactctattgaccaccatcttctgattaattccgatttttcgaacagtttttcgccgatgagttcgagcaacgtcgcaactcctaatagtcgtagttcaagttttggcagctgccttttggatgaaaacattgaagaaacaacaactctcgaatctcaatccgagaccgaggagcaaacgcagggcggaaaggcggcgcgtgagagaaacacgaagcaagattggaggcggtacataggagtgagatggcggccgtggggaaagtttgcggcggaaataagggaccccgacaggagaggtgccagactgtggctaggaacttatgagaccccagaggatgcagcgttggcttacgatcaagccgctttcaaaatccgcggttcgagagctcggctcaattttcctcacttaattggctcaaacatgcctgagccggctagagtaaaagggagttgtcacaattcatgctcactggagccatcgtcttcttcctccaccccattatcggaaaatgggacaaggaaaagaaatatagatgtaataaattctattgccaaagccaaatcggttggtcatatccgcaatctacacatgttactataa

SEQ ID NO: 219 - DNA, 690 bp, Nicotiana sp.
atgaatcccaataatgcaaccttctctttctctgagcttgatttccttcaatcaatagaaaaccatcttctgaattatgattccgatttttctgaaattctttcgccgatgagttcaagtaacgcattgcctaatagtcctagctcaagttttggcagcttcccttcggcagaaaatagcttggatacctctctttgggatgaaaactttgaggaaacaataccaaatctccaacttgaagaaaagtccgagtccgaggaggaaacaaaggggcatgtggtggcgcgtgagaaaaccacgacacaagattggagacggtacataggagttaaacggcggccgtgggggacgttttcggcggagataagggacccggagagaagaggcgcgagattatggctaggaacttacgagaccccagaggacgcagcattggcttacgatcaagccgctttcaaaatccgcagctcgagagctcggctcaattttcctcacttaattggatcaaacatgcctaagccggctagagttacagcgagacgtagccgtacgcgctcacccgagccatcgtcttcttcatgcacctcatcatcagaaaaggggacaagaaaaaggaaaatagatttgataaattccatagccaaagcaaaatttattcgtcatagctggaacctacaaatgctgctataa

SEQ ID NO: 220 - DNA, 375 bp, Nicotiana sp.
atgagttcaagtaacgcattgcctaacagtcctagctcaagttttggcatctccccttcagcagaaaatagcttcgaaacctccttttgggatgaaaactttgaggaaacaataccaaatctcgaagaaaagtgcgagtccgaggaggaaacgaaggggaatgtggaggcgcgtgagaagaacgcgccgcaagattggaggcggtacatagtagtgaaacggcggccatgggggacgttttcagcggagatgagagaccccgataggagaggggcaagactgtggttaggaacttatgagactcctgaggatgcagcattggctccgctttcaaaatccgcggctcgagagctcggctcaattttcctcacttaa

SEQ ID NO: 221 - DNA, 576 bp, Nicotiana sp.
atgagttcaagtaacgcattgcctaatagtcctagctcaagttttggcagcttcccttcagcagaaaatagcttggatacctctctttgggatgaaaactttgaggaaacaatacaaaatctcgaagaaaagtccgagtccgaggaggaaacaaaggggcatgtcgtggcgcgtgagaaaaacgcgacacaagattggagacggtacataggagttaaacggcggccgtgggggacgttttcggcggagataagggacccggagagaagaggcgcgagattatggctaggaacttacgagaccccagaggacgcagcattggcttacgatcaagccgctttcaaaatccgcggctcgagagctcggctcaattttcctcacttaattggatcaaacattcctaagccggctagagttacagcgagacgtagccgtacgcgctcaccccagccatcgtcttcttcatgtacctcatcatcagaaaatgggacaagaaaaaggaaaatagatttgataaattccatagccaaagcaaaatttattcgtcatagctggaacctacaaatgttgctataa

SEQ ID NO: 222 - protein, 232 aa, Nicotiana sp.
MEMNLADETLFFSESHLLESIKQHLLDDSDFSEIFSPMSSSNEILPNSPSSSFSSFDCSFLNWDENFEETLIPTDQNPSHEKCSESEEQTQGPAVVREKNAPRDWTRYIGVKRRPWGTFSAETRDPSRKGEGARLWLGTYETAEDAALAYDQAAFKIRGSRARLNFPHLIGSNMPKPARVTARRSRTRSPEPSSSSSTSSSENVPRKRNIDVINSIAKAKFLCHSLNLQRLA

SEQ ID NO: 223 - protein, 200 aa, Nicotiana sp.
MSSSNVATPNSPSSSFGSCLLDENIEETTILESQSEPEEGGKAAREENTKQYWRRYIGVRRRPWGKFAAEIRDPERRGARLWLGTYQTPEDAALAYDQAAFKIRGSRARLNFPHLIGSNNMPEPTRVTGIRHNSRSLEPSSTSSTTSSENGTKEKKYRGHKFYSQSQIGWSYPRPRDINITIRKEEFSVLFPNAATLLHK

SEQ ID NO: 224 - protein, 191 aa, Nicotiana sp.
MSSNNASPSSPISSFGSSPSAENNLNTSLWDENFEDTIQNLEEKSESEEERKGLVVAREKNAPQDWRRYIGVRRRPWGKFAAEIRDPERRGARLWLGTYETPEDAALAYDQAAFKIRGSRAQLNFPHLIGSNMPKPARVTARRGLTRSPKPSSSSSTSSSENVTRKRKIDVINSIAKAKSVCHVWNLQLLL

SEQ ID NO: 225 - protein, 217 aa, Nicotiana sp.
MNPADNATFSFSDLDFLDSIDHHLLINSDFSNSFSPMSSSNVATPNSRSSSFGSCLLDENIEETTTLESQSETEEQTQGGKAARERNTKQDWRRYIGVRWRPWGKFAAEIRDPDRRGARLWLGTYETPEDAALAYDQAAFKIRGSRARLNFPHLIGSNMPEPARVKGSCHNSCSLEPSSSSSTPLSENGTRKRNIDVINSIAKAKSVGHIRNLHMLL

SEQ ID NO: 226 - protein, 229 aa, Nicotiana sp.
MNPNNATFSFSELDFLQSIENHLLNYDSDFSEILSPMSSSNALPNSPSSSFGSFPSAENSLDTSLWDENFEETIPNLQLEEKSESEEETKGHVVAREKTTTQDWRRYIGVKRRPWGTFSAEIRDPERRGARLWLGTYETPEDAALAYDQAAFKIRSSRARLNFPHLIGSNMPKPARVTARRSRTRSPEPSSSSCTSSSEKGTRKRKIDLINSIAKAKFIRHSWNLQMLL

SEQ ID NO: 227 - protein, 124 aa, Nicotiana sp.
MSSSNALPNSPSSSFGISPSAENSFETSFWDENFEETIPNLEEKCESEEETKGNVEAREKNAPQDWRRYIVVKRRPWGTFSAEMRDPDRRGARLWLGTYETPEDAALAPLSKSAARELGSIFLT

SEQ ID NO: 228 - protein, 191 aa, Nicotiana sp.
MSSSNALPNSPSSSFGSFPSAENSLDTSLWDENFEETIQNLEEKSESEEETKGHVVAREKNATQDWRRYIGVKRRPWGTFSAEIRDPERRGARLWLGTYETPEDAALAYDQAAFKIRGSRARLNFPHLIGSNIPKPARVTARRSRTRSPQPSSSSCTSSSENGTRKRKIDLINSIAKAKFIRHSWNLQMLL

The invention claimed is:

1. A modified tobacco plant, or part thereof, comprising a non-natural mutation in a polynucleotide, the polynucleotide having a nucleic acid sequence encoding a polypeptide having 100% identity or similarity to the amino acid sequence of SEQ ID NO: 73; wherein said modified tobacco plant comprises nicotine at a level below 60% of the nicotine level of a control plant when grown in similar growth conditions, wherein said non-natural mutation introduces a stop codon; wherein said control plant shares an essentially identical genetic background with said modified tobacco plant except said non-natural mutation; and wherein said non-natural mutation results in a reduced level of expression of said polynucleotide as compared to said control tobacco plant.

2. The modified tobacco plant, or part thereof, of claim 1, wherein said modified tobacco plant further comprises a reduced level of at least one alkaloid selected from the group consisting of anabasine, anatabine, and nornicotine as compared to said control tobacco plant lacking said non-natural mutation.

3. The modified tobacco plant, or part thereof, of claim 2, wherein said modified tobacco plant comprises a nicotine level less than 2.0%.

4. Cured tobacco material from the modified tobacco plant, or part thereof, of claim 1.

5. A tobacco product comprising the cured tobacco material of claim 4.

6. The tobacco product of claim 5, wherein said tobacco product is a selected from the group consisting of a cigarette, a cigarillo, a non-ventilated recess filter cigarette, a vented recess filter cigarette, a cigar, snuff, pipe tobacco, cigar tobacco, cigarette tobacco, chewing tobacco, leaf tobacco, shredded tobacco, cut tobacco, reconstituted tobacco, loose leaf chewing tobacco, plug chewing tobacco, moist snuff, snus, and nasal snuff.

7. The tobacco product of claim 5, wherein said tobacco product is a smokeless tobacco product.

* * * * *